United States Patent 7,745,391 (HUMAN THROMBOSPONDIN POLYPEPTIDE) - sequence listing, part 214

SEQ ID NO: 533286 - DNA, 377 bp, Homo sapiens
tactagccatggcagtggcctgactcggccttcccctgtcgctctgggggctatgacctccgaagagtcggggctccttcaccctgcttcccacacccgggcctgaggggttccctgcgtgagcaggagattcaagacatacagggcgcccagaaactccccgtacgcccaagagccaagggctaacctgcgtcctgagagggcagcgggagttcagtaacaacacgagtgcgacccccttcttcatgacttatggaccacccgccttactccagcccccgggagagaggggagccgcctagaggggtccttcttcgggggaggattcagtccttcctccatttgggcgtacggggaggggatgctctagagacggc

SEQ ID NO: 533287 - DNA, 235 bp, Homo sapiens
actgagggtcacgttggtgtctcctgcacgactttaccctcggttcctgtcttctgtgcacgcagtacttgccgctgtgcaggcccacctctttggctctttgggtgggagcgtttttcctgcttttagctttttctaggttatggccattttgtgtcttttgcggttctgctgtgggggtttgggtttgacgggacagggagcagggtggcggttgaggaccgcttatccactg

SEQ ID NO: 533288 - DNA, 485 bp, Homo sapiens
  misc_feature (63)..(63): n is a, c, g, or t
  misc_feature (94)..(94): n is a, c, g, or t
  misc_feature (177)..(177): n is a, c, g, or t
  misc_feature (199)..(199): n is a, c, g, or t
  misc_feature (214)..(214): n is a, c, g, or t
  misc_feature (233)..(233): n is a, c, g, or t
  misc_feature (344)..(344): n is a, c, g, or t
  misc_feature (389)..(389): n is a, c, g, or t
  misc_feature (477)..(477): n is a, c, g, or t
  misc_feature (481)..(481): n is a, c, g, or t
agtttaggaaatccccccagtgaaaatatttggcctcagggaatatccaacctaggaaggggncagaatccaggaatttaaaggctttccatantccctaggcccttcattccttggttccttcaaccccatttttaggggaacctttccccccataagggttattgttttccccancccccaggcatgggagggatcnccttgagggcccaanagttccgagacccagcccnggggaacttggctggaccctccgtttcctacgaaataaaaataaaaaaattatccccaggtatggtggtgtgtgcctgtagtcctatctactcaagggtggggcaggaggntcacttgagcccaggaatttgaggccacagtgaattaggattgcnccactgcactctagcccaggcaacagaacaagaacctgtctctaaataaataaataaaaataataataataaaaaagatgttttcccnaaantaaa

SEQ ID NO: 533289 - DNA, 949 bp, Homo sapiens
ggaggcggaggttgcagtgggccgagatcgtgccattgcactccagtctgggtgacagagcaagactcattctcaaaaaaaaaaaaaaagggaattttttattaactatattttccgtgaaaaagggtttgtgggtaacctgtgtacgggtattcatttaaaagggacctttcttagtgggtttcacgtaccaataattctagaaagtgtgattaatggtgggacttttaataggttatctggaagtggcatttccttttgggccacattagaccatatgggctaggttctccaacgttttgggcgttatttttaagataaacccttggctggttcaaccaagtcagagaaacctttaagaatttggggatgtgattcttcacagtggagggtaaagaaccattcttaagataatagggaaagggcaaattacaaaggtcctaacaattttcatacgtaagagtttacaaggtaaaataaccttatccatatagggtaatctccgtggtgtagcaccagtatacaataggggatttcataaatcatggacatcagatgaagcagttataaatccacttttcacttggtggctaggaattatggtaattccgggacacttaataattccctcggagcagttcccattggagggttgagttcccctgttcaaagttcaaatcagtcagtaagggttagagatactcaatagcgagtaacaatacgttagtgtgaggagtcttttcccttggaaaatagtggctgaacttatggtctaactttcgggattcatggggcgcgaacgtgcgctgggttgtaaatcatagaagctaatccctgtgggcggaatataaatacaccgcgaattgctagagtgggagaggaacaatctgctgagacaatggtggctgtgttgggacgcggaagtgtgttacgaaattgacacactaga

SEQ ID NO: 533290 - DNA, 172 bp, Homo sapiens
aaatgatttagatatggttatgtaacttttaaatgatttatttaaaaataaaggcctggcatggtggctcgcatctgtagtcccctccctttgggaggccgaggcaggcaaatccctggagccccggagttcaaaataagtttgggcatcatggcaggaccctgtttttcca

SEQ ID NO: 533291 - DNA, 1058 bp, Homo sapiens
agcggatacgaacccctgaggtgctgcttcgtagcgcgcccggggtctgatgcccagaggggctgtgtaatgtaccgtggcggacccgcatgcaccccctgggttgatcgccctgccccgcgtcctcgttctttcggctttgtccttcccatcgtatgtcagaactgcttgcttggagtcggcgcggtttcacgcgcggcggcggcggtcttcgcgccctcctgcgcgcgctcatggtgtgatacctggtgaccgcgcgcgactggtcgcggcggcgctttggctctcgagcagcgggtctcttgccacgggtctcggcgggggcaagccggtccgggcgcgagcgcaggcgtcgcgccgtgcccgacttctaacgtgcctctagccgcggtcgcattgcttgtcacggcttagcgagtcggttccagtcgtggttgataacaacttccagcgtcgtgtcggtccagttttatccttccatgccttggatagagtgatgtttgcactcgtggacggacacattcttggtagactactcccgtttatgcccgttgtgggccttgtgggaaacttcgcgccgagacacttggccgtcatttttaacgcccacaccattccccgagccacccggtctttcccttgtacaccggtgggttgattctactacgtgacctttccgtgtgcccttggcctgcgacggcgggggcgcgtgtcccgtgccttgggcactggcttcgttcgtgcctggattgtacccgcaatagaaccgtaatggtactggaacagcgtggtggcccggtcccgttctggctttggtcaccctggggatggctcttcgcttctcgttgcgcttcttgggcctcacaacccttagtcccttgggggtgacttggagtgctcatccctttccggaaccccatgaatactaatccgtgggcgttagacgcacgcgggacatattaggggcctcacgagaaggagtacaccctttttaatttttaactggagagaggagacgaaaaaggggggcatttccattgaaaccccgaagtccccta

SEQ ID NO: 533292 - DNA, 328 bp, Homo sapiens
  misc_feature (17)..(17): n is a, c, g, or t
  misc_feature (103)..(103): n is a, c, g, or t
  misc_feature (139)..(139): n is a, c, g, or t
tttctcatctgtcactnctattaggactacagtgcaggctgacagctatctgagtgaggtatcgctgacttcacagctcaggagtggcagcaagtgtagcctnaccatctgtgcagaggaggttataaaattagaacancaccttcaacaggcaggcagccgtgcacaacgctcctccatcctttccccccaggagctatgcagaggggggattgtggacctgctgctagttagcagcacaacccacccccattgtgtatgcagcctgacccaacccaactgctcctgcacctctctcagaaaacggctcaggaggaggaggacatcg

SEQ ID NO: 533293 - DNA, 656 bp, Homo sapiens
tggagacagagtctctctctgtggcccaggctggattgcggggccaatctcggctcactgcagcctccgcctgccgggtcaagcgattctcctacctcagcctcctcagtagctgagattacaggctatgcaccaccatgcccggctaattttttggtgtttttagtagagatggggtttcaccgtgctggccaggctggtctaaaactcctgaactgcaaatgatcagcccgcctcagccacccaaagtgttggggattacaggtgtgagccactgtgcccagcgtgatttttttttttattaaaagcaaacttgtccttgggtttggcaaaacaggcctgttccctctcatttagcccatcatttctgggggcctgaaccccaggggtccaaagttttgcttgtgaactttaaaaatgtgaatatgatggggggatgggcctcttctactttcaccttgggcccagggggcataagcgtggctgggagggattaggtgagccccctcgtgtatttgggaggctctgagtcttcgggaagcctgtgtagtaactctccggtttctgataaccccgtggcgtccatctggccattaagcctcagcagtgagcaagcaatccatactcattctatgtcctgtcctcctcgacccctg

SEQ ID NO: 533294 - DNA, 1352 bp, Homo sapiens
  misc_feature (217)..(217): n is a, c, g, or t
  misc_feature (299)..(299): n is a, c, g, or t
gcgcctggtggtcacctgcgtacgactttggttactgcccgagaggctactgagtggtatcagtgagaggcctttcgtggccggggccagtgcacgcatcgtgatccctgcatggatcaacggctgcgggcacagggagagacgcgggcgagcagctggcccgcgaggcacaagctatccccaatcgggacctcactacagctcataccctgcttcngcacggtctcagcaccacaggtggagaatcactggacctcgacctgtgagcgtccatcatccgagtgcatccggcctctggnacagtgcttctttcgcttgggacgaacggagtggcgtagtatccggcggagtgccgctggtggcccgaggcgccgcggaaggaccagattgctgaagtttctttgccccgttctaaggaggttgcccgcgaggcaaccgcgacggccttagcgattgaggaggtgaagtgccattcagactgggatgtgcacccacgcccgaaaaatgtcggtccagaccatgcgtaggtgatttgactcggtcgagggacgctcagacaggccgcgagacatacaaggctagcatattcctgtggcatgggctcgacattgagcggcccagggagaccccccccaaccgaccacaggctgcgcaacgggagacgagcaacaaggcaacggtgcgaccagtatgcctccccaagaggccgcttgttgccacaggattgtatccgacccgaggggccgaccttgtcaggggaccgtaattggcggtgtggcggctatttgaacgcgcggaaggtgcccggctttgggatgccgcggcgtggtttggcgtttgagcttggcacgtatgcgcttgggaggcgtccccccgcggagctggtgagccttcgtccgtgtcgcgcgtcggaaagccggctgaacggccccggggtcccggccggtgtgggccccctttctcccggcccacgggtcctgccggggttgggacaggaacgcccttcggctgggggccctgaagagcactttgcgggcccggcaacacttgtttcccgcttcagcctgctgtgtccctgggggcccttggcggcggggtcctgggaaaagggtacccctaagcggggccaaagacccttggacaagccgaaggcttgattgggcgcaacccccgggcttaccccccaggtgttgccttcccaaccgggcgagtgcggttggaagggcccgacggctttctcttggctccttgggaagcaggttgcatgaacttgggcgtctcaacggggccaacgcttgcgtggccaaattggccagattgggtttacttttgggccctcaagactgtgatca

SEQ ID NO: 533295 - DNA, 101 bp, Homo sapiens
cgttttacattcaaggaggtgtgttctgtgacgcacactggcgaaatgcaaggagtgtaagaggctagacggtattgcgatgtgctcacatcagtgataac

SEQ ID NO: 533296 - DNA, 806 bp, Homo sapiens
gcctttagctctgttcctccagtaataaaaaagttaaagttgtgcgtctctgaggctccatgaacttgaagatattatgaatagataggacgagacataatattataatagcagaagatccaaaatagaagataaaatacagacaaaaacacgtaagcagacaacaggagtaagaagacaaacaagagaacacagagacaaaggagaagtagatgagaagcaaagaatagaagaagtagaatacaaaagcagaaaggaaacaaaaaaaacacgaagaataaggaaacaaagaaataaaacaggaaacaggaaaaagaaaagaaaaagaaacacagaaagggagaaaaaaaagaaaaaagaaagaaggaaaagaaaaaaaaagaagaaaaaaagaaaaaagaagaaaacaagaaagaaaaaaaaaagagaaaagaaaaaaaaaaaaaaacagaacaaagaagaaagaaaaaagaaaaaaagaaaaaaacaaaaaaagaaaagaaaaaaacaaagagaaaagaagagaaaaaaaaagagaaaaaaaaaaaagaaaagaaaaaaaaagaaaaaaagaaaaaaaaaaaaaaaaaaaaaaaaaaaagaaaaagaaaaaaaaaaaaaatacaaaagaaaaaaagaaaaaaaaaagaagaagaaagaaaaaagaaagaaagaaaggaaaaaagaaaagaagaagagagagaaaaaaagaagaagacgaagagagagaaaaagagaaacacgaaaagagaaagagaagagaaagagaagaagaaagaaaaaaagaagagaaagaagaaagagag

SEQ ID NO: 533297 - DNA, 462 bp, Homo sapiens
tgtggagtaccaaaagaaccaaatttagaggtgacttcaaaagtactgaggtcatcaaagacaaagaaagaatgaggagctcctctcaggaggagactaacgagatataattaaaggcaatatgtaacctttttttttttttattttggaaataaagtctggatctgtcgtcaaggcgggagtgcaggggtgcgatctcggctcagtgcaacctcgtgcctcccatgttcaagcagatctctgtgcctcagcctcccaagtagctgggattataggcgtgagccaccacgcccagttattttctgaatttggggtaaagatggtgtttgccatgtgggccaggctggtgtcttgaactcttgacctcaagtgatccggcggtctcggcctcccaaagtgctaggattacagttgtgagccaccgcgccgggcctattataattcggagacagggtacactac

SEQ ID NO: 533298 - DNA, 377 bp, Homo sapiens
tcagaggatccccgtccagtaaggtgtgccacagagtagctcgacttggcctctgggcagcaaagcctacagtatctggcccgttggagaggtatcaagcccttttcttcatcatttaacgaataacattactggaggagtctaagtcatttggcatacttataaatatagaatactaactagtaagtagacggacctcataggacagaaagcatcagaaatgagaggcactaagaggaaaatcatagtaagccctagcatacaggaagtaaccaccctgagcaaccacacctcaggaagcacccaagagcaagctccacggacgagcggaagcacccacacaggacccacctcttatgtgggcacacattatggag

SEQ ID NO: 533299 - DNA, 1012 bp, Homo sapiens
gactacaaagtatgttgcaggtggggggagcatagacaaacgcatggagcatattaagaagagagtcggggcgggcggggtggctcatgcctgtaagccccagcctcccaaaagtgctgggcatttataggcagtaaaggcacaccgcgagcctgtgggcataagccgccgagctgtctttactgagagtactatttcttcttgccctagggcggctattggtggcgagcaaaaaaagggtctagttgttctgaattcgccctgttacgcccatggtggctccttgggttttcccacgcatgctgctcctgcagctccacattctgccccctgggacgggctctcgtgtggttgcccctagcatggggaggcagtggcacgaatgagagttcattgctcgcagacctagttctccctgcaagttaggaaggagcggattgctcgccattcgatgtctcgcaagtgcaaatgctttggaaggccacgtgctccagaggccaccaggaggccagtgctagggaacagggcccccactgtgttgactggccgctgtaataaagagtggcatgacctctatagagacatgctctgaagggatcttggaaaccatggggtaatccaacaaagtgttcaaagggtacatggcttcactttcagtagggcataagcttggtaacccctgatatatagatcggagtctggatatgcttagatctcagaatggaagggtactaaagaaaaattccagaaatacccggattcagatgtacaaaactgtgtgacgatcacggacagagccaggcgaagcaaagggagttgataaccatttcatataaaggcaggatttcccccattaaggacggcaagtaaccggcacgacctattggaggcaaggctctccaaaaagagccacgggatacatgcatgagcaaatctggacagtataagagcacaaaagaagtaaaacatgtatcggacacactaccagaacggctaaaccatctgcgcggga

SEQ ID NO: 533300 - DNA, 424 bp, Homo sapiens
  misc_feature (34)..(34): n is a, c, g, or t
  misc_feature (70)..(70): n is a, c, g, or t
  misc_feature (77)..(77): n is a, c, g, or t
  misc_feature (84)..(84): n is a, c, g, or t
  misc_feature (109)..(109): n is a, c, g, or t
  misc_feature (137)..(137): n is a, c, g, or t
gcctctagaggggtagaggggtccataggtaaancggccctattcaagattttaggggattaatctaggncgatggncatgaanctgtgtttgcccacagatttcagancattgccgtagaaaccccggtcgtgtancggtgaaagtggtttggtttagacgtccgggaatgcatctgtttttaagcctaatgtgggacagctcatgagtccagacgtcttgtgatgtaattaataaacgaatgggggcctcaatcgggagtactactcgatttccacctcaaggagtcgcaggtcgcctggttctaggaataatgggggaagtatgtaggagttgaagattagtccgccgtagtcggtgtactcgtaggttcagtaccattggtggccaattgctcgtgccgaattcctgcagcccggggatc

SEQ ID NO: 533301 - DNA, 346 bp, Homo sapiens
  misc_feature (21)..(21): n is a, c, g, or t
  misc_feature (23)..(23): n is a, c, g, or t
  misc_feature (197)..(197): n is a, c, g, or t
  misc_feature (307)..(307): n is a, c, g, or t
  misc_feature (315)..(315): n is a, c, g, or t
  misc_feature (334)..(334): n is a, c, g, or t
tctttggctcactgcaacctncngccgttccaggtccaagtgattctcccgcctcagtctcctgagtagctgggattacaggtgcccaccaccacgcctagctaaattttttttgtatttttagtagagacgggatttcactatattggccaggctggtcttgaactcctgacctcaggagatccacctgccttggnctcccaaagtgctgggattacatgcgtgagcaaccgcgcccggcccttgtcctgtttttttaatcttaaaagttgctgggcacatagtagtttgtcttttaagtgtccantgaatgantatttgtggcatatagtantttcatagggtt

SEQ ID NO: 533302 - DNA, 272 bp, Homo sapiens
  misc_feature (262)..(262): n is a, c, g, or t
caaacattgtatgcttatcccagctacttgggagactgagcaaaaatcacttgaacccgagaggcggaggtgcagtgagccagatgtgccatgcattccagcctggacagaggagcacagctgtctcaaaaaaacaaaacaaaacaaaaaagaacatatgaggctggccatgatggcactttatgaggctgaggtggacagatggcttgaacctaggagttcgagacaagcctgggcaacttggtgaaaccctgtctctacnaaaaatacaa

SEQ ID NO: 533303 - DNA, 133 bp, Homo sapiens
ccgagtctggggtgatgtagggtaggacggaagaacatgtggaacgggcagacagcagatggcgaaggtgcacaccacgacaatcatcatttgaccacctggcaagagggtgagacaggtgagaccaccagat

SEQ ID NO: 533304 - DNA, 136 bp, Homo sapiens
ccggccgcagccacaggacgaggcgctgctcgacgatctttttgcgcgctatacgatggagcgcgagcgcgaggtccaccgggacttcttgcaagccctcgggctctcatcgagcgccgccgcccgccgggtcgag

SEQ ID NO: 533305 - DNA, 160 bp, Homo sapiens
aaatagttaagagattttattctaatagctataattacagcgcttgtttctcgaaatgaaaactgaaaacaagtatacaaacagttgattactaatcgcgtattggaaagcagtaagaggttccacgacaccaatagacagtctgaggattccaagataa

SEQ ID NO: 533306 - DNA, 381 bp, Homo sapiens
tggggaaagatcacatgggtcgagggtttctctactggtcaggatgcttttctcataagggtcgacttttttcaccagtcacataaacactatgtggactggcagtggttctctgctcctccacatcctggagcgtcccagcacctccccacctacttttgttcccaatgtcagccaccatgccttagcagctgaacaatcgagcctcatgctcatgaaatcatggtcccaggcggctccacctcaaagagaaagcctggaaggaaatgttccaactccttagaagggtcgtgcaagctgctgtgggagggtaagcacccctcccagcacagaaacctttcctttgaatcaataaagttttatgtcggcctgaaaaaaaaa

SEQ ID NO: 533307 - DNA, 662 bp, Homo sapiens
ctctgcttgaatgcccgtccttttccagagtccggctatgcactttgcctatgacacgccctttcgtggtttcatgatgctcacagatacactggtccattatgctggacagagctcattcaagtgaggcaagagagtagctcttcaagtaccgctagggcaggagtatgagtacaggttacatggcctaggttaaccagagtccctggactcatgaaagcatggtcgcacacttgagattcgcatgtgctttacactgtaaccgtgccctataaggttatacagggccattgcacagccagagacacagtgtggattccatggacagtcctcgctcgatatagatgccaccgatggtccagctgcatttccagccatggccctaggccacactctctgtgtagacatgctattcagtgacagggtcgtaataccttgggccctgtgggtttatccaaggcaataggactgcctggaccactctcggttggagatctgtcactcatctttcaagtcttagcacgctcacagcactctgtgtaggcctatgcagaggaagagcttggatatagccgtgtaggaaagcctttcggcacactatgcacagtcatcctgatatccttacacacctctctccatgcggtacaggcagtgcgtggccc

SEQ ID NO: 533308 - DNA, 893 bp, Homo sapiens
ggaccgtctcaatcagtggttcccgtcccccttctacagaagtgggtccgcccaccggcggttccgagaagtttcctgcccgcgtggtgcccccccgcaatgttctttgccggggtgcaaccaataattggggtggccacccctttctgggcgacgaaaacattgtttgggcgcgctggtaccgccctagggtggcgttgccggcggccgttactctagctctggtattagtcgatctacagggggtttttatattcttgtgtgcgctgcaaccccgggaactcttgaaccagtcgtggcccgcgggtgtgggccccaccccattccggtgggggcggcgctgacccccccacgaacgggccccacaaaatggggccaggcacacggcaatgcgccgccaagtaggagagttggtgtataacaggcaggtggcccgcacaataggccgaggcgccggttgggccaccggaatgttccctctgtcccatcgggattaagcgcccccccctgtgtctgtcctacaggcaagagcatactgggcccgtcgttcttccccacaatgcccaacaccagggggggtggcaatggcccaacgcgtcttcgtgctataattgaccgttggaagcgccaacctcggtgtggatttggtgtctcccccgtaaaacaggtggtgttttaattcttgcgtcccgtcgtatgacggacgttgccatcttttgtcccccccccccctgtcccccgtttgtggtgtcgccccactcactcgggggaatgtcatggagggagccttgtgcgttcgcccccgtggagctggggcgggcggagacgccccgggcgaccctccccctcccggggccccccggtaaaaaaaggcccccccccacataacaaaa

SEQ ID NO: 533309 - DNA, 1646 bp, Homo sapiens
  misc_feature (127)..(127): n is a, c, g, or t
  misc_feature (134)..(134): n is a, c, g, or t
  misc_feature (432)..(432): n is a, c, g, or t
  misc_feature (1216)..(1216): n is a, c, g, or t
gggggccctccgtgctggggtgaggtcctcagcatcatggacaaggaggatgtgggagcccgaggagggtggagggtggttatcattggacgatgagggcgcgcgcttgtgcaccaagtctaggctnatgtgcntcgcccgcgtacgcctggtggcggaggccgtcctcctgttcacaaggcgatgataggctgagggctgggcccagacattgtgctcttcactctcgccgtcgcacatgcgtctgagaggcatgaggtggtggtgcatgcaagcgtgacacgctaagccccactgggcatcagtgcgcgactagctatggcgacaagtgcagcaacgcaaacatggggggaaccagatcgtcgtccactcatcacacgtctggtaccatcgaagggctgtccctgtgagggcacgccggcaggccgtgcncctatctcgggtgggtcgaggcagaggggccccggtgatagcctgtacatcgaaacgaacagggacgaaggaaaaaggtgagttcatcacttactagggtgtagtagaaggcatgtgagggcagggcactcgagaaatattggtgctgttggacgcgattcgcaagaggcccggtggtcgtgtccaccctgcgtaacggctcttcaggggggtcggcaatactatcttgcgccattttgctccactagggacccgtacttgagtaggaaccgtggggtccaccctcaacgaagcgggtgcgcgcaatcgtacagaggagcgccttatgggcctctcgtacgcaaccccatgggcacactcctgtggacggtttctggtgaacactttgagaggttggggcaccggggggaacccttggaccccaggtacgtgaactccttctactgggaaagggaatccgctacgaggtggagagtcgcgagaggtgttaggcttggctttgccaattggaccctagacggtgacagtttgcgtgtgaacaacttctggtcggctggccagaactatttcgagaggggaggaataaggggttggttgactataagcggttctgagcctggttggaaagcgtttccggaggcgcaatagcgaggatttgggggccatactggtgtgggagagttcctcacgtttctttttttccatggggaggagaagaagtccttaacataggaatggcccagaattgtggcacagaggggtcaattaaacctagttggagaanttataagcgcgaggtaccgggggttattcaccggaaaagaggaggccatggtttcaaaaggccatagcggtgtactaggggacatttgcagagatttcgccgggtgcgtcccacggaaggagcgcggccctttttacaggtgccgccccagtacaagggtgtggcggcgggcgaaataccggctataaacaggtgagtcgacaacaagcggttgtttctagttaaggagaggacacacaggtagtatactgaggctcgcagcagagagatattaagggacacatcgtcagtgtgtgcactgtgcacaaattaacagtttgtgcccaacagagctgaatacctgtggagaagcagacgtacgtatagagaagctcccgagatgatcagagagaagagatccgccctacgccgattcacagctgactctggt

SEQ ID NO: 533310 - DNA, 220 bp, Homo sapiens
  misc_feature (15)..(15): n is a, c, g, or t
  misc_feature (46)..(46): n is a, c, g, or t
  misc_feature (143)..(143): n is a, c, g, or t
  misc_feature (155)..(155): n is a, c, g, or t
  misc_feature (180)..(180): n is a, c, g, or t
  misc_feature (210)..(210): n is a, c, g, or t
  misc_feature (220)..(220): n is a, c, g, or t
tagggggcctgagcntggggtattggaccgattgtatgggcacccntgccacaatgtctggctgtcttcagggagctcccatcccttggctaagaactgggtgatgcggatggtctttcttgggagcaagccttttgccacangctggctggtangctcctgttgggtaaaagaaggganttcagcaaggctcagggaaggaaagtacangggcttgctn

SEQ ID NO: 533311 - DNA, 141 bp, Homo sapiens
gccactttaatttacacttaagagccttagttggacttaacactttcgtagcgcttctcatcgtgtataagttgtgtatgtgtgcatatagcagatagtctgtagccgaggtgggtagagacacttactagtatcatgtcg

SEQ ID NO: 533312 - DNA, 176 bp, Homo sapiens
cgtgtgcacgcacgtgatgaggttggactccgtaaggcagtcacggcatttctcatagtaggatgcaaagaggaacgctcttctcagagaaaggctccaggttgaggttgagcaggtacttggatgccacactcgggccccaagatcccattgtagctgacggtgcgttggcccaa

SEQ ID NO: 533313 - DNA, 259 bp, Homo sapiens
  misc_feature (17)..(17): n is a, c, g, or t
cctccaacgccctcggnagatcgcaccaagcagaggcttccaggtaagtgacgcctctgcaccgagttcaggaaacaggtttcccctgttgactgttacttgcgtttgttttctggggttcttgaacttccagaggtctatttctcttaagaccaactactaccatctctttaaccatcttgggtaggccgtggggatttcagcctttgaaggaaattcccacgggtaggtccggcttaagggggaagtttggggggtc

SEQ ID NO: 533314 - DNA, 153 bp, Homo sapiens
tctcgcgaagctctgaggtccaggtgccttctcctgcagcatgtgaagatctgctggtcttgcaggcaagctacggcagaatgtcgttgaactctagctcatctgtcacgagctcatcgaatgtgcacggagctgctctccacttcctcgtgc

SEQ ID NO: 533315 - DNA, 268 bp, Homo sapiens
gcgtcacttttaagggataactagtatatcgcgtcaaccacctcatatcctccctgactaagccttagaagggattaataactatcgcgtgtgtccattgataagctactttccataccacctccacacccactcccttttaacccatattgtgcctattgccaaaataatttttgccgccttcgaaacaacggtgggcctaaccctaatagtttcaatttcccacacaaatggcctagactacgtacattaccttaacctactccca

SEQ ID NO: 533316 - DNA, 188 bp, Homo sapiens
tactaaattgctgttacctaaattgctgttacctacaattgctgttacctaaattgctgttacctaaattgctgttacctaaatggctgttacctaaatggctgttacctaaatttgctgttacctacaatggctgttacctacaatggctgttacctaacatggctgttacctaaactggcttgtac

SEQ ID NO: 533317 - DNA, 177 bp, Homo sapiens
tgtggatgacctggtggagctataggggaactattgcagaggtgtccgggacagcaggatgacgcggcatcagggcgtgtgcagcgacatgtacaacactctgcgtctggctgagcacaaagccagggaaatagccaggtgctacttgacggcctatccagttatcaaagataacgg

SEQ ID NO: 533318 - DNA, 1210 bp, Homo sapiens
  misc_feature (393)..(393): n is a, c, g, or t
ggtgaggaggacgtccatcgtgaagcagatacattctgcggcaagtagacgcattccctttggggactactccacgaggtaccaagggttgccggggacgtctaacatcgatttacgaaatactgcaatggggatttggcaccaagtggccaggcaagatggatggacatcgatgaccgcttcaactagaggtagtagaggcatagcggtacggtagtgggcacgaatgccatttgtgtcgccggaaaaaagcaagtgggactacccacatgtgttgcaaacctagtcgtgccaatcaggcatattgactctgggagcgagagccatagcacgtgccatgactcacgtgcactgtcgtagtcgtagtctctgcgctcacgaacgttagctagnagggtcaccagtgctgggaacccagatgcatcgagaggacgctaggaatgcgatattctatcccacgcgagaaagtcgggcggagctatctagagttcggaaatcccctgtcgtaacgcgcaaattcgttcgggccacgcatgcgcgagccgtttgagccgatcggggttgggcgtcaccctgggcagggagaggggtctctgcgctctcctcgtacatcttaggaacgtctcatgtggggttcgtagttagtactccgtggaggtgccttgactttgttcccattggtttgttcgttgttgtgtgtcccccctgagtaagggtcggaggtgggggttgtgagcgaaggccaaggagggccatccggcgttctgttcgcggaggccgatctgtccgttggaggcaccaatcaggcctctgtggactctcgggattctcggcttcgcattacccccacatagaggggcccaacgcgttcgcagcgtatagcggggggcccctgggtttaggtgtggcccctgtccccgaagggttctgccgagtgagcagggatacgacgtggttccaaccttatgggcaccccgattgcgtataccgggtgtggagacacaccccttgtggggggttcgcagggggttggccctccaaggttaaccctttgggacctaccttacggaaggggaagccccaaacaattgactcgcccttccacctatcaggttaggctacagggggggggaacaataaaaacaaggctatctagacctgggggaggtttgacagggggagccccaaaaacaagagcgtagtcccaaag

SEQ ID NO: 533319 - DNA, 329 bp, Homo sapiens
gatgctatgtatcccatgcagcgtgttgaatgcagtggatgtatgcagagtggtgcaatgtatctctattgaatgaagtggattccattcagcttggtgtaattgataccgattgaatgcagtggattccatgcactgtgtctgaatgcaaccgattccatgcagcagtgtgaaatgcatcgcgaagtgaatgcagtggattccatgcagcgtggcccaatggataccgactgaatgctttggattccatgaagcatgattgaatgcagtggattccatgcagcactgtgagaatgcataccgcagtgaatgcagtgcgattgcatgca

SEQ ID NO: 533320 - DNA, 113 bp, Homo sapiens
gggcccaaaaattttttgtttgtcctgggaaaggaaaagggggaaattaaaacccttccggttagttttggaaagcccgggatttttccaaaaaatttaaaaatgggctggga

SEQ ID NO: 533321 - DNA, 131 bp, Homo sapiens
  misc_feature (20)..(20): n is a, c, g, or t
gcacaaggctgttgcatggnctaatgaagatcatatacgtgaaaattctttgaaaacatataaagcactatacagattcgaactccattgagtcatatcctcgctaggagatggtgtttgggaatgagggg

SEQ ID NO: 533322 - DNA, 115 bp, Homo sapiens
  misc_feature (4)..(4): n is a, c, g, or t
cggnctcatcctcccaagcagcggggactacaggcgtgagccagcaggccggggtaactttttggtacttttggtagggatgggatttcaccatgaagtagagagccgggtaccg

SEQ ID NO: 533323 - DNA, 1020 bp, Homo sapiens
gagggctattcgagaacacggggctgggtagggccagagaggcccccgacgtgctggcccttccctctatggacgttgcgcttgtgcctgcgctctatgctctctgccgttatcgcccggctagtcagtcgtcctaactcactcacagagaagtccggatcgtggctagagcgcctgcgttcgcacccatgtgacttgtacacggcggcgccactcgcttgaggcttgtccccgtgccaccaccagcccgttctctgctttccggacctggtcgagtcaggaggcgccagtcatgggagtggacatccgagcataacaaggaccgaaagggtgcggcgcaaggagcccacggagccacggagtagtgcgtaccgtgagcgctggttggctcaaggttagtacagcgtatactggcgcagaagaatcaacataccgcagtatcgaacccaggatgaggtggcaacgaggtcggtgcagtgacggtcgcacgcaaacgggccgacgtctgaaaccctgtatcccggaatgaatccgcgaaggatgccaggcattcacgggggcggggagaaaacagagaactggccggggtggctgaggggaagcagtaacgggatcgaatgtagcggggctgcaggcgaggggtatcccaaacacatggcaacgcgtaatgtggcactgggaacacgtggtatcacgcgcgggggccgcgcaggcccggaatcgatcattgggcaacaggggacaacggaatccattcagcgtgaacaggaaccaacgtatgggcgccttggggacttaaacagtagatggtgccatgtgggcaaggtgttacactggcgctgatcccgggaccctcggacaagggggccccgaaccaagggtggttaaccggggcaacaaacgggggaaaggaaccccagggtagacccgcgggagcaagccccagcaccccagaggcccgcacgggtggcgaactcccagaggggccaggacactgtcaccgaaccgtgtgccaggaat

SEQ ID NO: 533324 - DNA, 544 bp, Homo sapiens
atccgccggtccgatggtctgaatcttagctctgccacttactagcatgtgactggggtaagttactgtcttctggtcaggtgcggtggtcacacctgtaatcccagcacgttgggaggcaagggtgtggatcacctgaggtctggagttcaagacaagcctgatcaacatggagaaaccccgtctctactaaaaatacaaaaatgaggccgggcatggtggctcacgcctgtaatcccagcactttgggaggccaaggcagggggatcatctgaggtgaggagttctacaccagcctggacaacatggtgaaatcccgtctcagctaaaaatacaaaaactagccgggcgtggtggcaggcacctgtaatcccagctactcatgaggctgaggcagaagaaccgcttgaacctgggaggcagaggctgcagtgagccgagatagccccattgcactccagcctgggcgacaagagtgaaacttggtctcaaaaaataataatcaaacaaaaattgaaaagatcaccaagcgacaggcccattg

SEQ ID NO: 533325 - DNA, 200 bp, Homo sapiens
tccaagagcagacctttaatctcacttgaagtcattcaggctagctaagactacacgattacacgactcctcccagacaacagataacaattaaaacatcatcctcactcaatcctcgctctacaaactactacttcaccactctgacgtcctttgacttagcgatattaacaaattacacctcatttacactgcatttt

SEQ ID NO: 533326 - DNA, 915 bp, Homo sapiens
aatattgtctgagatcatactatttgggcctgttcccagttcagttgtgaacatgagtcaatatgttttgtggtattccaatccacgcagcgtggactagtgtaatgactgtcaaactgatatgtagaagtgatgaatgggtggtgtagtggactaaatagatgccagatgggattgttggacgtctaataaatggtgttcttgttcgattagtcacgccgggagtagcatctgatgtgaccttagagcacaaggaaattgctaaaaggcacatgccgaagaggaatatggtataattttaaattttaatgcaaaattttaattgtctttattttttatcatttgaactgataagcacttttgtgtgtcaatataaaatatactaaaactgatgaaatgctaagacatgtctgtgtgaaggaaggtttctgtggagaccacttttatttactcatgagaagtggaagctcctagtatcagaagaagctgatacatagtgtcatgtgctcagtggttgccaaagtctaccaacttggggggagctgcagggttcttttgggaggtgggaggaagggagatgagttcgttattgggggtttcaagcattggaaccaaagggcaaataataaacagctttaagttttaaagtaaattcattttatttggagaggtacacttgttttggtagactgctaacgaccactttatgactattattgcccttataatggtcactctgcgtttggttaattaaaaaaaattggggaagcccctttgataggggaaagaaaaggcaagatggttctctaaaatgagagaatggcggggattggatggcggcttggaggagtaaaggataaggagggtgttctataaacgggggggggtctgcaaggtgggaaacgggataaaagg

SEQ ID NO: 533327 - DNA, 744 bp, Homo sapiens
tgcggccgtttgcagcttggcggtagggaggcgtggtggtctgaagcctccgagcagccgtggcatggcggatgtaaccgcccgtagtctgcaatactgagtacaaggcgaactcgaatcttgtgctccaagactgacctgtactctcattgaccggacccgccgtggatgaacccacaggagaggtgctgtcccttgtcgggaagctggagggaacccgtatgggagacaaggcgtcacgcggaccaaagcgaagatgcaagagagtggaaagaaggatgccaaagacgaatgaaagcgtgatagaggaccggcatgaaatcacccacgatgaagggcttactactactgctgtcggaagcgcattgaacgagaatggatgggccatacatcaacatgccctaaaaactaccacgagaactcgcggcagcagcgtagtgaaggtgctactcaccataacataacactgctgtctctagtgtagaacagaccaacggatgatatcccaatttgcaggggggccaaccctgaacctaaaataccatcagcctggaacaatacgagaagttgccgcaagcatagcatagacaaagtcagcggctcaaaagaatgaatcgaacactgctgcatgcatccaaaacgcatcactcccgaacataccatgatcgccaagaatacccagagacaacaacacatcacagaaccagagagcaaaacgacaacaaaaataagctccacacaacc

SEQ ID NO: 533328 - DNA, 356 bp, Homo sapiens
cctctcctagcacattgccagcccccgcaccctccagccgtcatctctcttccccgcctggcgcaggaatggttcatcgtttagcaatggtggctcctcccagtctaccagagtaactgccctctagacacaccatctctggagttcccgtcgtgactcggagacccccgactcctactagcgaaccatgaggttgcgggttcggtccctgcccttgctcagtgggttaacggtccggcgttgccgttagctcgtggtgtatgtagcagatctggctcggatccagcgttgctgtggctctggcgtaggctggtggctacagctccgattcaacccctagcctggggtgctaggag

SEQ ID NO: 533329 - DNA, 350 bp, Homo sapiens
atcttttagggatggagttttgctctgttactcaggctctcagctcactgcaatctctgtctcccgggttcaagggattctttcacctcagcctctcaagtggctgggactacaggtgcattgtgcccccatacccaacatggtgaaaccccatctctcccaaaaaaaaaaaaaaaaaaaaacccccaaaaattagccaggcgtggtggcacatgcctgtggtcccagctactcaggaggctgagtgaggcaggagaattgcttgaacccgggaagcggaggttgtagtgagctgagatggcatcattgcattccagcctgggcaacaatgcaagactctgtttcaaaaa

SEQ ID NO: 533330 - DNA, 373 bp, Homo sapiens
tgtaaccactcgagacatcgcccctgtgttcggtatgataagttaggtttgagcagggagaggtctacttcccagaacgaaccacagtacagtagtacggtagagctgggtatcctgcccggtccatccaaaggttacatccctatgtctcttctctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagcaag

SEQ ID NO: 533331 - DNA, 748 bp, Homo sapiens
gtgcccggctcggggtcatgcttgtcggctggggcgggaacaaggctccacactcaccgccgcggtggttggccaatcgacgtgcgttgtgtcctggccccacgcgcagtggcggcagtggagcgcccaccttacttacggcttcgcttgcacttcacggggggccacgtgtgaagcctgggcgcctgggacctggcctggatggcccgcgggcgggttgttcggtcaccccttttaagccgcggttcgttgcccccatttgttgtgcggccccatgagtaccctctccagtagactccacactcgggcctggggaccaattcctcggtccggcttgagcccccttggcccagaggcctaaatagcagggcagaggcaaaaagggttgctcgaacctggggcgccttggcagtgcagcacacctgtgggtgcccctggatccattggacaatcgccccttgcgggacccggagagcagtccgtggtcacaacgtcccccgggaagttacatcggcgggcaaaacagatgaacgccgcccgcgaaaaaccgtattccacaggaccggggatggcgaaagcacgacggaggagcagaccgcgcgaggaaccacccagggaaaaactcccccgggtcacacagcgccgggctctggaccacagcagccaacacaggcgggcgcgagcaagggagcacacaacgggaagcgcgcaccggggagcggacgcaccccaagggctacacaagagt

SEQ ID NO: 533332 - DNA, 216 bp, Homo sapiens
caatcacttgagctgggaggcgggaggtagtagtgagccaagatcgtgccattgcactccagcctaggcaagcaagagtgaaactctgtctcaaaaaaaaaaaaagaaagaaaatgcacaccccatttttaaaaataggcaaaagatctgaacagacatttcaccaaggatataggaatggaaaataagcatctgcacgcacagctgtacaatcac

SEQ ID NO: 533333 - DNA, 787 bp, Homo sapiens
ccaactcagatctggtgtaataactctcagcttccagttgatcacagtcctggcaggctctttcgaatacagccatgcggctccgttcatgaccacatgtaggggtaatccacgtttggcccctacaagcaactgttcctacagacatacgcccgcaggtcctgcaccaatcctatctaggctctgccctgcctaccctccatgtatggctatccttaatcgcaactggaaggatgcagggctgaatgatatggtgtacctaggtctgttgggccgtgaagcttaatgacctcatcgcagactggtttgcatgcatgtgctaccagcgtcagccgacagttggcacatgttgaggaggctgtggtatggtgccgttccatccttctcagttgttgccatcttcttgttgtggatcacatacactcacatgcacgtacttgctgaggcgcctgcggctcatcaccatgtgccgtgcgtgacattgtgggtttgtccgtggagactgacaggaacgtaagctgcccatgagaggactctagaacagcagaagcgcatctgtgagatggcacgcctatttcagccactcaaacctgtcagccgtgtgcactatgatccgtggtgctgcgtacagccctcaaatcgtgtgcttcacgctcaaagaacttcacagaacaggtgcaccttttgtcggggcctattagaatctgggccaagcctggggtggccggaccgaaaatcttgttgccttggaaaacccaatgcacagtatttctgcaccttgtttggg

SEQ ID NO: 533334 - DNA, 106 bp, Homo sapiens
agccagtaatcctcttagcctcagcctcccaagtagttgagactacaagatgtaccactatgccgtgctagctttttcatttttgtagagagacgggactatcatt

SEQ ID NO: 533335 - DNA, 908 bp, Homo sapiens
agacttcggctgacggaaacgggtattccatgtctcagggagtatgtttgtgcagttactgcttattctgtgtggtatgctataattaataaattggaagctgcccaatgtcatgattcggtgtacaatgagatggatcggtcatgaaagtaatcattggtaatggccacaggattgttgatccctccgtgtaccttggaacgcagacaattttagtaaggacttggaagctggatgtttggtgccagcctattcctgctgctttctacttgtacaggctattcagcatagtaagcgtaccatgcctatattgcctgtgggcctgctctctggtcgaccatccagctttagggattcttacacaggtgtgttgtatccaaaagctatcaccagaaatctaggattgcaaggcctacccattcatagtggctatatcttgcgcatatcttggaagttgctatatctagaggagcttggtgttccagcacatgtatccacgtacattgctcgctctttggggcatagtggcagctgcactgattaataggaactcgaggcgccctcttcttagttggactgagtattagtatgatcctctgaagagtttgcagctgtgcgatgtcgggttattataacctaatgtggtgcctgtgttcaatgtgtctgacaactactggattttcggcctctccattttcacctcttacagtgtacccctgttttttttatgaacgggcctctaggtcccagctttgatccattatctagggaccttgcctactaaggaatgttaaagatgcatgggtaaaaagttcaagaaaaaatccctggattgaagcgcaaagtggcatgacaagggccaaaatattagtggaagtcacttaaggggaaatccatggaaaaccgga

SEQ ID NO: 533336 - DNA, 631 bp, Homo sapiens
  misc_feature (624)..(624): n is a, c, g, or t
aaaattctttatatgacacctagatctttttttggtgccacttttaactgtggaggaaaccccactgcccacatgttcattcaacacagagtgattatccacttagttccaaaaaagttgtgtttggttatgggatttgatcccacttgtccagggtttaggtcagctactgaagattaggatatctgggtacctcttactggagaatccattcctgttttcatttcattcctgggggcaatattcaatctggtgtggccctctgtattataaaatgtttcccagattgtgtttatctgaaatacaaatccaagaagaagcatggtgttaattgccatgtaaaaaagattccagagtcaagagcttgagaagttctattccttccttcataggttcagttgtttaactcagcatttttcaaacatattttactcctagaacctgtttttcctcagacatatttaagaaaaaagcattttgtagaacacatttggacaaatgatactttatatcattgctttgttttttaaattttagtttgactcaattttacagtttcaggattttgtttctgtttcaggttttaagcttttcttttataaatagttactttcctagtctganaaaaaaa

SEQ ID NO: 533337 - DNA, 90 bp, Homo sapiens
gatccacccaggcctttctgtaaataaaagcacccaagttgggtacaaaccaggatattggagctactctatcctggagttaactaggat

SEQ ID NO: 533338 - DNA, 1008 bp, Homo sapiens
gggaagatggcggacattcagactgagcgtgcctaccaaaagcatggcgaccatctttcaataacaagaagagggtcctgctgggagaaactggcaagggagaagcgtcccgcggtacttatcaagaacatctggtcgtgggacttcaaagacagcccctaaggaggctatttgagggcacctacgagttgacaagaaatgccccttctaggtggtaatgtgtccattcgagggcggatcctctctggctgtggtgacctaagatgaagatgcagaggacgcattgtcatccgccgagactatctgccactacatcctgcaagtacaaccgcgttcgagaagcgccacaagaacatgtcttgtacagctgtccccctgcttcagggacgtccagatcggtgacatctgtcgacagtgtggcgatgtgccggcctctgtagcaagacagttgcgcttcaacgtgctcaatggtcaccaaggctgccggcaccaagaagcagttccagaagttctgaggctggacatcggcccggtccctcacgaatggcaataaagttattttgctcgattccccagataaaacaaaatgaccacaatgacaagacccggagggcatctcaaagtcgggtgtctcgcgaacatggggtcccgggcactggtggcccacggtgtcaattaccttgctcagggacccccaagagtatccggggacaaccccaaggggccgaaatcacgggggtaccgcgctaacatggaagggccgcaatgaaagttggagaaaagcgcaggtacacccgtgcggtgaaggaaatgcaggaaaatgagaggccacccacggggtaacatggaacaattcgacaagaaacttggtgacgttacgggggtcagccccaacaaggactgcaagacacagaggggtcatggagggcaaaaccaaaaaaccccgggaacctgcttcaacccctgacagtccgacagggctgaagtgaagaaccggaacgcgatacc

SEQ ID NO: 533339 - DNA, 312 bp, Homo sapiens
  misc_feature (273)..(273): n is a, c, g, or t
cggcctttctgctcactgcccctccccaggctcctggggcaggcgtctggcaggtcggcgtccactggctgcatagacgactcacagaccacagggtccaggagcttgctctcctcggggggtgctgctgacatgcccactgcccaccctcacctgggtccaccccagactccatttctctctatataaaatgtgagctagtcatgaccctggggacctaggggacatggaggtgtggcccgccccaggggcatggggcaggacgtgtggcanagggggtcctccagggacctgcatccagcctggcattgg

SEQ ID NO: 533340 - DNA, 838 bp, Homo sapiens
atatttagtgagtaactcctatctacacacagtgggaggacagactgattttgccctttctgaagttcgaacgggagatgggaaaagaggagcataaaataatacctgtaaccaggcatcagaataactatcgagcctgaaggccaaatccaggtttttccattttttttttttttaaggatccagaaaaaaacaagaaagaggccaggggcgggggctcagtgccgtggtaataccagcacttggggaggctgaggcaggaggactcactgtgagggtcaggagttcgagaccagacgggccaactagtgggtgaaaacccgtggtttctactaaaaatacaaataattagcgtgggcattgggtggcaggcgccgtggtaagtgccagcatacattggctgggctaagtgcattaagaaattacctggaacctggggaaggtggcggggtgggcaattggaggctggagagattggtggcacacttggcgactcttaggacctggggtggacaagacgtggaagactccagtcctgcaaaaacaggtcgaacactgggtattaatccatggcaaccactcagaaacactggtcccaccatttcacagtctaactatggtgcttaacactggtgacacagagtgctcccggggccaaacttggtacgtcttttcacgtgcaaaaatgcgtctccccaaaacctgggtctttagaattacgacatgggctcgaaccgttaacttaaaacttcacaacaactcttagggggggtaccagacatttttggggcccataaaacccctgggagactctccaccttcttataagccacacccc

SEQ ID NO: 533341 - DNA, 779 bp, Homo sapiens
  misc_feature (585)..(585): n is a, c, g, or t
tagtgtgacaccagaactcttctggtcagccacagaacacatacagaaaacagacatgacagaactgttcctgccgttgccgccactgctgccattgctgtggttatgggcatttacaaaacttgaaagtcagcactaaaggatgggcagaggttcaacccacacctccagctttgcttctgaaggcccattcattagaccagcttgtgaacatgattactccaacctcgatggttttctcatatctcttggttctaaacatcgagcatgtctctacctcacaactgtaagtgctctgatacaagagtccaaagtataaacatgcgtccttatctctctcttggctgctacctcttgcgtatttggacagttaccactagtggttctgcgagaagacctgcttgtataatctgctaagacacttcgtctaagtgtgttcgtcaaaggcaggaaagtgtatcgcccttctagtcgtcgctcattctgtcctatttgagggaaggttcctacatttgtttcaacagcatgcgagtcactttgggtttaacatgtgggaacactggtgggtggactgattatggacantactgtagccacagtggtcattgtactttgcgtgctgacagctgcactacagttacatgctgtcgtccaaacaccacagtgatgcttagggaaagaccctgctcaggaccagcaggtcagcagcccagagcagactgataggtccgtgggacccatgttagagcacgaaaattggggctcagcacagtttactg

SEQ ID NO: 533342 - DNA, 576 bp, Homo sapiens
  misc_feature (15)..(15): n is a, c, g, or t
  misc_feature (37)..(37): n is a, c, g, or t
  misc_feature (142)..(142): n is a, c, g, or t
tgggagtcatgtgcncctttattagctgagccattanttgaaagggatgaagcgggaggagtgggtggccccgatgccgggccggccatgctttacgggcttgtaggtgatggaaaactcgcccaggtagtggccgatcatntcgggcttgatctccacctggttgaaggtcttgccgttgtaaacgcccaccatgtgctgcccaccatctcgggttaggatgactcattgttcccgcaggtgtgcgtttttcaccatttccggcttcctccagtgggcggcgcctccttctgtggccttgcgccaggcgcttcagcgagggagtgtgcgtgcttccgccgaaggccccggtttcagccgccgccgcgtggcgcgcatgtgtctccagtgtgcttcagcgtgcctcgtaggactgtgtccagcagctgtggtctcgaggctccacgccgcggtaggtgacacttgcgagaaggctccgttcttcattcggctctacttctgccattgtgccccattgcactccagcctgggccacagagtgagactctgtctccaaaaaaaataaaaacaaaagag

SEQ ID NO: 533343 - DNA, 913 bp, Homo sapiens
agcggaggggcctgcggcgccccgctggtccgaagacgcccgaacccgcggctggcgaggacgcgggcgggggctggggcgggggctgggcccgctgcgtgtgcgcctgcgcctccatcttgcctgtacggctgctggactgcctgctgggcctggcccactgtccctgagccgtgtctgccgcctgctgctccctccctcggggcggtccgcgggctgggctgggcggctagggcctgtgtgggcctggctgctgcgtgctgtggcccaatggacccgcgactggtgatctgctgtgcgggccgtgaactggctccaatcggcagggaaagggccgagaagcgccgcgtactccttccacaggttccccctaaaaggacctcaaaacgtgctaaagtccaactgcgttaaagagctgttcagaaggggatacacctggacctccaagcctaacgtatccactctcctcatgtagttgagcattttcagccacagacgcagctttctccaaaggaaggcttgggagggacccagccatcgcctgctggacagccccacgggagcggtggccatcacaatctttcccaagcctgtaacccggagaacgaagcaaggagcgagcgcttgggacacggcccaatggcgcccgcaaccccgggagcagcacagactgcgcgggcacagggaccaccaagggggccgtggtgacaggtgagaacaaccttcagactcgtgccccgcgccacccggcaccagaagcgcaccctgcaccgattcgggacacaccggtcccgcgtcgaagtggaacgaccccggcatgcgccaacagcaccagagggtccccagaacgagggcttcgcaaggcaagagggcttgccccatagcacaggttgaacgagccacaccccaaagg

SEQ ID NO: 533344 - DNA, 840 bp, Homo sapiens
  misc_feature (1)..(1): n is a, c, g, or t
ncactattttaaacccccggccaaaaaaatattgcttcccccctgtcttggtgtaaatcctcctttggcgcataatttatttaccacacgcccccacttccgcgttcgacccaacccaaagcccgtatatgtcgttcctgtgcgaaatatttttcaaatcccgcccccactacggcgcctcttttggtaaaagccaccctgttctgacccccaacccccccgtatgtttcttacccgtgcgccaagcatatttttcaaaatttctccccccggaggcttcaaatccgcctcattaataatttctgcctttgactcacgaatctccaattttcgctgaacgccaaattctccccaagtctgctgactataacatactccctttcttcaaagaggacacttctccaacatctttacttctcccccactaaaaaaacccgttttgtagaggacatttcttttgaccaaacacctctctcgttactcatctctcccttactccccccctacgatttacccaccactgtgggaggaacactttctttggtatataaacaccgctttcttgtagccctaataatctactctctctatatactagggactctcacacatatcttatcttccacccccctataaatctccctctttacaataagatgtgcccaccaacaccacaatgggcgctacaacccacccccccaccacttgtaccaacacatattaccactttcttttcacacgcagagaacaacccctccatgtttcaaacaacacctccccccatttcctccctttcccccacccccacaacaatcccgggttttcttttaccaaaaaaaa

SEQ ID NO: 533345 - DNA, 372 bp, Homo sapiens
  misc_feature (54)..(55): n is a, c, g, or t
  misc_feature (143)..(143): n is a, c, g, or t
acgtagaagccccagaggggttttacaatcactggtttacacactcgggtaganntttttatttttacgttttatacccgagttatttctacttgttctacgcagattttctaaagtatcctttcaatgcctttgagaagatngagaaaaaagtttgtatatattttaaaaattgttttaaaagtcagtttgcaacatgtctgtaccagatggtactttgccttaaccgtttatatgccactttcatggagactgcaatacgttgctatgagcactttctttatccttggagtttaatcctttgcttcatctttctacagtatgacataatgatttgctatgttgtaaaatctttgtaaaaaatttctatat

SEQ ID NO: 533346 - DNA, 903 bp, Homo sapiens
ggtggaattcctggataacagtcttgcctgaccgcttgacggccgccgaacgatccatggggcagccgctgaaggggagggtgacactagagattgccctaaatgaacacaacaccgaaggctgcaacagcaactgactctaccactccgaaggaataagccgaaacacggcctgcggatggatagcccattacccacacatgagccattccgaaaacggaagcaagcctgttacactcagctgaagttttatcaactaaggatactgaaagaggccaagtgctccgctgcattagaacaatggtcacagggatcctcaccaggagtagcccccatcgccagaaaccacctaagaggcccctacacgaacaagcaacgccccatggggtcacgctgaatcatgagaatgcagcaccccaggccatatgcaggtcacacggctaaggctagacaccatgctattcacaccgcatctgcaggtacactgtccaccacaggcttgaacccgtcacggatcatgcctcagaggcgacgtccctggcggcagaacacccgaggatgctgataccttgaccctcacccctgagagccccaaaacccccaatggcagtctagcacggagaccccctcacaaagccttccagccgctttaaacacaaccaaccctagggcagcccccaggctctacagaatgtaagccccaagacaatacgtgaaaagcccaatgacgtcgttgacccatggccgaaacgggacccccagaacggacggccaggcagcccccctaaaaacattaaatccctgcgaacaatgtcgtcagaacgccatgagcggacaagaccccttaacatcctccctgcaagggttcgaccctaacctttattcgccgatctcgcgccatcc

SEQ ID NO: 533347 - DNA, 614 bp, Homo sapiens
  misc_feature (180)..(180): n is a, c, g, or t
ggtataacaaatttctacaacaaggtaaactagcctattgacctatgagttaccgaatttcgaagctcggttaaccatgtggctaacctgctggaggagtgggtggccccgatgccgggccggccatgctttacgggcttgtaggtgatggaaaactcgcccaggtagtggccgatcatntcgggcttgatctccacctggttgaaggtcttgccgttgtaaacgcccaccatgtgctgcccaccatctcgggttaggatgactcattgttcccgcaggtgtgcgtttttcaccatttccggcttcctccagtgggcggcgcctccttctgtggccttgcgccaggcgcttcagcgagggagtgtgcgtgcttccgccgaaggccccggtttcagccgccgccgcgtggcgcgcatgtgtctccagtgtgcttcagcgtgcctcgtaggactgtgtccagcagctgtggtctcgaggctccacgccgcggtaggtgacacttgcgagaaggctccgttcttcattcggctctacttctgccattgtgccccattgcactccagcctgggccacagagtgagactctgtctccaaaaaaaataaaaacaaaagag

SEQ ID NO: 533348 - DNA, 141 bp, Homo sapiens
actctagaggcatccccgagaggagaagatgtacaaggagaagagacgagatgctggtggcagggcattgaggacagcaagtggttgtatcaactataaagagctcgtccgcatagtgctgaagtggactgaggaccttcc

SEQ ID NO: 533349 - DNA, 339 bp, Homo sapiens
aagatcacaccattgcattccagtctgggcaacagagtgagacaaggtttcaccatgttggggcaggctggtctcgaagtcctaaccttgtaatcccaccactttgggacggcgaggtgagtggatcacttgaggtcaggaggtcaagagcagcctggctaacatgtgaaaaccccatctctgaaatacagaatactaaaaatacaaaaattaactgggtgttgaggtgtgtgtctgtaatcccagctactcaggacggtgaggcaggagaatctcttcaaactgggaggtggcggttgcagtgatgccaaaatgggctcagactcccaaggtgtgggg

SEQ ID NO: 533350 - DNA, 162 bp, Homo sapiens
agatcccctgattatatttttaatacctgtaaatattttattacgggtattttggatatttgttgatataagggcattttgggcataggtaccattgtgcatgttgctgattttgatagtcacttttttaatgaatgtaaaaagcttggtcacggaagatca

SEQ ID NO: 533351 - DNA, 255 bp, Homo sapiens
gatatacaggagaaatagaatgtgcatagtggggattatatcttaagttcgaggttaggtagtacgcaggtctagaggctgttagaagtcctaggaaagtgacagcgagagctgtgagttagaggtagaggggattgttgtttggaagggggatcgcgggagacatgtagttagtattgagaaatcctgcgaataggcttccggctgccaggcgtaaaatggggtttagtaagggtggggttattttcgtcaatg

SEQ ID NO: 533352 - DNA, 374 bp, Homo sapiens
  misc_feature (335)..(335): n is a, c, g, or t
tccactagcttcaaactttttcttcttgcagcttccccatctctctcagccttcagagaattgctctgcactaggctttggcttaagggaattttgtggctggtttgacctgctatccagaccataaaaatttacccatataagcaataagactgtttcattttcttatcattcgtttgttcactggagttagcactattaatttcctttaagaacttttcctttgcattcatgtcttggctaattgtgtggcacaggaggcctagcttttggcctatctgggcttttgacacaccttcctcaataagcttcatcatttcttaacttctgatttnaaaattaaagatgtgtaaattctttctcacttgaacatt

SEQ ID NO: 533353 - DNA, 1389 bp, Homo sapiens
  misc_feature (1389)..(1389): n is a, c, g, or t
tcagcaaactgggaggacgatggagaagatctggcaccacagcgcgttctacaactgagctgtgtcgtggctcgcggaggagtcacccaagtgtctgctgagccgagggcccccctggaagccccaaggtccaacaggagtagaagattgatctcagtagttagtgtttgtagacacttctagagcatcacctcggacacactgctacgtggtcaatccgaggactcgttgctgtcctctctacgcctctgggactgcactcactgggcaattgttcaatggtactcatggaaggcacggggttcacactcacatctgagttgaccgcatcttacgaaggtgctacgtgccctctcgctccaccggcctatcgcctgccgtttttggcactcttgttcatggcgcgtgcgactctgtaccggatctaaacgcttcatggtacagactccttcgagcgggagccgagggcgtgaccacggcttccaaccagcctaggtgcctgtaggcgggtgactagtctggtgccgctgaccaatcgaatggatgaaacgctcgtgcttacgttcgcccctgggacgtttgcagcagggagtatggctcgacctgacctgcattatcttctctactttcttcctggaagtaaagagtcgtaacgaaggcatggcccacggatgagtcgacgggtacagtcaggacattggcgaagtgaagcggggtttcccgggttgtcccgggaagagtcgcatggtactcacaagccctttgctttgcactgggcgtaatggaaatctttgccagggcattgccacagatgatccaccatatcaaacaattccagttcattggaaagttgtgagcggtgggaccattccggcaataggaactggtacggccaaaagaagggagagctaggtcgggggccggacgccacccaatgttattcccgggctattggccgaccaggagttcccgacacacggaggatacaacggcctgagggggcaccagagaccaagttgtaagagtctacgaaaacatgtagaaacacccacgaaaaaggcaagaaatccgggggaaccacggagagacacacaacctgggaggacacgtgtacccccatcacgggacatggtgttaaaacacacgagagctcaacaagagcgggggccccatatggacagcgcaaggtctaaaaaggacgctcaaaaaccgacctacgaacggagtatacaaacaaaaaagccggagaacaccacgagacgcggcgaggaaagcgtaagaagcaagagtggacatatcaggcaaaaaacagacgacgagtacgcgacacgaacaactactcaccgagaagaaagagaacgacgccacgcagcgtggcgcactgtcgcn

SEQ ID NO: 533354 - DNA, 823 bp, Homo sapiens
  misc_feature (213)..(213): n is a, c, g, or t
acccactccagccttactagcccagtacaatccttaatccgaaaccatttacccaaataaagtataggcgatagaaattgaaacctggcgcaatagatatagtaccagcgagaggcgaaagatgaaaaagttataaccaagcataatatagcaaggactaacccctataccttctgcatcaatgaattaactagaagatgaactttgcaaggnatgagcccagagctaagagcccacgaaaaccagaacgtagctaccataagtaacagctaaaaggagcacacccgtcatatgttagcaaaatagtgggaagattctatagggtagaggcgacgaaacctaccgaggcctgggtgatagctggttgttccaagatcagaatctttcgttcaatcgtattgataattgtagcgccacagaaccgctctaaatccccttgctaacattattaactgttgacgtcctgggatgaggaacgagtctctgttggacgactgagtgaaagaaagccttgtgagtagcagagtgaatagaatatttgaacaccccatcagtaggcctaagaagcagcgcacccagatttaagaaagcgttcagagctccaaacgagccactgaccttaaaaagatcccagagacatataagctgaagctccgtcacacccagattggaccagggtctatcacgcctataggaagaactaatgttgagtataaggtgacatgggaacattctccttccgtagtaagcctgcgtcagattaaaaacgctgaactgacaattaacagccaatatctacgagtcacaacaagtcattattacc

SEQ ID NO: 533355 - DNA, 181 bp, Homo sapiens
accttacccctacaaaaactaaatatttagctgggtgtggtagctgtgtacgtgtggtcccagctactcagtgaggctgaggcaggaggatctgtgtgagcccagtgaggtcgaggctgcagttagcctgtgatggcaccattgcattcctgcctgtggtgacagacggagacccatgtct

SEQ ID NO: 533356 - DNA, 254 bp, Homo sapiens
tgtggctcagttgatcctcctaggataacactgaataggaatatacacaaaagggctaagagggctgggtgcagtggctcacgcctgtaatcccagcactctgggaggcatgggcgggtggatcgtttgagctcaggagctcgagaccagcctgggcaacacagtgaaaccccgtctctacaaaaattacaaaaaaattagccaggcgtggtggcgtgcacctgtaaccccagctacttgggagactgaggcgg

SEQ ID NO: 533357 - DNA, 646 bp, Homo sapiens
  misc_feature (529)..(529): n is a, c, g, or t
  misc_feature (618)..(618): n is a, c, g, or t
caccatctactagggtccaccatgaccctggtgttatcatctcccaggatccatgaggtccagtgttgtcaccatctattaggatccaccatgaccctggtgttatcatctcccaggatccatgaggtccagtgctgtcaccacccactaggatccaccataaccctggtgtcatcccagagtccactgcaaccatgtgccatcatcccccaagagccatcatcttaggagccaagtaccgtgacgggctgtatttcagttgtcctctggggccgcatggtacttacagttgttcacttaaggggaaccagcacaacaggccatattcccgtttccactaaaaggacaggggtggggccagctgtccccctctgaagacttcacccctactctggccctccttatgtcactgcctcactcctgaccgaggatgatgcctgcatcaatcccaccacagatgtggcctcagccaacctcaccttaccccccggtgagggcacccggggccccccctggacaggcaggcgtntttcccttcacccaggccatcttgattggggtggacagggggtcaaacccaggcaacctcttcatttattcaccagaggaggggaggcntttttcaaccctcaggggtggacgggcc

SEQ ID NO: 533358 - DNA, 407 bp, Homo sapiens
gatatatcatataagcagctgagatgtaagcacactattctcacatctctatatatgatgagagacacaatcagccataattcaacaagggaagaacataattaagcatcagttataatacgcaccaaaataagcaggtagaagctctctaaattaaatatatacaaaaagctttgggaaaaggtctccacatttattacctaggcacatcaggaggtataaacagaattctactgcaaagaatgtaaataacatgaacagcatcttagcagcttaatcacggaagcaaattctcaacaatcccatatgacacattagcaagttacctatacacactctaggattgagcaggactattagattgtgcacaataacaaaatcccagaaatccacatccaggcaaactg

SEQ ID NO: 533359 - DNA, 119 bp, Homo sapiens
ccggttgcagtgagccgagatcgcatcacagcactccagcgtgggtgacggagtgagacttggtctcaaaaaaaaggaaaagaaaaattacatcttgcaacatagcgttcaatttgggg

SEQ ID NO: 533360 - DNA, 145 bp, Homo sapiens
attagctggtaccgaattctggatctctgggaagttgtgttctcatgaactgctcctcagctggtgacatggcatggctcaccacctgcccttcagtgttcaatgcaggggacatgcaccctttagtaaccttggaggggaccca

SEQ ID NO: 533361 - DNA, 502 bp, Homo sapiens
  misc_feature (135)..(135): n is a, c, g, or t
  misc_feature (347)..(347): n is a, c, g, or t
  misc_feature (352)..(352): n is a, c, g, or t
  misc_feature (359)..(359): n is a, c, g, or t
  misc_feature (361)..(361): n is a, c, g, or t
  misc_feature (368)..(368): n is a, c, g, or t
agcatattttttgcatcattaaattttctttgaggccctgattttaaccattgcatagtattcctacatatgaatagatgtattatgatttatttaaccagtcccttgttggtcatttagattgttttctatttntcagtataatgagtatgatgaatatcactgtacataagtctttatgcacatctctgatatttccttaggataaatgaggagctgattcttaatcctgtcacattggtaaggattatatacattccttattaagaatataaagtgcttgtttcttattgtttcattgtgattgcatagaagattctttggattctgaacaatttggtggtatnttaancaaagtntnagagagntttctaatgcctcatgctcagcaccttcatgatggaattcctattgtgtaagcttttggacaggaaaaccactgctgatatcagggagtttggaaagtagatatacttgtggaaacctgagggtggtaaaaaaa

SEQ ID NO: 533362 - DNA, 732 bp, Homo sapiens
  misc_feature (597)..(597): n is a, c, g, or t
tagaggatcccggcagctatcggttcataagacaaaagttaacaggatatcgaggaatgaactcagctctggacaaggcggactaatagacatttacagaactctacaacccaaattaacagaatatacattttttttcaaggacaaaataaaactaattcaaaattgaccacatagttggaagtaaagcactccttcggaaattttaaagaacagaaatttataacaaactagtctctcaaaccacagtgcaatcaaactagaactcaggattaagaaactcattcaaaaccacttaactacatggaaactgaacaacctgctcctgaatgactactaggtacataacgaaatgaaggcagaaataaagatgttctttgaaaccaacgataacaaagacacaacataccacaatcctgggacacatccaaagcagtgtgtagagggaaatttatagcactaaatgcccaccagagaaagcaggaaagatctaaaattgacaccctaacatccaattaaaagaactagagaagcaagagcaaacacattcaaaagctagcagaaggcaagaaataactaagatcagagcagaactgnaggaaatagagacgcaaaaaacccttcaaaaaatcatgaatccggagcgggtatttgaaagatcaccaaattgttgaacggatacttgcgggtacgagccgatcgtatctggctattcgagagaaaatcaaaaaa

SEQ ID NO: 533363 - DNA, 280 bp, Homo sapiens
agaactggtaaaatcttaatcgcaaaattagatgaagggtttatgggtattctctgtgttattcttgcaactttcctgtagacttcaaatttttcagcataaaagtttacaagtatataagctaagtcagtgcaaatgaaataacagttttaaataacccaaggatctaagaataaatatcaagagaactgagaaaatatcttgaactgaatgaaaatgaaaacacaacttattaaaatgtgtctactaaagtttataggaacatttatagctttaaaca

SEQ ID NO: 533364 - DNA, 770 bp, Homo sapiens
  misc_feature (44)..(44): n is a, c, g, or t
  misc_feature (133)..(133): n is a, c, g, or t
  misc_feature (136)..(139): n is a, c, g, or t
  misc_feature (144)..(144): n is a, c, g, or t
  misc_feature (150)..(150): n is a, c, g, or t
  misc_feature (159)..(159): n is a, c, g, or t
  misc_feature (186)..(186): n is a, c, g, or t
  misc_feature (190)..(190): n is a, c, g, or t
  misc_feature (193)..(194): n is a, c, g, or t
  misc_feature (200)..(200): n is a, c, g, or t
  misc_feature (203)..(203): n is a, c, g, or t
  misc_feature (331)..(332): n is a, c, g, or t
  misc_feature (347)..(348): n is a, c, g, or t
  misc_feature (352)..(353): n is a, c, g, or t
  misc_feature (355)..(355): n is a, c, g, or t
  misc_feature (361)..(361): n is a, c, g, or t
  misc_feature (364)..(364): n is a, c, g, or t
  misc_feature (390)..(391): n is a, c, g, or t
  misc_feature (394)..(394): n is a, c, g, or t
  misc_feature (411)..(411): n is a, c, g, or t
  misc_feature (415)..(415): n is a, c, g, or t
atattatagtcctgatcacatttaaaaagtcgtattattaaaanacagagggtgtacattgggaactcaactttttggtttcgtagattgtgatataaatgtatatgtatactgtaagtgtgcgcatagaatnggnnnntgggntgtgtncttttttantccactacctggggggagattggggangtgnggnngggagngtntgcataatggagattcctttggcctcttcaaggccacccttgctcctcagtcccctatgactacatttaatatatcttctcattaattcagtcttgcactttagctactggccaaagccaatttaaannaaaaaaaaaaaaagnnggtnngngggggngtngggtgggggggggggggggggggggnngtnacctgtatccgcatttntatngctattgttaattaccaagtgaccctgttgagatgggtgtccaggccccatctatcatacggaattatgatacttgcactctaaagcaaaacccaatctcaagattggagggagcaaagaggaaaaacctcttagggccagagagacttaaatctcagttgcttgctaaactgggtattttgagtatgggatgaaagaggctactttgcaagagggcttcgtatttggtttacactccaacaatgaggattttcactgggacggctaatccaagaagttgagtttccatgcagaaataacctctacagaacacacatcatatgtgattctgacagaaaaatgcagcattatcttt

SEQ ID NO: 533365 - DNA, 464 bp, Homo sapiens
agagatctgctgtacagcatggtgcctatggttaactatacagcattccatacttaaaaatttgctaaaagtgtagatattatgttaagtgttcttattacaaaaaataatgtggaaatatacaatggaatattattcagctttacaaaataaggcaatcctgctatatgcagcaacatgaataaacctggaggacattatattaactgaaataaacaagtcacagaaggacaaatactgtataattccacttacatgaggtatctaaaatagtcaaacttaaagaaacagcacagaatggtgggtgccactggctgggcgggggagagaaaaacgggaaattgttgttcaatgggtataaagttttagttatgcaagatgagtaagttcactgccaatagttaataatactgtactgtacacttaaaattttttaaaggtcatatattaagtgttcttatcac

SEQ ID NO: 533366 - DNA, 373 bp, Homo sapiens
ggacgagctcgatcactagtacggcgcagtatagctggaatcggttgattacggtctatggggaccgagcagcagacagcacctaactactcagaggctggcggaagcctgggagcggagcaatcggtggagaagcctgtgtcctcgattctgtcccagaacccgtctagtaggcaaagagcctcgaagctaagagccccctccagtcgcagcctacactctaggtaccgaacaatcctcctagctcacatgtacaccagaggtaaggggactcctactataccccgtaccgtgactaacacccttgcacgctgtctcacgtcctggcatttaacaaattgctctgcgaaggtggtctgttctttcagaccca

SEQ ID NO: 533367 - DNA, 225 bp, Homo sapiens
  misc_feature (67)..(67): n is a, c, g, or t
  misc_feature (96)..(96): n is a, c, g, or t
  misc_feature (109)..(109): n is a, c, g, or t
  misc_feature (162)..(162): n is a, c, g, or t
taaaaccaccttgggggaaaagggtagttgggagcatttattaccaatttcttgtttaatgtcttancgggggccttttatttggtaaaccctganataattgtgggcntgggaaaaccatttacctatttccttgagaggttttaaaagaccagtcccttntttagcatgtgtgttgtgtccagcatgtggtcgtcttaactaataaatgtgatttttctcccc

SEQ ID NO: 533368 - DNA, 351 bp, Homo sapiens
gtgggggaagagggcttggtggtgtttgggtagttgggtttacttttcggtagctggggtctggcatggtagccgcgttggaaagctacagctctgaacctctctcggcgaggtcttttggacaagcggttgggggcaccgcgcagacgtctggcgccgggagccagagctcgggcccgtggctgagcccggggttcctgcaggcgatgaagctaggggcggggggaggaagggaactcgggagggggaaaggacttggcggtacgcgtgcggcagggactgggggttaacttaatatggtcttacgccttccagaactggctttaaaggcagaccattagcaggacgata

SEQ ID NO: 533369 - DNA, 220 bp, Homo sapiens
gaggaatagcaacagtccgccctctccggtcctctatgaaccaaggaagggctggtgcccagagaggtgggggggccagggagcaggcaacacaggaggtactcgagccagtgcacctgccagctcctggactcctctctggcaaccagtgcccgctgtgctgcaccatttcccacgagcggctgggcacaccattttttcagttccgtcctccttggaa

SEQ ID NO: 533370 - DNA, 321 bp, Homo sapiens
  misc_feature (14)..(14): n is a, c, g, or t
atttcggcacagtnatcataactcaccgtaacctcgaactcctgggctcaaccgataactcctccctcagtcttctaagtagctaagactgtaggctcatgcacaatgctcggcttttattttatttttttgtagagatagggtctcgacatgttgtccagactggtcacaaactcctggcctcaagtgggtgctcccaccttaggcttcctaaagtgttgggaattatagggcatgagggcactgtgcccagcccattctctttttaaacagtggggcaaactgtttggcattaaaaacaagtctgtttgttttctcttt

SEQ ID NO: 533371 - DNA, 200 bp, Homo sapiens
gcccactgtctggcactccctagtgagatgaacccggtacctcagatggaaatgcagaaatcacccgtcttctgcgtcgctcatgctgggagctgttagaccggagctttacctatttggccatttggtctcctccccccaaggaccttaaatattaggattctcggaaaccaaattggaggaatcatgataaggataag

SEQ ID NO: 533372 - DNA, 366 bp, Homo sapiens
  misc_feature (20)..(20): n is a, c, g, or t
tcaggcaggtcgtcagaggntattctaaagaaggcattactatcacaggagatgacaactccatggcgtgttattgcccctgaagacctttcagtgggatacagtgtggaggtggaagacagtgatactgatgatcctgaccctgtgtagacctatgctaatgtgtgcttgtgtcttagtttttcacaaaaaaggtttaaaaataaaaatacaaaagaataaaaaaggttatagaataaggatataaagaaagaaaatacttttgtacagctgtataagtgtttgtgttttaaattaagtgttattacaaaggagcaatagagttttcacaaattaaaaagttaataaatattaaaagtcactgta

SEQ ID NO: 533373 - DNA, 904 bp, Homo sapiens
  misc_feature (55)..(55): n is a, c, g, or t
  misc_feature (67)..(67): n is a, c, g, or t
  misc_feature (116)..(116): n is a, c, g, or t
  misc_feature (129)..(129): n is a, c, g, or t
  misc_feature (894)..(894): n is a, c, g, or t
accaggtcggacccccacacagggtactgcaatgaataagatcatagcgacggtnttttccgagttnccacacaccaacataactagtgtatgccagctggctctgcaacgacctnagcaagcaactgnactcatggaaggaatgcagtttcaacatcctgatgattacatcccccttaccctgaccaatcaacaatccaaatttttcagcttctcatcctccacagtctccttaaaggaccccttgatggagcaaatttgtggcttgagattacctctcatttactagatcaaaggccttgtgattattaaactcattctcggctgtaccaaaaacaaaaaatataccaccaatacaattacactaaatcaaaatagagaaagaagaaacacgagagacacgcaacagcgtgacacgtaaagataaaaatggagactttaggcctgaggtgtaagacacccgcccccctccccttcttgggagagatgcatagagctccatattcagataccttcgacgtagtactcggagcgctacgagcgatagcgctatactccaccccctcggacccgaccataaccacgtcagctagggccatcagcaccttatttaatctcagctctgacgtcgatgtgagagacattccttaatccgcgcatctttgagccttttgcatacttgcccatgcagcggttttaatattcgtacaagtcctcccccttcactcaatcacgcaagtcctgccactcgacgcttcgtcaggccaccattcacacacaccccgcgcatctgtcagaagatataacatccagtatcattactcccgtacgacaacacccacgtatacgacacggtctgtcttccactccgtaccaataacagagctatagtgnatatcccgat

SEQ ID NO: 533374 - DNA, 102 bp, Homo sapiens
tgatcacaagaggaatttgtacgcccaggatcagccctcacatcctgcccaaatgtaggcagaatctgggtctaagactagcataagtgaagtctggggagg

SEQ ID NO: 533375 - DNA, 777 bp, Homo sapiens
  misc_feature (369)..(369): n is a, c, g, or t
tcctcccgcatttctggattggtgcaaccattgcagatacaccaaagccatgcctttcccgaactacaatcatcccgggggccaaccacatggacaagggtccccgttacctgagagatgacacgatggaatgtgaactagagcccagcttgcttggcacacatggatgttaatatgggaggaagaatgccgaggagcttatatttggaaccgacccatattaccaccggtgcttcccagtgattttgataatgccccttaaatagccaagcggatggttacccaatttggaatgagtgaaaagcttggagttatgacctaccagtgataccggggaactaagtcccagaaaccccatctgccctcganccagaaataaggatccttctaagggactccatatgacgagccaaacatatcttgagactcatgccaaggagcataagaatctcgccgaagctttattgacctatgagactttggatgcccacagagattccaattgttcttgaggggaaaaagttggaagtgagatgataactctcttgatatggatgcttgctggttttattgccagaatataagtagccttgccgtagtctacttttaccacgctttcccctcattcttgatgtggtgtaattgaagggtgtgaaatgctttgtccatcctttgtcacctttatcccgtttgggttattctccttatgacccctattgccaattagcatcccctggccaatatattttgaaaaaataaagaactatcccggattga

SEQ ID NO: 533376 - DNA, 1869 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 533377 - DNA, 702 bp, Homo sapiens
  misc_feature (454)..(454): n is a, c, g, or t
aggagacagttgatcagtaagtgaatgtgaaatgtattaaataacatggtgagtcccaactgccagtaacgtgattagggagatgacacacaaaaagttaagtaatagtgatagaatgcccaatgagtacctttaacttgtatgtaggagggagatgggtatgttgtagtgctcattgtttcagaaataaggtagggttttataggggaggagttattccaacagagaaaagcagcatgtattattagtcacttataccatgtcgtacaggttatatttgtagatgaggccaagggatatgtttgggatttttagaagctggctttatttaagaactattcttttgcataggtagtagctagtaatttgggaaatggcctcaataaaaacttgcaacagcatgtgtgctgttttattgtattcttaccagtgtacaatttggaggtaatatatntatatagaattaaaggaattttaaagttctaaatgattaaagaaaggctaggtaagttttcactctttcattaatttccctttttcgtttggtttgtggttctgcttttccgtttgtgcagatgtttcattgggactgtttaccagattgctttcttaaatagccagcttggggttactttaaaacaagcttatttgtagtcagagcatacaaatcattgcttataacgcattggtattataaggcga

SEQ ID NO: 533378 - DNA, 1954 bp, Homo sapiens
tctctgaagttccagaatcgatggaagtggacggcacgccgcggcggggtgggtgcaagatgccgctgccggttcaggtgtttaacttgcagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 533379 - DNA, 399 bp, Homo sapiens
aatctacaggatcccccagttctgcttcttgaaaatcctatagcccaggctatgcttcagtctttcgggattgtacagagtactggagctgagggttgcaggccggatagggatcagacaaaataagccacctaggctgagggatacccctcactccttcactccatatcaccaagtgaggaaagggctagtctctttccccagtgccccttcccctgccaagggtgagcagctgcatactagaaccaggccgactgttttgggcagccgccctcgtcgccgcctttcaagacgctcctagtctagccgcagagtcagaaggggatgcttgggctccgtccctcctgcctgctcctcctcttctgggtcttctaggccgtgtgatctggcctgccccct

SEQ ID NO: 533380 - DNA, 246 bp, Homo sapiens
tgaagcactgggcacagagtgagatcccatttcaaaaaaaaaaaaatggtgtagactacaaatttacaattcttctcatttcagtgtcacgataatactggttaatatttggaatacagatttctccttaaattctaattttggtacattggtccctttttaaagttcaagttttactgaagttttaattttacattgtagttaaaattttactctttattattttttattgagtgtggcagggtt

SEQ ID NO: 533381 - DNA, 294 bp, Homo sapiens
aaacaaatggaaaaacattccatgctcacagatagaaagatcaatattgtgaaaatggccatactgcccaaagtagtttatagattcaatgctattcccatcaagcttttatttgaataaatataaaccgctattgactttcttcacagaatagaaagcacacctttaaatttcatatggcccaaagagagcccatatagccaagacaatcctaagcaaaaggacaagctgggggcatcattacctcctcaactatactcaggcatcagatccaaacagcatgtactagtacca

SEQ ID NO: 533382 - DNA, 320 bp, Homo sapiens
cgcggggcccgaagcgtttactttgaaaaaattagagtgttcaaagctcaagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 533383 - DNA, 376 bp, Homo sapiens
ggtctctgctcctcagctgactccagccaacagccagtcccggatgagcaccaacatgtgaggggtgaaccttggcctccaggggcaggcagaggacagagttctgaggggtctgcctcaccagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggctcctgttcccgcctcagtcaggtgcagacaagtgggcggtgtccattaaagagcagactcagcgtt

SEQ ID NO: 533384 - DNA, 1947 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 533385 - DNA, 396 bp, Homo sapiens
  misc_feature (8)..(8): n is a, c, g, or t
  misc_feature (158)..(158): n is a, c, g, or t
cagactgnacatggagccacagtaagtgagaagtgaaccccatctgtaaccagagcgcagtagtttcattacagatgggagcaaaccttggatacttgatgcttaaaaatccaccataaggaaagatggaaacgttcccatgtggctcagatcacatntctgttcattcattttaggcgctgtggagaattccatggagtgcatccttgtgaagcatggtgtttctcattctcagatctcacccaggagggtagggaatgcttggttggctagtcaggtgcacaatgtgaaaatagctgtgacaactttaggacagagagagtctgacaggagctgagaactgctgctccctggtactctgtccatctctttcgtgtcaggtacaggtctctgtgg

SEQ ID NO: 533386 - DNA, 2037 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgttgctcttggctgttctttcctgccgtgcaggctctggtcacccctgggtggccttgggttcctgagggctgtctccctgggactaggcttggaggcagggcctggtgagagaaatgagaagcctggccctcagattcaacagcccccagcagcagccactgtggcctcg

SEQ ID NO: 533387 - DNA, 149 bp, Homo sapiens
tttctctaactggtccaattcttcctatagaatacactatagcacgtcatttaagagttgtctctcccggctgggcacggtggctcatgccagtaatcccagcattctgggatgctgaggcgggcagatcacaagctcaagaagataag

SEQ ID NO: 533388 - DNA, 2235 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggccaaaaacccccgagggaggggcgcgcaagaaggcagcagcccacccgactcgcatgtattggaagaaaaggcgcggcgccaacaaggagggcgcccctctaatgaacaagcgagcgaccggggcggggggcgctacaaacaacctgcggcggaggagagacagaatgtgggcgcagcggcgacatatggggagaaggacaccccacctagctggcgaggggagagaaacgcgggggacgaaacgtgacgag

SEQ ID NO: 533389 - DNA, 281 bp, Homo sapiens
gagtatcccgacttgggactgtcaggtacagagctactagtataacgcagcatgaaggagtaggtggcagcgtgagaacgactcaacagagcatgagaaagactaagccctaaaggtgatcaacaacaagtactgaaggaggaagtggtcagctgtggctggggcaaaacacgcccagtcagttacattggcctgtgtttggtcatccagggacaaagtgacctttttagtgcctgtcggcccagtcccaagtcggagaaaacagtcccaagcggcgaaga

SEQ ID NO: 533390 - DNA, 2225 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgttaaaaaaaaaaaaaaaaaaaaaaaaaaaaaaaaaaaaaaaaaaaaaaaaagggggggaaaaaaaaaaaaaaaacacaagagagaggggaaaaaaaaaaaaagaaacaacggacaggagtggggcgagcaacacaaagtgaccccccacacaaggagcgaccaaaaaaacagcacaccccggtgacgtcgggactaaaaagcggcggccccacaaagggagaaaacaacataataacacgcggagaaacactgcggcgcgaaggcggaaaaacaacaacagcagaaggacggaaaacaacagtggcacccagagaccccacgggaagaagggagacgccccaagggggaggggagaac

SEQ ID NO: 533391 - DNA, 188 bp, Homo sapiens
aggctgattctagagtatcccgacggctgggggatctgccgagtccgagccctgggctccttcttctaagctggactcccttacctccggccctcttctctttcccagatcccccctcccctttgaaagtgctttgaaacccccattaagtaacagtgtgtgcatcagactgaggcattaggggcaat

SEQ ID NO: 533392 - DNA, 350 bp, Homo sapiens
gtcgacctgacccaaaaataagtataaagtagaactagttaaggccaggcacggcgtctcacacctgtaatcctggcactttcggaggccgaggcaggcagatcatgagtcaggaaattgagaccatcctcgccaacatggtgaaacccgtctctactaaaaatataaaaattagccgggcatggtggcgcgtgcctgtagtcccagctacacaggaggctgaggcaggagaatggcgtgaacccgggaggcggacgttgcagtgagtcgagatcgcgccactgcactccagcctgggcgacagagcgaaactccgtctcaaaaaaaaaataggagaaaaaaagtcgacg

SEQ ID NO: 533393 - DNA, 2365 bp, Homo sapiens
  misc_feature (350)..(350): n is a, c, g, or t
tctctgaagttccagaatcgatggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccgtggctgcgcgctgcgatcgggggccgccgggccgcgcccgccccgcctcccctcccagcagctcacgggagaggttcccgnccgccccgacgctaacgctctttctcccttcagcagccagccagctctgtgtcagggtcggggggtgcagaaagtcaggacagaatgagggatagctcggcccccagctcggcctcctcgtcagtgacagatctgtactgcacccctcacaggcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 533394 - DNA, 148 bp, Homo sapiens
cgcattagctactgctgtcacatggaaccttctcacttcggctcaaagtctcgttgatattgtactacacagatctgactgggtggtccaccgggccgcgcctaggcttaaggctcacgcagcggcctcctactcgtcgcggcgtgga

SEQ ID NO: 533395 - DNA, 2198 bp, Homo sapiens
  misc_feature (124)..(124): n is a, c, g, or t
  misc_feature (132)..(132): n is a, c, g, or t
  misc_feature (141)..(141): n is a, c, g, or t
  misc_feature (151)..(151): n is a, c, g, or t
  misc_feature (168)..(168): n is a, c, g, or t
ggggctggtcctcctgcctcctggggttgaggtggcgtcccgttcttctccgtggcttggaggaaactacatcaggatggtggctgggaacgtgtaggggccctcagaggcccctgtgtagttngttgtccnctgtctgcnttctggcttncagagatgagcggctanaatcaggcgaggggtttctgcttctgagccttagagtcttgtgaggagacccctccctgatgtggtggcacaggagcctgggtgggggcgggggtgactgggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 533396 - DNA, 195 bp, Homo sapiens
atgtaaagatcatgtgtcccggcagacattgtttgaggattccttccacaagattatggcattaagaccctatgacttgaggaggcgcttatatgtaatattagagggaagaaggacttgattatggtgcctagcagaaaatggttttctgcttcaaatagtttgacccatgtatgcttattgagtattcggcag

SEQ ID NO: 533397 - DNA, 461 bp, Homo sapiens
accggcccgcactaggcgcacttctggaataagactccagcactgggccaggcgccgtggctcacgcctgtaatcccagcactttgggaggccgagacgggcggatcacgaggtcaggagatcgagaccatcctggctaacatggtgaagccccgactctactaaaaatacaaaaaaattagccaggcgtggtggcgggcatctgtagtcccagctactcgggaggctgaggcaggagaatggcgtgaacccgggagacggagattgcagtgagctgagatcgcgccactgcactccaggctggtcgacagagcgagactccatctcaaaaaaaaaaaaagttaaaacaatgaggcggggtgcgggggctaacactggtaatcccagtatgtggagaggcagaggcagaggcgggcggatcacctgacatcaggagttcgacagaagccggggaaaggggg

SEQ ID NO: 533398 - DNA, 112 bp, Homo sapiens
agacgatgtcgaggtgatgttcgaccccgtggccaccgaccaccgttggcagcgacagggatacctcaccgtggaatcccagcaccccgtcggctagcgtgcataccggatg

SEQ ID NO: 533399 - DNA, 650 bp, Homo sapiens
  misc_feature (279)..(279): n is a, c, g, or t
  misc_feature (411)..(411): n is a, c, g, or t
  misc_feature (443)..(443): n is a, c, g, or t
  misc_feature (498)..(499): n is a, c, g, or t
  misc_feature (510)..(510): n is a, c, g, or t
  misc_feature (522)..(523): n is a, c, g, or t
  misc_feature (586)..(586): n is a, c, g, or t
  misc_feature (606)..(606): n is a, c, g, or t
  misc_feature (613)..(613): n is a, c, g, or t
  misc_feature (630)..(630): n is a, c, g, or t
gagatattgaagggatatatgcacttcccttgataggccccttgcaattgagtaggggcaaatattaatacattctgagtgctcactgtgtgcctggctgagagccaaatgcattccttgcatcttcttatcatctcatagcaaccctatattgaagatgatgttcttattcctgtcttttaatgaggttactggatgataaatatattaattgaccacttagcagatggaaactattgaaagcctaacccaaactgccagggttaaaatcctggctgnttctcttatgagttgggtaaccttaggcaagatgcccttcttctctttggtgcttctattttctcctctgtaaaatggagacattgctatgaaggtgaaataagttaatagatagaaaatgctcagaactgnattttacagtatcccagcagtccagttcattnttttaatttattttattatttatttatttatttattttgagagtgtctcgctctnncacccatgctngagtacagtggnncaatcttcgcttactgtaacctcttgcttccgggttcaagcgattctcgcgtttaactacttnggaggctgaggcaggagaantgcttgnacccagaagtggaggtncaatgagcttagattgtgcc

SEQ ID NO: 533400 - DNA, 595 bp, Homo sapiens
  misc_feature (279)..(279): n is a, c, g, or t
  misc_feature (411)..(411): n is a, c, g, or t
  misc_feature (443)..(443): n is a, c, g, or t
  misc_feature (498)..(499): n is a, c, g, or t
  misc_feature (510)..(510): n is a, c, g, or t
  misc_feature (531)..(531): n is a, c, g, or t
  misc_feature (551)..(551): n is a, c, g, or t
  misc_feature (558)..(558): n is a, c, g, or t
  misc_feature (575)..(575): n is a, c, g, or t
gagatattgaagggatatatgcacttcccttgataggccccttgcaattgagtaggggcaaatattaatacattctgagtgctcactgtgtgcctggctgagagccaaatgcattccttgcatcttcttatcatctcatagcaaccctatattgaagatgatgttcttattcctgtcttttaatgaggttactggatgataaatatattaattgaccacttagcagatggaaactattgaaagcctaacccaaactgccagggttaaaatcctggctgnttctcttatgagttgggtaaccttaggcaagatgcccttcttctctttggtgcttctattttctcctctgtaaaatggagacattgctatgaaggtgaaataagttaatagatagaaaatgctcagaactgnattttacagtatcccagcagtccagttcattnttttaatttattttattatttatttatttatttattttgagagtgtctcgctctnncacccatgctngagctcgcgtttaactacttnggaggctgaggcaggagaantgcttgnacccagaagtggaggtncaatgagcttagattgtgcc

SEQ ID NO: 533401 - DNA, 186 bp, Homo sapiens
  misc_feature (1)..(1): n is a, c, g, or t
ntctgtgggccacacttttaatagcatggactacaacacaagagggatcacccggcttactgggtcatgagagggctgctttagagtatctgcctctccagcacattcccaggcaaaggtttcgatgcactgcataaggtggcagctagctacaagactgcgttaatatattttctgagagcaccg

SEQ ID NO: 533402 - DNA, 192 bp, Homo sapiens
cccatgggttatacaatcttcccatgcacaatcatgattaataagatcttagcagaatcttgaaaaggcccagagatccaaagagcccttcgagcaccacgcaagaatgatccatcgcagagtcctaaatgaagaacccactgcaaaaacttgatgaatcttgtttgggagcttgtgggatcctcatagagt

SEQ ID NO: 533403 - DNA, 426 bp, Homo sapiens
  misc_feature (4)..(4): n is a, c, g, or t
  misc_feature (35)..(35): n is a, c, g, or t
  misc_feature (49)..(49): n is a, c, g, or t
  misc_feature (99)..(99): n is a, c, g, or t
  misc_feature (109)..(109): n is a, c, g, or t
  misc_feature (112)..(112): n is a, c, g, or t
  misc_feature (174)..(174): n is a, c, g, or t
  misc_feature (224)..(224): n is a, c, g, or t
  misc_feature (236)..(237): n is a, c, g, or t
  misc_feature (347)..(347): n is a, c, g, or t
  misc_feature (412)..(412): n is a, c, g, or t
ccantggctccctgggcggagcgagcactccggcntgaacccgctgcancggtgtggctcacgctgaccgccgccttcctgctgaccctactgctgcantcctgcagcncgnctgctcccgggctgcgcgatcttcaggacctgatccgctatgggaaaaccaagtgtggggancgtcgcgccccgccgcctgccgagcctttgatgtcccaagagatattttnccacttttatannatctcagtgctgtggaatggcttcctgcctttggtgccttactcaatctctgttcctgggaacaccttttccaagctggcttcatggtttgctcagaattctcggggcgnacagttcagggaaggggagctggcactgtctgcattcttagtgctagtatttctgtggctgacanttacgaagactctt

SEQ ID NO: 533404 - DNA, 1510 bp, Homo sapiens
tatgattcctggcacttagcatagcacgtgcgtcggtgtgtgtatatggcgcgcgacttgcgctgcgtaaattagtgtgtagccctgcatctgaaaggattgctagagtctcgtgattgattacgatgctgggactactccgagtagtgctcggcctgagatttccacaggcctggtagatcattcatgtgccctacagcgatcaggacatgacgacttacgtactaggacattgtgaagacatcattgggaggcttagcatgagaagttccatctgtaggctagacttcaatcaagagagaactctgtgtagcatagagccagaggcctaagctggggtggataggccgcgtagctccttgaatagaagagtctccggtacaacgctctatgccggtcaaaagtggcacatagctagagcgcgaaatgggacgtactactacgtatgccctacagcgtcatacatcttacgtccggactagggggaacgaaacagcgtttcgtgtacacccgtgcctataaccgtgaggaatggttcctctttaaaaatgggccccaaaggtcaattgagtaggggcatagtcgcattgcgacaacgcgaatcatggacttggaccacttgtcacaagggagcgcttactttaccgttgtgacccattaccagaaatccaatggtacgaatttcgccccggcacttattcccccagttggtaagcccttactcaccttgagattggccatagccggaggtcctaatttacggaggcattttctcgtgtcgtgggggagcacaccctgggggagccaggaaaagaaactgagggcgctcaaaaatatccctacgacaagtggtatgtgcgagtggcggccccaggtaggcaaagttcagggcactatctcccatattggcttgtggcagagtacatcgtccatttggattcacaaagggacaggcggcaagcattctcgttgaggcatttgcacgttaaggcctgaacaagcccagggcatagttacattttcataacatttacgagttgggccgacaataggcctcgatgggccctcctgagcacactttcgtgggccgggacacgggacctaataagggccatatcaagtgctggcacgtcgcgaaatgcacgtacctgtcccactgggttcatgtccacatgatactcgttaccccaaaatggttcaattagagaatcgaagtgtcaacccacggattcccacgcatagaaacaggggttgcgcaccaacaggcaccaagaattgtttcaagcaggaggtttattccctacaattctggttcccatatggcactaatccagttaaattaaatccgtaactggacctttgcgacacacccgctgggctacacttgggccccctaggccactagcgttgacactcccataggtgtaacgccggcatacttcttgcatggagacccctggtcgaccaaggaacagaacctgtcaattcccccgcggtatactcggaacct

SEQ ID NO: 533405 - DNA, 205 bp, Homo sapiens
aaatttttttaatcttccccctaaaacttttttattttgttttattttgaaagaggagccttggtgccccccccagtcctaattttttttgcctgcccccccttggggaatgcccccccccccccggtcctgccctgggcaataaggattgtcccccccgaagttttgttggaggtaaaaaaagtaaaagccgcttctgtcttta

SEQ ID NO: 533406 - DNA, 379 bp, Homo sapiens
  misc_feature (126)..(126): n is a, c, g, or t
  misc_feature (143)..(143): n is a, c, g, or t
aaaatgtgagcttgttttcctgcccggcatgtgtccccataaaggctttgtccctcccttgggcctgaaagttccttctcagcctaaaagggggcccttcggactcaggcattactcagcccgggntaatgcctttcaagtgntaaatcaggatttggggccggcttttttgggtccttccccttttcccaggtactcccttacaaaactgtggccaggaagtggccggtataaaggatgcccaaggtctttgtacgggtataggagttagcgggtttgatattgttaaaataaaaaaaattattttttaaaggcccgcttttgtatgtatgttgaacaggatccaggtttttaaagcttgatataaaacagaattcca

SEQ ID NO: 533407 - DNA, 1015 bp, Homo sapiens
ggcgagaatgaatactattgcctcagcaatcagactgtcggacattccagaaatatgtcgaacattatctctgaagggacggcacagttatcgtgaacgggccccagaggaaccctgcgtgcagcggacttcaatcacatcaatgtagaactcacccttcttggaaggataaaaaagaggctccgggttgagcaaatggtggggtaatcagaaaggaatcgtgtgctaccgtatcgggacgtatgtgggtatgtcagtgctaacaagtaaatcatgatcatagggggtgttataatagggcattccgattagcaacgatgacgagtcctggtgttatgctcactatccccagtcgaacacggtttgtgttatccgaaggcagaatgtggtcattcgtatcttgcaacagatccggaaaatttcttcttgaggctgaaaaaataacactccggcagggcttcggaataagactcagcgtgttgctagtacaggtatctcaacgcccagaaaagatgaattaagtcctggaaggaagtgacattagtagcttggttgcaatattcagaggggtgtgattcaggaaggcactaacagttaaaagagcaaggatatcaggaaagttgttggatggtatctatgtctctggaaaaaggaactgttcagcaggctgatgaataagatctaagagttagctggctacggaaagaagatgccatgatgagacttaagactacttgtgatattgagttgatggcatagacagaactatgtttggcaccatcagtggacaacaaacagctggggacgcacccgcgggtcggtgacaaaaggctttcatcggcccggcatggtgtgcccaaccattagttgcgaaagagaaaagcggccttagggacaatagcgcagaacgatacctagaaggaaaggtcccacgggataagcattacaggacacatccaacagtgcagaaccgaccacccaacccgagccaaagaaatacttctctaccccgagt

SEQ ID NO: 533408 - DNA, 1013 bp, Homo sapiens
ggttatgaccctgtaatagactccatgactgggtaacacttcatctagtgattcattcatagcttgtaggaactcgagtcgaccacgctagatgcgtgagactcatcgagaatgcgtgcgtagaaggtgtcgcgtgtctcattgtgacgcatttgcagatcgatgaggttcttggaactgcgtgaaagcatcctttacaggtttctcgaaaccacatgagcgctaatagagcagaaaacgatatccgtagttgcccctgacacattcattcccctcagacattctaactaccacacggcttaggcgcaactaggtaatacgatgatgctaacaggaaaaagtactggtagggagcacctagggggggaacccgatccaagacgagagaagagcatggtccatatgtctctctttctcgaccacatagagaagattggagttggaagaagcatctttggcctatcaagccatacaaaacctcatgtccacttcgtcgtaccaggaattgatgcgctcgtcatcgcattggaaattcagaaattacataacgtttccccctaatacaaagtccttcataacgacgtgtagggaccatgttatacggacccatgcgctaggataggacgcgagtcgagtattcgcatgcataccatacactcgtttgtggaacgcttgtggaagtacgtccgtacatatcactaggaatccactcctggatggaagcgcacgcaagatggaagctgtgcgagctaagccttgctttgctacgccttgctgcgacccccacatttcacccttgttggaaaaggaattgcccccctactacacaaccgcaattgtgggaaattcccaaattccttggtttagccaacggtcttccctattcaaaaggcaatttccttggtacggaacccgctgggcaattgttttggagaatttggcccaacgcattgaatattggcttggtgcacgattaggaagtagttttaaaaattttcttataaggtgccttc

SEQ ID NO: 533409 - DNA, 232 bp, Homo sapiens
gtgaaactatgaactatggacctgagcagggcctcaatcacatagctccatatgtaactagcagcttgtgtgaggatggacatgataactatggccaatgtagaaccctggccacagtgccctggggctttccaaaggcacctcgcatgcctgtttggagcctgtcagacccagcaaaggacaacatctatgtagatagcggatgactgtgtaaggggtggagccgcacccg

SEQ ID NO: 533410 - DNA, 254 bp, Homo sapiens
cgtacgtgtaccggtggtggtgactactgtgtgtgacgaccgtgacgtggtgaaggtggtggtgactacttgtggtgacgaccagtgacgtggtgacacggtggtggtgactactggtggtgaccgacagtgacgtggtgaccggtgactggtgactgtgtggtgactgaccacgtgacgttgggtgacggagtcactggctgactgagtgactgactgacttgacgtgtgggactgacatggttgggtgactg

SEQ ID NO: 533411 - DNA, 1210 bp, Homo sapiens
gtggtagctgtgaggaatgattcgggccgtcaccctgcctcccctgcgtaccgcaccggccgcttctgtcctcggacccattccaatcaatctcgtaaaacatggtggattactatgacagttctaggcgtgcagagacatgcctcacccgaggcatattacatacaggcatcatcggacaacttggcactgcaatgttggcatcccacgatagagaatatcctgtagaatagaagaatgaagcagacgaggaaacattccctgcacgttatgcggtaggtcgactattgaagtgctgctcgtgatgctaatgaaacgggactttctatgcaccagaatctggcaaagaaggcattaagatggtggaaggaggacgttggtcatgtccgtacttgactagtccatttgagaatttgtgccttcgacgattccccgtcaatccccatgactgcattgtctgtccacgaggaattgctcttgggtgggcatatgaggcacgccccattgcttcatgtgttggacgtatccgtttgtggataagaccgccctgttgtcgagggacttgtcttttgagcgaactcagcagaggggggtacccccgaggcggagacgctaggaaaagaccgaacgtgggacccggggtcccggtttattggctcatgcagtccccaagttagcgatttgttcctggatcttctctagcgcacatgtcgcgcttcgcgtctttcctttctcttggattaccagcgatttttacctttccaattttgcggtccatcctagtgaggtccaccagcgattgtgccccctccagcgtttccaatttcacttcctttgcccacgcgttgcgaatagtccggggtagagcctcaagtacgtggcacactccgggcctaaacggtttccaaaaatttccggaattaattcgaaaggctttaccagagcgttaacagcaaacttgggggcttcaaattgtggacagcggatagcacaacacatttccacatcatacgcttacaagcactgaagactttaggtctcccgaaggaacccggggattccacactgcacgaagcacgagttcggaacagatttggcatcaagaacagcacctcggccccaagcgcttaaacagagttcctcttataaacaatcgtaaacctgacgtagctggagcccggaaaccggaccggcagatgggacccgatca

SEQ ID NO: 533412 - DNA, 337 bp, Homo sapiens
tatgggtgccagaccaagactgtcaggatccggggagacatacagcgcttgaaggaaatggacaagagcccttccattacggcacccattactcttcggccatgatcgtgtcgtcgtacctgattcgactgccgccattcgttcagtcatatctcctgctgcaaggtgatagctttgaccatgccgatcgtttgttccagtctattcctgacgcctggaagtctgcgtcctctcgcaacaagacggatgttcgagagctgatccctgagtttttctgcgtgcccgaatttttgacgaacatgaacggctacgactttggccgcagacagagcaatgg

SEQ ID NO: 533413 - DNA, 445 bp, Homo sapiens
tcttccatgcagtgtctctccctagcatgtctgtgatgtcacgtagtcatccccagatagtctcatactgtactcggtcatgcctcgcagtttctacatatacgtgtaacatgtgctagtgctatgtcacgttgacacagcattactcgatgaatgtcagcccttgtcctccagaatagtatcataatggtatccgatgcctcctactgcttggccggaatatggagcatcgatagctgtggcatccatacgacacagtgaggtagcaatcatatgtacagacccgtcatatgcttccacccaaggtaccttgacctgctcaacattaccctagtgctcagcttcacatatcctcgtatcgttggcctattagtatactatgtctcttgtatgctcactgcttatcggtcatcggccctgggtgagtatgtgcgaattagcattc

SEQ ID NO: 533414 - DNA, 124 bp, Homo sapiens
gagcctggcccgtgttaggagtgactatgaagaagaacatgagctgctgtggacatggaaaccatcaacctggacaggagatgcagaggatgttgatttgaatcactatcgcatagggaagatt

SEQ ID NO: 533415 - DNA, 1348 bp, Homo sapiens
tactccagtcgcggtaatcctgaccctggatgataggtcgccactggagcagcagacagccttaccagtacctaccatgatcacacccagggacctgcatagggtagaggggacaccctgaggacctctctcccgcccagcatcctaccctgagtaccccacacagggacctacactactgcaccccaccagaggtacccgctacacaccagagcagccttacataagtaggtactaccctgcgccacctatgaggcagagctagggtacatagcagacaccccatacctaaacccgagtgaccctactacctatgacacaggctatactacccacagagaccaggagccggacccatcgccgataagaccaagaagccacgggatgtagccccggagaccagagcgcgtaccacgcgcgacacacgcgataccctcagtgacggacacgtacccaatatgccacgctatatatacgccttacgctagatagactactagctaacccaccgaagggagctacatagggacacttcgaagggttaactaggggaccataacaaaacggagaaagccttagagaacaggcttacgcgagaactataccggacgcaagaacacgcgttaaccacagaagaagactaaagcaaggcgggcggcggaatacccgtaactatacgacgcattagagcaagaggggcgtaggtaggcaacgtatggcggtataacccttatactagcgacacccacgagatacccctcagttggaacgggaaacagccacatacgagagcatgagccacaaagcggagacatcaattccgagccaagacaatggacaagaccgggaatactgcatgggctatggcggcgagccccagtgggacagtcccgacggagaaggacctattgaaaacgacgccccacggagtagggaaccccagacactcccaacgacaggcagttgggaactacccaatataaaaccaatagacacaatggcataatagacagagacaatataggaccactaacaccgccgcgtgcccttaggaacgcactaagcaaatcgccatacggcatggcaaacacagtaattccccccgcgcagaaacgtgtcacaccaccgtaggtgcgcgatagcgacaggaggaaacacatggcgcagtatgagcaatacctgcgcgcgcccgtccctagagagtcccgttgccataggaccacgcacgtatcaatacgatgccatacaagcaaacacaacccacctggcggacacagaccatcgcgccataccactagctatctcccaccgatgccacaagcatggcggccccccaggtgtacgtcac

SEQ ID NO: 533416 - DNA, 556 bp, Homo sapiens
tgcagcgatacagttctggtgccggtacttccaggtatggactttcggagcaaaaatggtggacagagtgtgccgtgctggaggtctttatatctcttccctctcatatcctctcacgccgcagaacatccagcactgtgttgttgcccatgaaatgaccatctccagaggcgatagaaaagcctttgtcagggaactcctccacaagggccttcacccgcttccctattactctcattccgcttgtagatcagctcccggcgtaggtagctgtcaatctcctgagcagtgatgcgctcctgaggtggtagcgtggcattactaacattggtaacctgggatctgtcaaggcttttgctgttgttaacatggcggtcccccgcagttatacgtgtttgatgagatcctccgtcgtgtaggggatctgaagactgcctgctcgcaggctttcctgctgcaggagggtctggttcaaagcaaagatgacctgtgaaaagttcaacccattcaatggatggcactgctcttccaccttttccactggcttccaaccatg

SEQ ID NO: 533417 - DNA, 199 bp, Homo sapiens
acccctccgggcaccaaccctatggaaccagcgcccatgcacatgacgacatcgccatcgcgtgcgttgtcggcaatggtctgtggcagatccgccacgttgtctacaaaaagcggctccacgcggcccgccacgcgcagcgcgcgggcgagagaacggccatcggcggccaccaccggagcctaaccggcggcgtaca

SEQ ID NO: 533418 - DNA, 348 bp, Homo sapiens
  misc_feature (57)..(57): n is a, c, g, or t
tgtcgcccgggctggagtgcagtggcaggatcagggctccctgcagccccgacctcncaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggttgcagtgagccaagattgggcccctccattccagcctgagagacacagcaacactcttgtcttgataaataaataaataaataaataactgtcaaa

SEQ ID NO: 533419 - DNA, 656 bp, Homo sapiens
  misc_feature (92)..(92): n is a, c, g, or t
  misc_feature (124)..(125): n is a, c, g, or t
  misc_feature (271)..(271): n is a, c, g, or t
  misc_feature (289)..(289): n is a, c, g, or t
  misc_feature (409)..(409): n is a, c, g, or t
gctgggtttacgtggcaaagagtgggcaaaacagtgcgattaccctgatgtaatcactgccatggccagcgtcgccgtgcaattgtccgatnagcctatcgtcagtgttggcctgttctgacannatcggcggcatgactttgcttcctgatttcgaccaattaaaccctgaacaactgcgcgctatcgccgcgcagctgatgcagcgtgtcgagactctcgatcaaaaagtcgagtccatggacaagcagatccatcactacaaaacggncaacgacaagctgacccncgagatcgcacagctcaagcgtttcaagtttgccaagcgcagcgagcagctaaatccgtatcaaaccagcctgctcgatgacgtgatcgatgccgatatcgcggccatcgaagccgagcntgagacgttgcaacccgctccagccccgaccgtggctcggcaaaaacctaaacgcaccgccttgccgcccgagtttccacgcacgcacatccatcacgaaccggacaacactcactgccaatgcggctgcgccctcaagcggtatcggcgaggatgtcagcgagaaactcgactacacgcccggcgtgtacacggttgaacaacacatacgtggcaagtgggtctgtgaggactgcgagaacctgat

SEQ ID NO: 533420 - DNA, 161 bp, Homo sapiens
tttcgtcgtcgtccgtggtgcgaaaaatgggcgaacatcgttaaagggagaaaacgtcaactttgcaacccaaggtttgcggggaaggaaaggaggggcgagcaaggttgcccaaaaacagagtaaaggagtcaacctggtaggtgggggtggtttgggac

SEQ ID NO: 533421 - DNA, 184 bp, Homo sapiens
gcatcctggaactgggatctctcctggcaaagactggacaagctgcagagcttggaggactcctgcagctatgtacgcaccccttcttgcaattccatcagccaaggcctaaagccagcctcgccctggctcccatctctttcttgcatctgcttttcttgcatatggcaggccagcctacagg

SEQ ID NO: 533422 - DNA, 378 bp, Homo sapiens
  misc_feature (6)..(6): n is a, c, g, or t
  misc_feature (12)..(12): n is a, c, g, or t
  misc_feature (70)..(71): n is a, c, g, or t
  misc_feature (100)..(100): n is a, c, g, or t
  misc_feature (103)..(103): n is a, c, g, or t
gcagtntggcgngccaaaccacctatgttggcttgtttagcctcaaccctcgccctttgttgagatcccnnaattcctatgattttataactcagttccnggnggactataagtctatttgtactccaaaccaaacgcagtgcagttcgctactactgaggctgatctgtacgacttcagaccagtccgagacgttattatctaaaaatattacttgatactagatgatccttcagagattttacctataacctatttcttgatgaggttatttaatgcactggagataactgtgacttactgatcaaatacttgaatacttatacttacctgggatttcatttctgctgaaagaaataggaagaacaggactcactt

SEQ ID NO: 533423 - DNA, 1880 bp, Homo sapiens
ctgtgagagcacaacgatgtagcaaactctcgtacaacacacgcactcagtagcccgcaaactgcaacagtatactccacgtcgaaccattgtcacaagacgtattcatactacaatcctaaacccacagcgcatcaacaacacaccttgtagtgcacacccacccataacaacatgcgccatcacacagcaaaactcacacttactactggacaatccacaccaggctaatgcacagaccactagtcactccaggctgaccaggaacaacaaccatctcatgcgccaaaactgccacttaaccgcaaactcaagaacaccaccaccacacacgacctcctcacaaactgtaaacaagaaacattactacattcaccatggagacattaacaatcaaacaccacagtctgacccctcaatgacacacaccaacacaaacaacgcacactttgttgaaccccactaaacattccactcccaacatacattagaccatagaacacgcagcaaccataagaaattaaacacaaccacaatttcaagtggacacataacacacacacacactacatagcagacaaacgccacaatacccacacgaactacaaacaataacaatatcaacgatctataccaacctatgtcagcatactcaccatatacattagctcccacaccacatcacccacccagattagtctaccacaccaactacatcgaagaaacacattccattgccacaacataccctgaccactacacaacactctcaataccaacactgtacgccacatacacgtgaacacactacaacaatatctacaatacgaacacacaccaatggcaaccaaacacaacattccattcaatacaccaactaaccttacccgcggcacaagagaaaaccggcgcaaacaactctcgggcaccagttccaattcctacgacaccactctcacgaacaacatagtgcatgaacacaacaacaatataaacaacaacgacctgatccacacacttataacatattccaacaagctcatcagggatacgatacaacaataaacacacgcatggatatcaataacgaaccaatgtacaaggataaataaccagaacacgtacatcatatacaaaaacaccatcgaatatcacttctactaaactacacatcacaagttgacaacaaactatagcacaccccatcctagcagccccacctaactgcacgctacatacttccgcgcaccctgacaccacacgacaccgaacactactctaaacgggacgcaacacctactctgacaaccgatctccaccactgcaaacacatctgactccaacaaacagtaacagaagcacagtactctctcaaaaccttatcacttgatcacaactgatctgcacacccaagcatatgtgcccaactaaggcaacttaaacacacaccctttatcaaacggacctaatcacatcacctcaccacacacactgcacacccgcgacacacgagccaccgacgaacaacgcatatataccaaaaactatacaaatatcaaactaatcatcccaataccttaaacacaatatcacaaccacacaaaccacacacacaatacaatacgatatctacaataccaactcatacacaaacaaacaccaacacatacctagcaactcaatcaacacacaacattaacaacacactaaactaaaaaaaaacacaatataacactaaacaatctatatcacaccacacactatatacaatcaccatataccacataaaaacaatctcacaaataataacctctcataatatcatacaaaactcacacccaaacaactaaccacacaccaatcacacttactcactacac

SEQ ID NO: 533424 - DNA, 644 bp, Homo sapiens
atcatgctcccatcagaacacaacaatacaaaaaaaaaacaaaaaaacaaaaaatctggcaactaataaattggtggtaactcttaaagcagccttatatagaaaaggtggtggatcctattaattttttttctttctttctatgtaagcaagaacttcactttggacttggcagcacggaccccatttctcgggagtctgtgtgcccggatgggctattcccagattttggtttggaataaactcttttttaatttttaccattagttcccacaagcagaaggaataaacattttaacactgaattctggaacctttcaattatttcaggtggacatctcctgggccaaactaatcaggctcttcggagtcctcttctcactaggcctcaactatggagctccggggtacgtctcggcatggctcaatctcagcaagaatccttctcagtcaatttagccagagttccccatcttcaatagctgaccactcataatatctaatagggctcctcatccttcaccatctgctaggtgatgtcggatcaccctgcattcagcaagaatgctatatgtgggcttagccatgtgggaagcccaaaatatgccaccccaaaatacactcctgtggtataataagagatg

SEQ ID NO: 533425 - DNA, 380 bp, Homo sapiens
atgtctaagcctgattgatttggcctttaacctgaggtatggcagatttatttgctgtgatgatcccttctcccccgaagacttctaacacaagggagctgtcctgaggctctggatgacttttattcttcaaatggcttaccctcccagtagctccagtgacccttccattttccatatccaggaaaatgtgatgcgccacaggtatcaagcgtctggatcgccacttcacgttttattcacaagtgactcagtggaagatccagagtcaacagaggctcgtcaggaagatgtccaccgacaaacgtagaccacaaggaggaagctggggaccaagaggtgtgcggagaccagatccaaggaccggccacagaggagga

SEQ ID NO: 533426 - DNA, 112 bp, Homo sapiens
tactccgtacactgtcagctaacataataatgtaatttagatatgaaacacaatctatccttggcactcccttcaggctttaatccaattattcttgttcattctaaccgta

SEQ ID NO: 533427 - DNA, 218 bp, Homo sapiens
agcccccacacccagccttagagcccgtgccttttttgctaatctctaactcctgtcttttgagaaaggtttagagtaatttatcttaaaattcatttataggctggcgcagtggctcacacctgtaatctcaacactttgagaggctgaggtggaaggatcacttcagctcaggagtttaagaccggcctgagcaacccagtgagaccctgtcttta

SEQ ID NO: 533428 - DNA, 208 bp, Homo sapiens
  misc_feature (3)..(3): n is a, c, g, or t
  misc_feature (11)..(11): n is a, c, g, or t
atnttcggcangagggggattgtaggcatgagcaccatgcctggcctaatttttctgtttttagtagagacaggacttcaccatgttggccaggctggtctcaaattcctgacctcaagtgatgtgcccacctcggctgcccaaagtgctgggattacaggcatgagcttctgtgcccggcctgaactgttaagtgtttgtgaagaat

SEQ ID NO: 533429 - DNA, 347 bp, Homo sapiens
  misc_feature (311)..(311): n is a, c, g, or t
ttaaatgaagcttagtccatctcaggtagacactggtagttactgacaaggtaatgagactcttaggcactgggacagagagggtggggggaccacagacacaataaatgtagggagcttttcctttagggattaaagcaagccaaacagtcaggtggaccccagcatccattcccgagagcaagtgctcatccttggcaataaacgaagactgagtccagggccagaggcgaggggtcctatggctcccatctgggaagcagcccctcagaaatggcagtaattcacagtctggactgaactccccaggncttggaggtaaatggtgaacccaccaaggtaggttt

SEQ ID NO: 533430 - DNA, 264 bp, Homo sapiens
gttgagaatgcgcgtggtcttggattatccaggggggcacactgtactcctgttggtctttccaatcagagactcgaccatcccagcactttggaaggccgaggcaggcagatcacctgaggtcaggagtacgagaccagcctggccaacatggtgaaaccccatctctattaaatatacacaaattagccaggcgtggtggctcacacctgtaatcccagcactttgggaggcagaggcaggagatccactagagcttaggag

SEQ ID NO: 533431 - DNA, 232 bp, Homo sapiens
aatgaatgtaaggtacccctctttttaaggtcgcatttgttacttaccttcgtcatgaattgagcgacccgatggtccgaaaggtatgcctggtgtgcgtctcggagtcacgtgtgtgaagacacatgtcattgtgttgtagttttcgttgtgtcgacatatgtctttgcatccagtaagaaaagtcgggattacctctacattaattgtcatagctcgtgagacgaccttt

SEQ ID NO: 533432 - DNA, 263 bp, Homo sapiens
agagtgctaacgtagccctgctccctcagtgcatacaggaggccgctgccccttctgctactgatcgtggcatctgtctgcgcccagagtcctatctggggtctcctcagcacaggccctctatcaggagctctccaaataggagcctcccatctccaggtgtactctgtgggtctgaccatcccaaaacttaggatcctcctggagagaagatggtagcagcaaaagtaaagggtgagaaaaaggatacgacgctgaaaaaa

SEQ ID NO: 533433 - DNA, 378 bp, Homo sapiens
  misc_feature (45)..(45): n is a, c, g, or t
  misc_feature (104)..(104): n is a, c, g, or t
  misc_feature (114)..(114): n is a, c, g, or t
  misc_feature (130)..(130): n is a, c, g, or t
  misc_feature (138)..(138): n is a, c, g, or t
  misc_feature (300)..(300): n is a, c, g, or t
acgcatacttactcttcctgagaagagattacaaagaagtgtcanggtacttaaacccaaaatgtctccaaaactccaaagcaatcccgggccatctcattganctccaggtancaggataaacgtcttntttctgtngcatagcctcacgtgatgtttctccccctcttctcccaaatactaaatactgcatcactgtaagagtaacagcagtaaataagccagaggttgcgaggcaagctctgtgctgcactgggccctgagggaccaggctgcctgccctactgataagtcttcacntactgaacaagcaacttggagttgctgctgctgctgctgtggtggtggtgtctgttcctggggagttcgcgtgcgatg

SEQ ID NO: 533434 - DNA, 158 bp, Homo sapiens
tagatggcaccactgcactccagcctgggcagcagagtgagatgctatctcaaaaaaattaaataaataatatataagaggaacaaaaaaagacttcagaggaagataaaaacatgatctgtatattacagtgcttatctatcgttacatattagggt

SEQ ID NO: 533435 - DNA, 1588 bp, Homo sapiens
  misc_feature (43)..(43): n is a, c, g, or t
  misc_feature (83)..(83): n is a, c, g, or t
  misc_feature (87)..(87): n is a, c, g, or t
  misc_feature (550)..(550): n is a, c, g, or t
  misc_feature (975)..(975): n is a, c, g, or t
  misc_feature (1010)..(1010): n is a, c, g, or t
aaataggctaggtcggaggcttgttctgaatcggccgaggatnaagttgaagagtggcagcacagggccaaagaagcccaggntgancctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccatggcccgagatgagaaataagaggacccacaatgacatcatccacaacgagaacatgaggcaaggccgggacaagtacaagacgctgcggcagatccggcagggcaacaccaaggcagcgcattcgacgagttcgaggccctgttaacagccaggccaggaccaagggcagaggggtgctcatagcgggcgctgccagcccccgccancgcttgtgtctttaggtgctccaaagtctaggaagctccctcagatcccagttcctttaggaaagcagttacccaaacaggaaacattctgggctgggaaccaggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcaagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaanttgagtctgaagcactctcgcacacacagtgattncctcctcccgtcactccacgcagctggcagagagcacagtgatcaccagcgtgagtggtggaggaggacacttggattttttttttggtttatttttggcttaacagttttagaatcctttgtacttatacacgcttattaagtgatcagctatatactagtttatatacaagctgataactacagatttgtaagcatttagtttctaaaaggggaaagtttggtccctgtatatttggttacccttttacagaataaaagaattccttttgaaaaaccctttaaaccattggcacttgatgtgatgtggcaggagggcagtggtgcgagctggacctgcctgctgcagtcacgtgtaaacgggatcattatacagggtctatggctttgtaatggcctatgccccttttaatttgcgtcagatccccacatgccattttgagctttcaagaccccggtgtgagagaactctgttggcttgtgttcgtggttggcgggctctctcctgcatgggcttgcaggttgctggaaggcagctttggaggcgtgggtccgccattcttcctttcgggcacggt

SEQ ID NO: 533436 - DNA, 269 bp, Homo sapiens
tagaccagtattcaacatgaatatacatttcgacaaaatcacatcataatattaccaacactgaatcagcaatatataaacaacctaatagggtttatcctgagaacataaggctcatttaactcttgaaaatcaatcaactgtaattagctatagtaacagactaaagaaaagccatatgattaatatactgtttgaacacccacattacaccggatataacattaattacccatacaaactcacagaagactatccacagaaagaac

SEQ ID NO: 533437 - DNA, 1700 bp, Homo sapiens
  misc_feature (58)..(58): n is a, c, g, or t
  misc_feature (91)..(91): n is a, c, g, or t
  misc_feature (138)..(138): n is a, c, g, or t
  misc_feature (195)..(195): n is a, c, g, or t
  misc_feature (199)..(199): n is a, c, g, or t
  misc_feature (662)..(662): n is a, c, g, or t
  misc_feature (1087)..(1087): n is a, c, g, or t
  misc_feature (1122)..(1122): n is a, c, g, or t
aggctgaccgtatggctgcactgcgggctggggaggagctggagagacaggcggtggntcagataaagagccaggagcagctggctgcggngcttgcagaatacactgccaagattgcccttctgtttgaggcgcggnggcgcttggtggtgtgggggggggagagtggcagcacagggccaaagaagcccaggntgancctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccatggcccgagatgagaaataagaggacccacaatgacatcatccacaacgagaacatgaggcaaggccgggacaagtacaagacgctgcggcagatccggcagggcaacaccaaggcagcgcattcgacgagttcgaggccctgttaacagccaggccaggaccaagggcagaggggtgctcatagcgggcgctgccagcccccgccancgcttgtgtctttaggtgctccaaagtctaggaagctccctcagatcccagttcctttaggaaagcagttacccaaacaggaaacattctgggctgggaaccaggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcaagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaanttgagtctgaagcactctcgcacacacagtgattncctcctcccgtcactccacgcagctggcagagagcacagtgatcaccagcgtgagtggtggaggaggacacttggattttttttttggtttatttttggcttaacagttttagaatcctttgtacttatacacgcttattaagtgatcagctatatactagtttatatacaagctgataactacagatttgtaagcatttagtttctaaaaggggaaagtttggtccctgtatatttggttacccttttacagaataaaagaattccttttgaaaaaccctttaaaccattggcacttgatgtgatgtggcaggagggcagtggtgcgagctggacctgcctgctgcagtcacgtgtaaacgggatcattatacagggtctatggctttgtaatggcctatgccccttttaatttgcgtcagatccccacatgccattttgagctttcaagaccccggtgtgagagaactctgttggcttgtgttcgtggttggcgggctctctcctgcatgggcttgcaggttgctggaaggcagctttggaggcgtgggtccgccattcttcctttcgggcacggt

SEQ ID NO: 533438 - DNA, 181 bp, Homo sapiens
gccgggagtggattcctaagtaggagtgcgaggagtgtcatcagtgatgatcccaggagtggatacctaagtaggaggcgaggaggtcatcagtgagtgatcccatgtgaagtggctgcagttgacgttgtgcccgggaaacctccttaaggccctgcttttttgcgtgcgggtctaggga

SEQ ID NO: 533439 - DNA, 303 bp, Homo sapiens
cgcggtaggagcggtctggtaagagcggctgagatctgcttgtcctgcatttccctgaagttgggtggcaaagaagctactaccagctcaggcaatgtgtctcttgaacttgtactgctctccttgaactgcccagaccccaccttttttagctccttttagggctgcactcagagtacgtggaagttcctaggccgggggtcaaattggagccataaccgctgacctatgccagagccacagctgcaacctacaccacagctcacagcaacattggatccttaccccgctgagaccgctctt

SEQ ID NO: 533440 - DNA, 182 bp, Homo sapiens
cttctcaacgaagtaaataagaaaaatcctcagccaatattaaaacctactttaaagaaaatactgctggcattttaaagggaggatacaaccaaatccaggaccaagcctgtagatggaagacaaatggtaaactaaaaaacattagccaagaaaataaaatgtcaggcgttgagaagctt

SEQ ID NO: 533441 - DNA, 557 bp, Homo sapiens
cgatctagaggatcccagcggccggcctttttttactaactgatcatactactggaatctggctttagatgtaggtattagtaatattcaaattggtctctgttcttttagaaaatcaaggataaaggactggtgtggtggcttacgtctgtaatcccagcactttgggaggccaaggcaagtggatggcctgagcttaggagttggcgaccagcctgggcaacagggtcaaacccagtctctactaaaataaaaaaattagccaggcacggtggtgtgcgcctatagtcccagctacttgggactgaggctgaggcaggagaatcgcttgaacctgggatgcggaggttgcagtaagctgagatcacgccacggcactccagcctgggcgacagagcaagattccgtctcaaaaaataaaaaaaaaaaaaccaggtcacagaaatattcgaggagagaagacgggcgggttacagaacaattttataagcatgactatgtcctcataagatatgggggagtaaagcttgtggcatctaactctgcccagtgacaag

SEQ ID NO: 533442 - DNA, 208 bp, Homo sapiens
ctcgaggacacgatctctgcactaaacacagacactgcttactgacacacaggagagaggaaaccagaagagcagacaccactcaaggtgacagagaaggaacaatgacacggaacacacacacactgggctccgggtcctgtccacctgcctacaagcaacactaggaaacaccttccaagttgacgcctattctacaacataactt

SEQ ID NO: 533443 - DNA, 871 bp, Homo sapiens
gaccgccagcccggagagctgccgggagttccccgggagcgctgcgggagttccccgggagcctcaggtggtgactatcctgtgagaagcaaaagatacttgtgcaagttaaaaaatatgcctcccaagtttaagcgccacctcaatgatgatgatgtcacaggttctgtgaacaagtgaaaggagaaatcttttgaagatgattcagatgaagcaaagaggactttttttctaaggggaccatctggaccaagattgtgcgctagaattgataaacattacagcatgttcagaatcacgtggatgaagtcatgatgtcatgcacggaacattattacaaaggtaattgagagaggggagagactagattgaactacaggacaaatcagaaggcttatcggataatgcaaccagttttagcaacagatccaaaaaattcgaagggcaattgtggtggcgtggatgcaaataaaaggcatcatggtttggttgtgctatcctttgggtagtgattatcaattctatagtcatgaaatacggtactggatttgtgaccagaatcttcattaaacacgatttgggacagaataaaggattgctgaataatttaatgaaactagtggtatataacttcaaaaattttttcaagaaaataggggaagataacttaaatggaagtgcgatgccattacttttctttttaaaaagtctttaatatatgttagcaaggaatgcatattcaattcaggtcaatgtaagactgcgacattggttaacgggaatataaaactaaggaaggggaatgttggagcaggggtgacgtttgcacttttagaggtacgtgatggagcgaagtgcacagagatgggca

SEQ ID NO: 533444 - DNA, 181 bp, Homo sapiens
gcgagcctatcaccagaagatcgacagcaacctagatgagctgtccattgggcttgggtcgtcttaaggacatagccctggggatgcagacagaattgaggagcagatgacattctgaccgctgacaccaagtggcaagtagatgtcacataaaagcacagaagaaagtcgacactcttag

SEQ ID NO: 533445 - DNA, 512 bp, Homo sapiens
  misc_feature (11)..(12): n is a, c, g, or t
  misc_feature (15)..(15): n is a, c, g, or t
  misc_feature (37)..(37): n is a, c, g, or t
  misc_feature (50)..(50): n is a, c, g, or t
ggggaactcgnnggnggcctttgtttagaccagactncgctcgaactcgnccgccgcgttttactttacctccgcaaccactcctgacaaacccgatatggctgagatcgagaaattcgataagtcgaaactgaagaagacagagacgcaagagaaaaatccactgccttccaaagaaacgattgaacaggagaagcaagtaggcgaatcgtaatgaggcgtgcgccgccaatatgcactgtacattccacaagcattgccttcttatattacttcttttagctgtttaacctttgaagatgcaaaagagttggatcaaagttaaatgactgtgctgcccctttcacaataaagactactgaccaccaaagcccgcctgcctttcccatctgctatcatactgctgcaagaaaggaaagactgcatgttgttaagaaaaaatgggtcaaaaaaatggcgggccacaagtaaaactaaaagaaaaccaaactggccaaaggggcctcaacctt

SEQ ID NO: 533446 - DNA, 303 bp, Homo sapiens
gggaagaccgaatcaacaaaggatctgggccgggccattggcatcatggtctatgtatttaactgctccgaacagatggactatcagtcctgtggcaacatttacaagggtcttgcccagacgggcgcctgggcctgctttgatgagtttaataggattacggtggaggtactctccgttgtggctgttcaggtgaagtccgtccaggacgccatacgcgataaaaaggacacattcaactttatgggcgaaatcataagctgtgtgcccacggtgggcatatttattacaatgaatcccggc

SEQ ID NO: 533447 - DNA, 310 bp, Homo sapiens
gaattacatggtgactgtcatcatcacgccagtctcatatttgtaatttttatgtatggattgcttttcaccatcttggtccgaggtaggtcttgaactcctgatctcgtgatccagtcgcctcgttctccccaagtgcttggattactggcctggaggccattcgcgccgtggagcctatccttgcgcttctattatacttaatacacatatgtgcatgctttcatcacttgtttcatccttttattgtatcccactatgattggttgtaggttgtgccaatagtttatctattttggattctttgtga

SEQ ID NO: 533448 - DNA, 264 bp, Homo sapiens
cgcggtcatgtcttacgcccctggctcactgcgttaccgatccggtgttgccgtgcagctgtggtgtgggttgcagacgcggctcgtgatcccgagttgctgtggctctggcagtatgccggtggctacagtctcccattaaacctgaactctaacacgtaccaatgtcaacaactgctgctttcagatctgtctacctacccagtgccagccaggtgcccaaagtcaggtcctgactcaaggctccgtaggacataaccgcgg

SEQ ID NO: 533449 - DNA, 651 bp, Homo sapiens
tccgtcacgcttatcttctttgatcaccaccaccaagtctacctcacagaatcctccgagcttcacttctgtgattgccaccgcaggatcacctcacacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttctccaccaccgagaccacctcacacagtactcccagcttcacttcttcaatcaccaccactgagaccacctcacatggagacaacctcacggagttctcccagcttcacttctttgatcaccatcactgggtccacatcccacagtactcccagcttcacttcttcgatcaccatcactgagaccacctcacacagtactcccagcatcacttcttcagtcaccactgccgagaggacatcccacagcactcccagctacgctttttcgattgccaccagtgagacaccctcacacactgttcccagcttcacttctttgatcaccaccaccgagagcacatcccacagtcgtcccactaacttggcgtccttaatcacc

SEQ ID NO: 533450 - DNA, 270 bp, Homo sapiens
tctgtggtgctctagcggctcctttcttatggcatgcctgctggcatggccacgttgcctccgtgtggtggctgtctgcggtgggtgtgggctgtcctgctcatgcacctgggcggccgcacgttctttgcctttcgaggcacccattccgcgcgctgctgcctcttcggcctcgggcatgccccggcttggggccgtcgttccggcactcgtggccccaacccattgcccagacttgcgcacaggcacaccttccaaggcttccgcatc

SEQ ID NO: 533451 - DNA, 514 bp, Homo sapiens
  misc_feature (451)..(451): n is a, c, g, or t
  misc_feature (461)..(461): n is a, c, g, or t
tccgtcacgcttatcttctttgatcaccaccaccaagtctacctcacagaatcctccgagcttcacttctgtgattgccaccgcaggatcacctcacacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcggatcaccaccaccgagaccacctcacacagtactcccagcttcacttctttgatcaccacctctgagaccccntcacacagtnctcccagcttcacttcttcgatacctccacagcccccagaagcaggtttcgtt

SEQ ID NO: 533452 - DNA, 344 bp, Homo sapiens
  misc_feature (182)..(182): n is a, c, g, or t
  misc_feature (326)..(326): n is a, c, g, or t
  misc_feature (329)..(329): n is a, c, g, or t
ggagtgtgcccatggacaagaaggaaactatccatgttagggagttgatctgttatagcgactagtattcccggtacttgtacaaggatgaaatgggttttatgaatgtttactccaggatcccaaaccaagaatcattcaccccaatttttttttagcacctattatgtgccaggcgactngcaaggcacagacacaagaaagtttaaaaaaaccattctcagggctgggtgctgtggctcacagctgaaatcccagcactttgggaggctgaggtgggagaattgcttgagcccaggagttcaaggacagcctgggcaacattnttngactccttctctaca

SEQ ID NO: 533453 - DNA, 986 bp, Homo sapiens
  misc_feature (184)..(184): n is a, c, g, or t
  misc_feature (187)..(187): n is a, c, g, or t
  misc_feature (191)..(191): n is a, c, g, or t
  misc_feature (195)..(195): n is a, c, g, or t
  misc_feature (206)..(209): n is a, c, g, or t
  misc_feature (446)..(446): n is a, c, g, or t
  misc_feature (875)..(876): n is a, c, g, or t
  misc_feature (887)..(887): n is a, c, g, or t
  misc_feature (893)..(893): n is a, c, g, or t
  misc_feature (895)..(895): n is a, c, g, or t
tttctttgtttgtttgtttttttgtctttgtgctttttttgtcttttgtctgtgtgtttgtctgagtgttcacctttttttttcgtgtcttttttgtgttttgtttgttctgtttttattatctttgtctcccaattttctatcaggggtcctcaattcatatacattgcatccccatcatcancancatngaanggtcttaagannnnctggtcagatgatattattgcttcccatcgtgcaaccagtacattagttgccactgagaaagctgacagccaggagtctgtcaagtatgctcaagatatgttatataatactacatgcctgttcacagggggataatgcctaggacatgacttatgtgtacttcttgatttcatcatacaagacaagcacacaaagcaccacccagcctctgagaacattggaccatgcacccttgnacaaaagcctttgcctccgttgcatcacgagcaatcttccggccagcagtcaagcgtgcctgtgtacatgatgtcagttcctctgcgccactgacatgcatcatcatgcggcggcgaacggtgtcaaatggataggaagtcaacccggcaacagcagtgacagtctgtgcgatcatccagctgatgacgatgtgagtgttcttgggatccggaagcattccctttgcagtgtcatagataccgaagtaggcggctcggtagatgataataccctgcacagacacgttaaagccttggtacaggcccttaatcccatcagatttgtagatcttaaccaggcagtcaccgaggcctcggaattccctttcagctccagctttacccacatcagctgctagacgggtacgggcaaaatcaagagggtacacnnacacagggatntggccntncgcaccacccgatgccagattacatgcaaagtagcgccaaactggcttctctgtccacaccacccaggaagatctgcttgtattgatcttt

SEQ ID NO: 533454 - DNA, 235 bp, Homo sapiens
  misc_feature (30)..(30): n is a, c, g, or t
aacaacgcccacaggcatttatggtacacntaatgaacaccgttggtttaaaaagcagctgtcggtccgaatccggatgtgggctcggagccactcacatgtctctcccgcctctccggcgcgcgagcggctcggggggtcccggcggcccgggagcccggtgggccttccgagagcaccgaggggcggcgccgggtgtccccggccggcggcgaatccctccctggcgcgggcg

SEQ ID NO: 533455 - DNA, 190 bp, Homo sapiens
tgagatgatgaaggcctcccagcaggccattgagcggggtgtcaaagtcttgcctgatttgtcagacatataagcggagaagcggacattatcgatgtgaccactgtggcgtcaataaaggagatcacagaaaagaaccgacactgcctcccggacattgctccgcacgctattgagcggctccaccaca

SEQ ID NO: 533456 - DNA, 2013 bp, Homo sapiens
ctctcagtaccacgccggtggccagttctgaggctagcaccctttcaacaagtcctgttgacaccagcacacctgtgaccaattcttctccaaccaattcatctcctacaactgctgaagttaccagcatgccaacatcaactgctggtgaaggaagcactccattaacaaatatgcctgtcagcaccacaccggtggccagttctgaggctagcaccctttcaacaactcctgttgactccaacacttttgttaccagttctagtcaagccagttcatctccagcaactcttcaggtcaccactatgcgtatgtctactccaagtgaaggaagctcttcattaacaactatgctcctcagcagcacatatgtgaccagttctgaggctagcacaccttccactccttctgttgacagaagcacacctgtgaccacttctactcagagcaattctactcctacacctcctgaagttatcaccctgccaatgtcaactcctagtgaagtaagcactccattaaccattatgcctgtcagcaccacatcggtgaccatttctgaggctggcacagcttcaacacttcctgttgacaccagcacacctgtgatcacttctacccaagtcagttcatctcctgtgactcctgaaggtaccaccatgccaatctggacgcttagtgaaggaagcattcccattacaattatgcatgtcagcaccacacgtgtgaccagttctgagggtagcaccctttcaacaccttctgttgtcaccagcacacctgtgaccacttctactgaagccatttcatcttctgcaactcttgacagcaccaccatgtctgtgtcaatgcccatggaaataagcacccttgggaccactattcttgtcagtaccacacctgttacgaggtttcctgagagtagcaccccttccataccatctgtttacaccagcatgtctatgaccactgcctctgaaggcagttcatctcctacaactcttgaaggcaccaccaccatgcctatgtcaactacgagtgaaagaagcactttattgacaactgtcctcatcagccctatatctgtgatgagtccttctgaggccagcacactttcaacacctcctggtgataccagcacacctttgctcacctctaccaaagccggttcattctccatacctgctgaagtcactaccatacgtatttcaattaccagtgaaagaagcactccattaacaactctccttgtcagcaccacacttccaactagctttcctggggccagcatagcttcgacacctcctcttgacacaatgcacaacttttaccccttctactgacactgcctcaactcccacaattcctgtagccaccaccatatctgtatcagtgatcacagaaggaagcacacctgggacaaccatttttattcccagcactcctgtcaccagttctactgctgatgtctttcctgcaacaactggtgctgtatctacccctgtgataacttccactgaactaaacacaccatcaacctccagtagtagtaccaccacatctttttcaactactaaggaatttacaacacccgcaatgactactgcagctcccctcacatatgtgaccatgtctactgcccccagcacacccagaacaaccagcagaggctgcactacttctgcatcaacgctttctgcaaccagtacacctcacacctctacttcgatcaccaccaccgagaccacatcccacagtactcccagcttcacttcttcgatcactcgatcgtcaccaccgagaccacatcccacagtactcccagcttcacttcttcaatcagcaccactgagaccacatcccacagtactcccagcttcacttcttcgatcaccatcactgagaccacctcacacagtactcccagctacactacctcaatcaccaccaccgagctacctcacaccttcctcccaacttcacgtctttgatcaccgcctcccagaaagattg

SEQ ID NO: 533457 - DNA, 3791 bp, Homo sapiens
ctctcagtaccacgccggtggccagttctgaggctagcaccctttcaacaagtcctgttgacaccagcacacctgtgaccaattcttctccaaccaattcatctcctacaactgctgaagttaccagcatgccaacatcaactgctggtgaaggaagcactccattaacaaatatgcctgtcagcaccacaccggtggccagttctgaggctagcaccctttcaacaactcctgttgactccaacacttttgttaccagttctagtcaagccagttcatctccagcaactcttcaggtcaccactatgcgtatgtctactccaagtgaaggaagctcttcattaacaactatgctcctcagcagcacatatgtgaccagttctgaggctagcacaccttccactccttctgttgacagaagcacacctgtgaccacttctactcagagcaattctactcctacacctcctgaagttatcaccctgccaatgtcaactcctagtgaagtaagcactccattaaccattatgcctgtcagcaccacatcggtgaccatttctgaggctggcacagcttcaacacttcctgttgacaccagcacacctgtgatcacttctacccaagtcagttcatctcctgtgactcctgaaggtaccaccatgccaatctggacgcttagtgaaggaagcattcccattacaattatgcatgtcagcaccacacgtgtgaccagttctgagggtagcaccctttcaacaccttctgttgtcaccagcacacctgtgaccacttctactgaagccatttcatcttctgcaactcttgacagcaccaccatgtctgtgtcaatgcccatggaaataagcacccttgggaccactattcttgtcagtaccacacctgttacgaggtttcctgagagtagcaccccttccataccatctgtttacaccagcatgtctatgaccactgcctctgaaggcagttcatctcctacaactcttgaaggcaccaccaccatgcctatgtcaactacgagtgaaagaagcactttattgacaactgtcctcatcagccctatatctgtgatgagtccttctgaggccagcacactttcaacacctcctggtgataccagcacacctttgctcacctctaccaaagccggttcattctccatacctgctgaagtcactaccatacgtatttcaattaccagtgaaagaagcactccattaacaactctccttgtcagcaccacacttccaactagctttcctggggccagcatagcttcgacacctcctcttgacacaatgcacaacttttaccccttctactgacactgcctcaactcccacaattcctgtagccaccaccatatctgtatcagtgatcacagaaggaagcacacctgggacaaccatttttattcccagcactcctgtcaccagttctactgctgatgtctttcctgcaacaactggtgctgtatctacccctgtgataacttccactgaactaaacacaccatcaacctccagtagtagtaccaccacatctttttcaactactaaggaatttacaacacccgcaatgactactgcagctcccctcacatatgtgaccatgtctactgcccccagcacacccagaacaaccagcagaggctgcactacttctgcatcaacgctttctgcaaccagtacacctcacacctctacttctgtcaccacccgtcctgtgaccccttcatcagaatccagcaggccgtcaacaattacttctcacaccatcccacctacatttcctcctgctcactccagtacacctccaacaacctctgcctcctccacgactgtgaaccctgaggctgtcaccaccatgaccaccaggacaaaacccagcacacggaccacttccttccccacggtgaccaccaccgctgtccccacgaatactacaattaagagcaaccccacctcaactcctactgtgccaagaaccacaacatgctttggagatgggtgccagaatacggcctctcgctgcaagaatggaggcacctgggatgggctcaagtgccagtgtcccaacctctattatggggagttgtgtgaggaggtggtcagcagcattgacatagggccaccggagactatctctgcccaaatggaactgactgtgacagtgaccagtgtgaagttcaccgaagagctaaaaaaccactcttcccaggaattccaggagttcaaacagacattcacggaacagatgaatattgtgtattccgggatccctgagtatgtcggggtgaacatcacaaagctacgtcttggcagtgtggtggtggagcatgacgtcctcctaagaaccaagtacacaccagaatacaagacagtattggacaatgccaccgaagtagtgaaagagaaaatcacaaaagtgaccacacagcaaataatgattaatgatatttgctcagacatgatgtgtttcaacaccactggcacccaagtgcaaaacattacggtgacccagtacgaccctgaagaggactgccggaagatggccaaggaatatggagactacttcgtagtggagtaccgggaccagaagccatactgcatcagcccctgtgagcctggcttcagtgtctccaagaactgtagcctcggcaagtgccagatgtctctaagtggacctcagtgcctctgcgtgaccacggaaactcactggtacagtggggagacctgtaaccagggcacccagaagagtctggtgtacggcctcgtgggggcaggggtcgtgctgatgctgatcatcctggtagctctcctgatgctcgttttccgctccaagagagaggtgaaacggcaaaagtacagattgtctcagttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagatccgaattcagaggcctcaggtaatgacgacatcattttaaggcatggagctgagaagtctgggagtgaggagatcccagtccggctaagcttggtggagcattttcccattgagagccttccatgggaactcaatgttcccattgtaagtacaggaaacaagccccgtacttaccaaggagaaagaggagagacagcagtgctgggagattctcaaatagaaacccgtggacgctccaatgggcttgtcatgatatcaggctaggctttcctgctcatttttcaaagacgctccagatttgagggtactctgactgcaacatctatcaccccattgatcgccaggattgatttggttgatctggctgagcaggcgggtgtccccgtcctccctcactgccccatatgtgtccctcctaaagctgcatgctcagttgaagaggacgagaggacgaccttctctgatagaggaggaccacgcttcagtcaaaggcatacaagtatctatctggacttccctgctggcacttccaaacaagctcagagatgttcctcccctcatctgcccgggttcagtaccatggacagcgccctcgacccgctgtttacaaccatgaccccttggacactggactgcatgcactttacatatcacaaaatgctctcataagaattattgcataccatcttcatgaaaaacacctgtatttaaatatagggcatttaccttttggtaaag

SEQ ID NO: 533458 - DNA, 555 bp, Homo sapiens
  misc_feature (6)..(6): n is a, c, g, or t
  misc_feature (70)..(70): n is a, c, g, or t
  misc_feature (75)..(75): n is a, c, g, or t
  misc_feature (82)..(82): n is a, c, g, or t
  misc_feature (108)..(108): n is a, c, g, or t
  misc_feature (141)..(143): n is a, c, g, or t
  misc_feature (184)..(184): n is a, c, g, or t
  misc_feature (200)..(200): n is a, c, g, or t
  misc_feature (274)..(275): n is a, c, g, or t
  misc_feature (350)..(350): n is a, c, g, or t
  misc_feature (418)..(418): n is a, c, g, or t
  misc_feature (420)..(420): n is a, c, g, or t
  misc_feature (521)..(521): n is a, c, g, or t
tgagcnttaaaaaccaaactttgacataaccttatttcttgtatttgccccctttttttttataaaaggngaatnaaaaganataatttaatataaccattgtatggnttcctaatcaagatttcacgttctgcgggcgcnnngggggtggttttctttgctctctgtaattagagcctttggnagcaaagttgaaaggnagtatttccattctgttactgttttgtagcactttgtccatttattgatttttaaagtagatatttagataccnnacctgccctgccctgccccaaaaagaaaaatgtttattgtcctgctaatctatatgcctacacctcagaagctgncagatgagcttcctaaaacatgggggtgagtaaatgttagaactgtgatatcttctcatttccacagngntttgggtttaaaacaaatgggtaatatttgtaagcctgaaagctgccatcctctttaacatctctacctaccttttttaaaatattttttctggaaggtanaagtaacagttaaggcactcagaaacatattgtt

SEQ ID NO: 533459 - DNA, 4433 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 533460 - DNA, 893 bp, Homo sapiens
  misc_feature (23)..(23): n is a, c, g, or t
  misc_feature (64)..(64): n is a, c, g, or t
  misc_feature (70)..(71): n is a, c, g, or t
  misc_feature (73)..(73): n is a, c, g, or t
  misc_feature (81)..(82): n is a, c, g, or t
  misc_feature (112)..(112): n is a, c, g, or t
  misc_feature (117)..(117): n is a, c, g, or t
  misc_feature (119)..(119): n is a, c, g, or t
  misc_feature (122)..(123): n is a, c, g, or t
  misc_feature (126)..(126): n is a, c, g, or t
  misc_feature (131)..(131): n is a, c, g, or t
  misc_feature (173)..(173): n is a, c, g, or t
  misc_feature (175)..(175): n is a, c, g, or t
  misc_feature (185)..(185): n is a, c, g, or t
  misc_feature (194)..(194): n is a, c, g, or t
  misc_feature (204)..(204): n is a, c, g, or t
  misc_feature (215)..(215): n is a, c, g, or t
  misc_feature (289)..(289): n is a, c, g, or t
  misc_feature (343)..(343): n is a, c, g, or t
  misc_feature (388)..(388): n is a, c, g, or t
  misc_feature (417)..(417): n is a, c, g, or t
  misc_feature (433)..(433): n is a, c, g, or t
  misc_feature (509)..(509): n is a, c, g, or t
  misc_feature (520)..(520): n is a, c, g, or t
  misc_feature (524)..(524): n is a, c, g, or t
atgttcgtgcgcaagtcccagtnccgcctgcccttcaaggccaccacgcctgtcatcatggtgncccccnncnccggggtnncccccttcataggcttcatccaggagcggncctgncngcnncancaggncaaggaggtgggggagacgctgctgtacctacgctgccgccncncggatgaggnctccctgtnccgggaggcngtggcgcagtnccacagggacggtgcgctcacccagctcaacgtggccttctcccgggagaagtccaaaaaggtctacgtccagnacctgctaaagcaagaccgagagcacctgtggaagttgatcgaaggcggtgccnacatctacgtctgtggggatgcacggaacatggccagggatgtgnagaacaccttctacgacatcgtggctganctcggggccatggagnacgtgcaggcggtggactacatcaagaaactgatgaccaagggccgctactccctggacgtgtggagctaggggcnctgcctgctcnccancccacccccacagactccggcctgtaatcagctctcctggctccctcccgtagtctccctgggtgtgtttggcttggccttggccatgggcgcaggcccagtgacaaagactcctctgggcctggggtgcatcctcctcagcccccaggcccaggtgaggtccaccggcccctggcagcacagcccagggcctgcatgggggcaccgggctccatgcctctggagcgctctggccctcggtggctgcacagaagggctctttctctctgctgagctgggcccagcccctccacgtgatttccagtgagtgtaaataattttaaataacctctggcccttggaataaagttctgttttctgtaaaaaaaa

SEQ ID NO: 533461 - DNA, 4464 bp, Homo sapiens
  misc_feature (126)..(126): n is a, c, g, or t
  misc_feature (128)..(128): n is a, c, g, or t
  misc_feature (131)..(131): n is a, c, g, or t
atggggtgccagcttcacttctttgataaccacctctgagaccccgtcacacagtactcccagcttcacttcttcaatcagcaccactgagaccacatcccgactcgatcgtcaccaccgagaccncntcncacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 533462 - DNA, 292 bp, Homo sapiens
acattcatctctctggctcagcattctgtgtgtgaagctggcagaattggtcagatgcatcacgcgtggatggctttgtttgagaaaaagtgcgggaggatgagttccactatcgatacgtaccagactcaggtctcagacgcaggcttgtaccgctgcatggtgacagcctggtctcctgtcagtcgcagcctttgttgagaagcagcaagcagtctctccaatcctattaagatagacttccaaacctcaggtcctatatttattgcttgtgtgcgttcagacagaccat

SEQ ID NO: 533463 - DNA, 4293 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacaagcctacgaactctcaccccttcgtctgtgggcaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattctttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 533464 - DNA, 239 bp, Homo sapiens
  misc_feature (14)..(14): n is a, c, g, or t
  misc_feature (155)..(155): n is a, c, g, or t
  misc_feature (167)..(167): n is a, c, g, or t
gtgggctctgagancctccaggaaagagcttttgaaaataaatgtgaagctgggcttaggagctcatgcctgcaatcccagagactagggaggccgagaagggaggatcgcttgaggtcaggagttagagaccagcctggggaacacagcaagancccatctcaaanacacacacacacacacactaaagaaaaaccaaaacaaaacaaaacaaaacaaaaaaaccaagccaggcatgg

SEQ ID NO: 533465 - DNA, 1041 bp, Homo sapiens
  misc_feature (812)..(812): n is a, c, g, or t
acttatgagactgcgacatctgcccgatggacgccgtcatcaacaatgtagattgtggtgacataccctctacggttgaacagaacaatcgatgcctccgaggcttgaacccgtcggactctcgtactaggtacacaactgtacatcggcacaaagatcccaggactgaggcacatgagcatagtcccttgcctgaactgcaggcatcagcatcatgaatcatttggttggcagaaaccacctaggagacaagtggcacggtacctatctcgtactgaatgtaccatgtaattcacactgagaaggtctgactctctcagtacttgggttgacgcactctcgttgtgtggcttgtctcccggagaccagggatcgaatgacatgtctcttgagcgaatcccaataatgaatatgctcacagagtacccagggttgcagctttggttgatgcctgcagagattattattccacgagttgggactcgagcacagggggcaagatctataagatcgacctgtcgctggctagagctgctcgctctcgtgcatcgaaactggtgggtgcatgttggtgtgccatggaacgttcactggttgtgcccataacgattcatccggtgcgataggatggtttgtcctgacatggactggtctgccaggtgataccgaggagcccgcattttacctgtgtgatgggttgagtatagaagacattgagcttcaatgttccaaaacaaaaaacaagcaagacctaatatttgttgggagtgggatcccccaacaatgtgaaaattggtttgtctgttgacatntcgcacccttccggggggctaaaaaattgtccgacaaccttcattaaggcaacagcacggcacatccaggaagcctgtaccaagcggcatttccgaaccacgtttcataggacaatgttcccgggggggcaaggccttcctgcaaatggaaacaccgggagcgagggcatgggagagactggaggtacaccgaggcggagagcaaacaaatgattgacctggtgtcgac

SEQ ID NO: 533466 - DNA, 583 bp, Homo sapiens
cgtctgtttgtagaaaaatatatgtgcaaaagtagtgtaactatattattcactaaatagctgatatggctatacttcagagtcttcgatagtatgatcaggggtgtctttaaaagtgtcttctgtagcagaataggtgggagttgggtctcttctcgaaggaggcttaggctaagcagggagcgaaggtgatggaggtggtgtcgcagcaacacttgccttaggctcgttctccatctgtgcatagatcggatctacagagttggtagtatgtttagattttcgtttgaagagatgccatttagtcacctgagttccatcagcagctggtgaagttgggtttgtctctggaactatctcagaagggttcatgggacttccataattcttattatccacgattgtcagatacagtcacctggataggctgaaccagtttgacagcactgtctctggcctgagtacatggggttttcaaatattatgggctgcttccccatttccatgacaaagtcttcactcattggcattgacctgtcaatagcagtctcaggtccaaaaccagacactccaatatccatgt

SEQ ID NO: 533467 - DNA, 5368 bp, Homo sapiens
  misc_feature (423)..(423): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaggaccactgagaccacctctcatagtactcccagcttcacttcttcgatcatcgccaccgaaaccacctcacacagtactcccagctncacttctttgatccccaccaccgagaccacctcacacagtactcccagcttcacttcttcaatcaccaccactgagaccacctcacacagtactcccagcttcacttcttcgatcaccaccaccgactcgatcgtcaccaccgagaccacatcccacagtactcccagcttcacttcttcaatcagcaccactgagaccacatcccacagtactcccagcttcacttcttcgatcaccatcactgagaccacctcacacagtactcccagctacactacctcaatcaccaccaccgagaccccctcaagcagtactcccagcttcacttcttcgatcaccaccaccgagaccacatcccacagtactcccagcttcacttcttcaatcagcaccactgagaccacatcccacagtactcccagcttcacttcttcgatcaccaccactgagaccacctcacacggtactcccagcttcacttcttcaatcaccaccactgagaccccctcacacagtactcccagcttcacttctttgatcaccaccaccgagaccacctcacacagtactcccagcttcacttcttcgatcaccaccaccgagaccacctcacacagtactcccagcttcacttctttgatcaccaccactgagaccccgtcacacagtactcccagcttcacttcttcgatcaccaccaccgagaccacctcacacagtactaccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 533468 - DNA, 387 bp, Homo sapiens
tctagaggatccacgtgcattgtgttatattcacatagtgaagattggaacacccaaatgccatcaatgatagactggattaagaaaatgcagcacatatacaccatggaatactaagcagccataaaaaatgatgtgttcatttcctttgcagggacatggatgaagctggaaaccatcattcccagcaaactatcgcaaggacaaaaaaccaaacaccacatgttctcactcataggtgggagctaaatggtgagaacacaatggcacgtggatccacaatggcacgtggatcacaatggcacgtggatcaccatggcacgtggatcaccattgtggatcaccatggcacgtggatcacaatggcacgtggatcaccatggcacg

SEQ ID NO: 533469 - DNA, 150 bp, Homo sapiens
ttgggatgcaacgcaggaggattgtttgagcccaggaattcaagatcagtctcggcaacatagtgagaccctcgtctatacgaaaaattaaaaaaagaattagccaggcatggtggtgtgcccctgtggtcctagctacttgggaggctg

SEQ ID NO: 533470 - DNA, 456 bp, Homo sapiens
  misc_feature (62)..(62): n is a, c, g, or t
  misc_feature (89)..(89): n is a, c, g, or t
  misc_feature (113)..(114): n is a, c, g, or t
  misc_feature (123)..(123): n is a, c, g, or t
  misc_feature (250)..(250): n is a, c, g, or t
  misc_feature (278)..(278): n is a, c, g, or t
ggggcacaaaaagggcggggaacaaggggggaaggaaagaggaaaggaaaaacccaaggaangggacaaaaaaaaaaaagcaaaggcgncaaggaaaaaacgggaggcacccnngggggacanacaaggaccaggcagcaaaaaagcaatcggagcaaaaataaaacaaaaagccacaacaaaagaaagccaaaccaatcccccaccaaaaaggaagaaaaaaattgatgtgaagcccatccacccttcnacccaggtgccatagagcaaaggtgacngcagcagtaagtcagagctgaatgacagacaaaaatggaggccagacaccacggtctggaggaagctacgctgaattccagaacccagactctctatgggttaatatcttgtttttcctgagattaaattaagaccagatctcctaggacctagtggacatctggtattattaatctc

SEQ ID NO: 533471 - DNA, 5396 bp, Homo sapiens
  misc_feature (423)..(423): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaggaccactgagaccacctctcatagtactcccagcttcacttcttcgatcatcgccaccgaaaccacctcacacagtactcccagctncacttctttgatccccaccaccgagaccacctcacacagtactcccagcttcacttcttcaatcaccaccactgagaccacctcacacagtactcccagcttcacttcttcgatcaccaccaccgactcgatcgtcaccaccgagaccacatcccacagtactcccagcttcacttcttcaatcagcaccactgagaccacatcccacagtactcccagcttcacttcttcgatcaccatcactgagaccacctcacacagtactcccagctacactacctcaatcaccaccaccgagaccccctcaagcagtactcccagcttcacttcttcgatcaccaccaccgagaccacatcccacagtactcccagcttcacttcttcaatcagcaccactgagaccacatcccacagtactcccagcttcacttcttcgatcaccaccactgagaccacctcacacggtactcccagcttcacttcttcaatcaccaccactgagaccccctcacacagtactcccagcttcacttctttgatcaccaccaccgactcgatcgtcaccaccgagaccacatacgaccacctcacacagtactcccagcttcacttcttcgatcaccaccaccgagaccacctcacacagtactcccagcttcacttctttgatcaccaccactgagaccccgtcacacagtactcccagcttcacttcttcgatcaccaccaccgagaccacctcacacagtactaccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 533472 - DNA, 131 bp, Homo sapiens
tacctctagtcaccctgacggacctgccgaggaggacacctgcatggccttcagatccatctgcagccggagtgaagctgttcatccgggccctgcttggacccagcaccctcccgagacttcaccccagt

SEQ ID NO: 533473 - DNA, 203 bp, Homo sapiens
aaaaccccccttttttaaaaaaaaatttgggggtttggtttcccctttggggggggggacgccccccccgggtttttttttacccccgaaaaaagggggcccccgggggtgggggggccccccggggaggcggggggggggcccggggtatttccgggggcccggttccccccagggggtttaaaaaaaaaccctttttttta

SEQ ID NO: 533474 - DNA, 105 bp, Homo sapiens
tcggtggccccactccaagccctggagtactccaaggagggctgggagtatgtgacaggcgcgcaccaatgtagcgagtcagcagtgtgcctgccttgcccctgt

SEQ ID NO: 533475 - DNA, 1484 bp, Homo sapiens
  misc_feature (1)..(2): n is a, c, g, or t
  misc_feature (196)..(196): n is a, c, g, or t
  misc_feature (239)..(239): n is a, c, g, or t
  misc_feature (260)..(260): n is a, c, g, or t
  misc_feature (304)..(304): n is a, c, g, or t
  misc_feature (323)..(323): n is a, c, g, or t
  misc_feature (330)..(330): n is a, c, g, or t
  misc_feature (543)..(543): n is a, c, g, or t
nnctctgcgtccttcctgctctttgcctcgtgtttctgttctctcgttgtcatggtagtagagagcagcagataccagaagaatagctgtatagcgtggaggaggtgagagagcagaggcgagacgagcaggaagtggattggattggtgcgtccgactttcagaatcaattcctaggtgccgatgcgctaatgtntaactcgcattgacccgcggtactggtattgacagaccgagcngttgggttctttatgcactangtagtggcgtctgctgcttagcgacacggcggctggtgtgcgtntgctctagctaccgccacnctaagtnggtggtacgatcacgctatgcgaccgacgcgacgcgttggtgcttcgctacgtgatagtatgattatgaattcgtgatcgacgcgggtggtgtcgcgcacagctagctgttgtgttcttctagctcggccctgcttgctctgggatggccgtgagcttagtagatggctctctgtgtgtcctacagcgcggtcactcaaactcttgtctggtngtgtgtcttcctcgccccgccccgcggtgtgtgacaccgtgaggtgtgtgtgtgtcgctggttcaccgcacgagagatagaccacaacgttcttcgtctgggtgtacccagtacattggtgtggtgtgggatccgctgcgtccgctccgggttatatcttgtttcgtcgatcgaaacaaaccaaaaagagggcggttgtcgctttatgtctagttagatgccttgctgccgcatcatccgtaaatacagagggcgtgtttcgagggaacctctgttgtcagaaggtgcgctgtcacacacaggcgcggggaccgttgcatgataataatgtggtcacaccatactggagttttcacaagacaggtgcacctcgcgttatataatggtgccctccccctcccctctcttttagttgcattgtagtaagtaagacatgtgttcccagactctgctgtttgtgacgatcttatatttgctctcctttgtgcatgtgtgatataaaataatatgtaacatgtcagtcctccctctgcgttcccaacaaccgtctttttattgctccccgctgggcagctttcgtgcggcaccgacgtgtgtctaaagagacgggagttcctctgttaataatgaggcgccactctcttacctgcagcagtcgcgccgttttgtggggggcgcgctcacgtgtctctctctcctcgcgccgtgcgtaaattattcttgtcaagcagatagcgaccgcaagagggggggtcgatctattacaataggtgagtcattgggagacatacctccttacttctcctcgaggcctcggctcacaatgaggcccacggggaccccgctcgggtgacagaatgtttcttgctggagcatgttctcttctgtaataaagacattgtttcttcgacaggtcaaatcaaaagaacacaaaatatact

SEQ ID NO: 533476 - DNA, 710 bp, Homo sapiens
  misc_feature (16)..(16): n is a, c, g, or t
  misc_feature (34)..(34): n is a, c, g, or t
  misc_feature (306)..(306): n is a, c, g, or t
  misc_feature (422)..(423): n is a, c, g, or t
  misc_feature (428)..(429): n is a, c, g, or t
gcaccgagcttaattngcccaacacttggggagnggccacttccctttggggggatttttttgcccctgtgaaccctctaagcctttttattttgggaaaaccacctttccaaatttttttgtgttcttttgctcccccaccccccaaatttttttttgggccccgggtttttttttatcgcccgccccccttggtgtcccccccaccagcccccctcctttttttattggggccccccccccccccctttggggggaagaaaaaacccacccccccccctttttctccttttaggagaaaaaaanaaagaggtttttttttttttttttttgtaaaacacccccggggggcaaaaaaaaaaatttttgtgtttaacaaaaaccaaaaattcttttttttgggggggggggggggggggggnnccccnnattccctccccctccccctcctctctttcctgtggtagataaaaaaaaaaaaaaaaagagggtggggggccgccaacaaccaccccccccccttttttttaaaaaaaaaaataaaacccccccccgcccggggggggggggggagggggcctccccccccccccacctttttttttcccccccccccccgcccatgtggttttttttgtttttggcccccccccccccccccgcgggagacgagaaaaaaaccccccccttggtgtggggggcggcgttac

SEQ ID NO: 533477 - DNA, 887 bp, Homo sapiens
agcgggagttacgggtcctccgtacgggaggactagctctgtgtctcggacagcggtgagattaatgagtctgatttatccaactcttgtctcgcggatgtcgccagctcaagagcagtaggcaacgaaatgtgtctagggatgcgtgacatggcagttcttgacgagatgaccccgtattcgtattatactgagatccattcgttgtggctacctgcagaaaagtatgcggacatgattgataagtaaggtttctctggataaccttaggtaagagacttatgctcaggataattctcgtgagtggtacgcagggagacgtctcattacattactgtacgaggtaccatgatatcgtatcggttcgccaagattctttagacttcagtgacatgtatttcatgcatctttccagagtgatgggacctaaatggtgtcgtccatatgagaaaccatatattggcagaaaattacgaacgagaatatcatgtcgttgtgccccctttatgaggaatgggattctcgaaaatgggagattatcaggttattgggtgccttccttctagtgaatgtatctgattcccgagagattaggagaggattgtaacccggtacaaaaggagtgtgtatctaggggcgactcaaaatatcaaaaacgtcaagttcgtaggcattccccaggtagggaacttaaaaagtgaaagactcatgtgaaataggacgacattgcatgaacgaattcgttgactgagatgcgtagcataagcaaaacagaaacattgggctgaatatgcgattcaatgcggttacttcccatggactctgcacgctttccaatgataccactttgaatagattgtttaatattaaacaatgaaacgaaattg

SEQ ID NO: 533478 - DNA, 943 bp, Homo sapiens
gagagaactagtccgagttttatttattttttttaaagggcttgttctatttcaatgggctgatctatgtaatcccagaggccagtttgtccagacaaagtgggaggttgaattcctgggtctcgttcctccttggataaagtctggatgatctcctccttctgggccgtggaggcgctcttcagcgggcgcttgcgtgcttcctgaggtctaagaacctgcgggacctcagccgtggtcagccgaggagcttcttgcgggccttgtctgccttcagcttgtggtttgtgttccatgaaaatccgctggtatttgaacactattcccattcaccttcaggtacaggctgtgatacatgtggcgatcgatacttcttagattcagggtatcttctgagcagccggcgcaaaatcctaattctgctcatccagtgtgaccttctctggcatccgggcattggctgtacccttccgcttacctatgcccatggtgcctgcccttccggggggccaggggtgtttacccggaatcaagcccggaaatggaccgtcaaaaggcttgcggcatgatctagcccatctttgatgagcttccggatctgctgacgggagttggcacttgggggaaatacatgggtcatcatgggggtcaaaccagaacccttcttctgtgccccagtgggaggaaccctagaggcagagcgtcttatgaagcctgagcatacttcatggatgggccggaaaagatgagggcagaggtgaaacgcctgtggaaacacaaaaagggggagactgggcataaccttggcacaaaacaagaacaagaaagccccgggacacgggtgtgcccagagaggcagcggggcccccctagagaccatcccattgtagccatatgaagggcccgaaaatcccaatgggcaatacacaacacataagaggca

SEQ ID NO: 533479 - DNA, 949 bp, Homo sapiens
tgtggaatatggttgtaaagtggagtccatattcctgaacgtggctggtgtgaacacgacaccgggacaggcgctcagaacgtggacatctcaagactccagaggaagcgccttgtacacggtgcctgctcaccagtgaccgatgttcatccactgtgactcactaggtagtgcactgagtctctgacaagagtggggtcattccaggccctccagtgtgtgtgatagtcaccatggccatgccagggtatattcttgaagccacacatggctggacggaacccagtagaccaccctaccccagtccacctggactcttggttgacagtcggagacaaggttgtgcgtggttcctgacctgctgctaagagtcacttgaccagatctgcatctgcatgggctgcgcggaggttgcccagacacagttttcttccggcgacagctcttaggtgttcactctcagccagcctcagttggctttgtgaagtgtgaaaagcctacaatgtgataggacagtgctagcgtgttgatgtacctactgtggcccagctgaccagccatggacctggtgatctccacagggactctacatcctctatgtggccacattcctgagccagaggccaggtctaacatggcgcctgagcctttctgcatgcctctggatgagagggagaacctgttacattctttactagccaggaactagagcccaagcaaaaggagatgtcttcctgggagccattgaccagccgcatgatgttcaatgtaccataagtgtgcggaattcagtaaggcactgagcttcgattcagactttgaatgccacaacgtaagcacagggcaaatgtgcaccccccagtgatgtcccggactcaagtgtcgcgggacgcgtgccggggtcacaggacgggacaaggaacatacaacgagagtatactgtggtacc

SEQ ID NO: 533480 - DNA, 664 bp, Homo sapiens
agcggggtgtagctcccggaatgcggacgcggaacgcagcggaggctagtcgtaacagtcagtccgcagtcgccagtcagtactcttatctatgctcgtaagctgtgcgcggtcgttgaccgaaggattggaggcgctgataatgatgacatcatctcggtgcagctgaagaagacctcagaggtggacctgggcaagccgtggtgaagttcagtgcatgcagactgaatcaatgtggcggggaagatcaggcccacgttactggcgcgcggcgcgaggagactcgtcatatctgagccgcagtcctgcattcggatcgtccgttgtgacaagcactagggacgcgctcaagtaagctcctgatgatattatgagctgtattagttctattgaatctgaaatatgccattggctgaaaatcaggatttgcttgatatattatctggaaggatgcttatgatagaaggttaacttatttggaagggtacatgtaagaaatggctcttgacaggcttagagatatgaaaagaggtgtgtgttgtttaatggtgtgatcttagctagcaagagtagacagtaggaacagaacactggatataggatgaaggagtggaaaatcgatgtctaaggatatactagtctgtagtggtggcattaacatatt

SEQ ID NO: 533481 - DNA, 458 bp, Homo sapiens
tgataatggaaaacgttctttatagtaatagggtaaatgaagagagtaaactcaacgaaccaggagttctttaataatttgtattcattaaagatttgggatagattttagtttggaatggaatattcatgtgtcacactgaggatcaggtattgggcagttcccttgacagggtttcctttagcctaataataataataattcacaagagaggtaaggaaaaaattctaggccgggcacggtggcttacacctgtaatcccagcacttggggaggctgaggtgggctaatcatgaggtcaggagctcgagaccagcctggccaacatggtgaaaccccatgtctaataaaaaaacaaaagttaaccaggcatggtggcatgcgcctgtaatcgcagctacttgggaggctgaggcaggagaatggcttgaacctgggaggcgtaggttgtggtgagc

SEQ ID NO: 533482 - DNA, 146 bp, Homo sapiens
ctataaggcagtgtcgggcacactcaaccctactgagcacactccagcggggtaagatggtggcacttggtatattaagtgtatttacctcagtactttaaaaggaaagggaaaatatcagctcaataaagtgaccttggaaaaaa

SEQ ID NO: 533483 - DNA, 226 bp, Homo sapiens
gaggagtatctacaaaccacagagacctcggaacacatatacctattattcggcgcatgagcggccggtcctaggcacagctctaagccctccttattgcgagccgagcgtgggccagccaggcaaccttctagggtacgaccacatctacgacgttatcgtcacagcccatgcatttgtaaataatccgtcttcatagtaatacccatttcataatcggaggctt

SEQ ID NO: 533484 - DNA, 367 bp, Homo sapiens
aaaaaaaaaaaaggggggtttttccccccaccccctggttttttggcagggggctggggggccggattcccggaaattcccccgggggaaaccgggttttaaaatttccctattcccaggaaccccgggttttttttaccccctaataaaattggggccggcgggggcccccccccggggttgggggggaaaactttttggtttttcccctgggaaaaaccggggggggaaggggttttttgggtgggccgggggcggtggggggcccccccctttttttttttggggcccccgcccttgggggggggttttttttcccgggggggccccccctttccccccaaaaaataaaaatttttttggttta

SEQ ID NO: 533485 - DNA, 181 bp, Homo sapiens
accccagagtctcgctcgtctaccagagcgtgcactttgatcctaaaataagcttcatctccgggctgcgccctggagtgcagggggcaggattcgtgcagctgctttggctttctcttcctaaatttcattgtgtgagtttctttccttcccaataggtgatcttaattactttcagaat

SEQ ID NO: 533486 - DNA, 247 bp, Homo sapiens
gtcgactgatgactaagcatataagcctatgggagctattttttttctgaaccaccatatacagtgtaaaacctaaggccctgattctctacttgcggctgcgtaatcctcccttatgtgggtctcactggatgccccagtgctcctgctccttcagctgtgaaacttttcttttctttgcccctccttggactgaagtgtggctattgtttcgcctctgacctttcaaggggagctatagtcgacg

SEQ ID NO: 533487 - DNA, 187 bp, Homo sapiens
ctagtagagagggcaggactatcttcagctcccagttggatggttacagcagcatgtagagacccacatcacgaacttctgctccaacaactaccacaagaacataccaggaaagccgagataatccacagaccctttgaaggagctggattgctgctgtaggctctgtgggacagccaaggaactc

SEQ ID NO: 533488 - DNA, 339 bp, Homo sapiens
agatggagtctcactctgttgctcaggctggagtgcagtggcaccatcttggctcaccacaacctccgcctcccggattcaagccattctcctgcctcagcctcccgagtaactgggattacaggcttgtgccaccgcacccagctaatttttgtaattttagtcgagagaaggtgtcaccatgttagccaggcttgtcttgaactcctgaccttgagatatctgcccacctcagcctctcaaagtgctgggattataggcttgagccaccacggctggatgaatcataaattgtaaacctgaataaaatgctgcaacctccaatgagaggaaaataaa

SEQ ID NO: 533489 - DNA, 109 bp, Homo sapiens
gatctctgcaggagagagaactgtaatacccaatgtacacttccacaacggctaaaataggctcaatgtcactattaaagtgataaagtggaggtccgtggggcgaaaa

SEQ ID NO: 533490 - DNA, 227 bp, Homo sapiens
tggcccgccttgtaggcatcctttataaggaccatttctgttcctagagcttactagaattcattcttcactgaaaaaaaaaaaatttacttaagaaagcttttctttcctaattctcactcaattttgcagaatttatttgtaattagtattacaaattctggccaaaaggagacttgtaattagcgtaaagtgattgttccccgcttgggattccttcttaaagt

SEQ ID NO: 533491 - DNA, 182 bp, Homo sapiens
ctccagtgtcccatgcatctccatgcgatctcccgatctcctccatcttgtcttgatccaggcccgatgccatatgtcctgggctccaccctgcttgcgtacgcctctcattgtgcttgttgtcgtgcatgctcctcctgtccgagccttgtgtcgctccgatgtgcaccactgcttgcctg

SEQ ID NO: 533492 - DNA, 1217 bp, Homo sapiens
gcgtgtgcgctacggtgtgcgtttggcgagcttgtctggccttctacgcgcctgttggggggtgtattcacgtttctggctttggacaatcttttcaagccgtgtcccctcttgcgggtttacccccccctgcccctcgcgcggtgttgttcctccggggtgtttccctccacccccctgcccgggggggtccccccgcggtccccaggaagatattggaaaagggcgccccgcgggatggcccctatgtgccccgggggccacacccgcccccacaacagagttccgcgcgggggttcccccagggcgacccattgggggcccaaaacccccaggacatacgggacacgggggccccccccccgggaagaagaggcttggggccccccccttcgagattccatttttgaggaactttgggggtgccgttttttatgggggccaccgagcccccccagagctgtcccccacggccccccctcttagtgtgggccgccgttcacaatggtgttacttcgctccccggggggccccatacctccggtgtcactccaatccgctgggaccccccaaggcctccaagctccaggcccacagcccccgaaaaggggaaggggaaagggctttaacgccccacgcccctggatccccacaggaggccccccctgggtgacaccaaggggcctcggcgccaacagccctccctctttccccgggcccggaattggggcccccccccggcgtctttctgttggtcttttatagggctttatccgcacttcaatggcgcccgcccttgtccctctttcactctcccccccgcgcccaccccgcccacaaggcccccaaatatgggggagggacccacggggtttctggggaagctctgagagccctcccccccagcccacattggaggtgccccgagagccccctcttttgtttttttccccccacactttccctcttatttaagagaacacccccccaataaccgaactttttccccccccacaaaaaaaaaaaaaaaaaaaaaaaaaggtggcgcaccaccctcgtgagttcccggctatacttcgagaaggctgaggccacagttcgaggagggcttgaggccacggagaattgcttgatcccggggggcggagggtgccgatgagactgagatagcaccccgtgcactcccagcatgggcgaccagaaccggatggtttcca

SEQ ID NO: 533493 - DNA, 3965 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533494 - DNA, 156 bp, Homo sapiens
gaccccggacggttatcgcgaccggcaaccccccgatcgacgggaaagacggggcgatcgaatttgcgtacagcatggaagaagctgcgcgcaagccgatggagctggaggacggtacggtagattataaagaaatcatccggctgaaaaacgtca

SEQ ID NO: 533495 - DNA, 4209 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaagtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533496 - DNA, 4201 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533497 - DNA, 893 bp, Homo sapiens
tcccccccctcttctttcccctttacgctctaatcccccccccctagaggtcattttggcactgttggaacactccttgagctgttgaagatcccgtgatcattacctggggaggggttcctgaaaccttccacatcgggatctgcggactttcatttttctaagagacttactcaatcccatgcatgcactacctcacccaccgtgagaaaggacaggcgcctctccctcacacatcactcataaattttcagcacttcatctttccccacccaccccgaaggacaactatcctacaatacatcccccacccccccccctcgactactccccccacaggacccgtacgttcataccgacgccctccacccatctcaccactacgtccctctcctctctttcccgctcccgccccactaccacctgcgtcatccccgcccactacccgatacgtggacattagtcaccgctgagaagttcacatagcccttcctcctccccgatcttatcaccacacaaaccactatccccactcgctagcttaaccagtcgtttcctcccccctattctcccccacatttactatatctcaacctctcccttccaacccattacttctcctctttctcaacctctcccctttccctctctccgtaagcccccctcacccacatcgatatcctatacgcatacttctttcatcctcctctttacccctccctcaacttcccccacccctctaatcctttattgatactcatcttcaccccttcacactttcttcttttaccacactattgtgctacatctcctttatactctcccccatacatttcctttatccccacactctcccttctgtcccatatcttcctatcaatatctctatttct

SEQ ID NO: 533498 - DNA, 4070 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533499 - DNA, 254 bp, Homo sapiens
cacggatcaagaggtgaattcaaatgggaaactgatcctcttactgtatatatataactggacataaaagagaaaaggtatgagagtctgaaaaggtctggcttccaggttcagccatgaaccttagtgagctgtgtgatgctggcaaggttactctacctttctggatggtactttcttcaattatgataaagtgcggtgtctgatgaggtaaatacagagattatatccagcacaaaattcccgaagtctca

SEQ ID NO: 533500 - DNA, 3231 bp, Homo sapiens
  misc_feature (66)..(66): n is a, c, g, or t
  misc_feature (92)..(92): n is a, c, g, or t
  misc_feature (102)..(102): n is a, c, g, or t
  misc_feature (131)..(131): n is a, c, g, or t
  misc_feature (134)..(134): n is a, c, g, or t
tgtgctgcggtgatctagaggatcccttggggctcattcagggagaagacaagatgagggcctgtngctgaacaagtaaagaaatcaacgtngaaccctaangctaaggagttcaatcctacaaagcctcngcngtctgtgaataaatccaccagtaccccaacttctccggggccccggactcattcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533501 - DNA, 261 bp, Homo sapiens
ggcttcagaatacagtgagaccccatctctacaaaacaaaacaggcaggtgtggtggtacgtgcctgtagtcccagctattcaggaggctgaggcgggaggattgcttcagcctgggcttgcagtgagccatgattgtgccactgccttccagcctgggcgacactgcaagaccttgtctctaaacaaacacacacacacacacacaaagagcttctttatgtcttgctgtggattccgtggcatagcttgtcgttctttt

SEQ ID NO: 533502 - DNA, 4443 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggagggcagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533503 - DNA, 4267 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggagggcctcagggagggccaggccaagcagggtgggggtctgcacggcctggcccacccaacctg

SEQ ID NO: 533504 - DNA, 3180 bp, Homo sapiens
  misc_feature (3146)..(3146): n is a, c, g, or t
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtccctcaaaaatccccagcagcggggttgccncacaaaggcccggtcaaagccgaccgccgcacgg

SEQ ID NO: 533505 - DNA, 2591 bp, Homo sapiens
ctgctccgcccctctctgggggagagtatttcagttatggaagtttgttggaattcagaggcaaacaatgtctatcagcccttggattataatttcacttctgtgatcctcaagagtttctcttttttctttgctttcttgtcctctgttcttttggcactgtgtagccaccttagagaaagaatgttttgtattttcttctttttgactgttttctcatagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533506 - DNA, 689 bp, Homo sapiens
  misc_feature (41)..(41): n is a, c, g, or t
  misc_feature (70)..(70): n is a, c, g, or t
  misc_feature (90)..(90): n is a, c, g, or t
  misc_feature (93)..(93): n is a, c, g, or t
  misc_feature (106)..(106): n is a, c, g, or t
  misc_feature (136)..(136): n is a, c, g, or t
  misc_feature (140)..(140): n is a, c, g, or t
  misc_feature (223)..(223): n is a, c, g, or t
  misc_feature (242)..(242): n is a, c, g, or t
  misc_feature (322)..(322): n is a, c, g, or t
  misc_feature (363)..(363): n is a, c, g, or t
  misc_feature (464)..(464): n is a, c, g, or t
  misc_feature (568)..(568): n is a, c, g, or t
  misc_feature (599)..(599): n is a, c, g, or t
  misc_feature (656)..(656): n is a, c, g, or t
taataaaaagttgattttgagaaggggagatatgatgtttnttgattagagtttgctcagaagccccttntgggagtttttttttaattngtnttattggggttangttattttgggggtgtttggttggaggggntggngtttttagttttatagttgggagaggttgggatagagctggggaggtagttgaggtgttttagtgttagatgagggctggttnattcttttagtttaatttngttttataggtgagatggtatttggttataaatatgaattttgattgagggaggtttgatttgggatttttagggtaggnagaatgattatggtccaggttccacaggatgtggagttttngggcttagtatcatggtatgtggggcccatgttcaagtggagtgaattgtagctgggaaggtttgctcaggtacaggggaatctggtttgtttttgcaggnccaccccatggagtatgtaagggtggtatgttatctcccccccaactccaatagcacgtatgtgtctcaggagcctttggatgcctcctgccatcctgtgtgcnccctgaggccctataactcgtctcgcatctngtcacccttaggccggaccaggcgccccatgaatagcagggagccgctttgggtgtnccgcactaggaagatgaaggggtggtcggcgta

SEQ ID NO: 533507 - DNA, 3534 bp, Homo sapiens
  misc_feature (3159)..(3159): n is a, c, g, or t
  misc_feature (3165)..(3165): n is a, c, g, or t
  misc_feature (3168)..(3168): n is a, c, g, or t
  misc_feature (3171)..(3172): n is a, c, g, or t
  misc_feature (3176)..(3176): n is a, c, g, or t
  misc_feature (3184)..(3184): n is a, c, g, or t
  misc_feature (3188)..(3188): n is a, c, g, or t
  misc_feature (3197)..(3198): n is a, c, g, or t
  misc_feature (3216)..(3216): n is a, c, g, or t
  misc_feature (3219)..(3220): n is a, c, g, or t
  misc_feature (3225)..(3227): n is a, c, g, or t
  misc_feature (3234)..(3234): n is a, c, g, or t
  misc_feature (3240)..(3240): n is a, c, g, or t
  misc_feature (3243)..(3243): n is a, c, g, or t
  misc_feature (3248)..(3248): n is a, c, g, or t
  misc_feature (3253)..(3253): n is a, c, g, or t
  misc_feature (3255)..(3255): n is a, c, g, or t
  misc_feature (3257)..(3257): n is a, c, g, or t
  misc_feature (3265)..(3265): n is a, c, g, or t
  misc_feature (3267)..(3267): n is a, c, g, or t
  misc_feature (3270)..(3270): n is a, c, g, or t
  misc_feature (3272)..(3274): n is a, c, g, or t
  misc_feature (3278)..(3282): n is a, c, g, or t
  misc_feature (3285)..(3286): n is a, c, g, or t
  misc_feature (3296)..(3296): n is a, c, g, or t
  misc_feature (3464)..(3464): n is a, c, g, or t
  misc_feature (3511)..(3511): n is a, c, g, or t
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagttcccccaagccaagccagcatgttgtatgncaatcnaanaannaagnagcatgcnacanaggcattannaaacaatggcacaatgtntannaagannnaaatgtnaaacanatnggaanacaancncnacacaccnanaanannnaatnnnnncannaaaaaaaagnaaaaagggtggatgatgatgaaaaaaaaaaaagaggtaatgggggggaaaaaaaaagggagagggtgaaaaagaggtgggggtgaatgaaatataagattaaaaaaaataaacataaaaataaataggaaaaaaaaaagtatgtagggtgggaagaagaaaaagtagnagaagaaaggggattgataatggatatgtaatttgattaaataagtnatagataagttgtgataaaggag

SEQ ID NO: 533508 - DNA, 471 bp, Homo sapiens
caggatcttctcgaatcgacggtttctcggaagagggggatgtgtcaggatcataagataatagtggagagaaggtcagcagataaacacgtgaacaaaggtctctgtgtcatagacaaggtaaagaactaagtgctgtgctttagatatgcatacacataaacatctcaatgccttacagagcagtattgctgcccccatgtcccacctccagccctaaggcggttttcccctaactcagtagatggaacatacaatcgggttttacaccattgcccagggacgggcaggagacagatgccttcctcttgtttcaacggcaaagaggcgttccttcttctttcactaatccttctcagcacagaccctttacgggtgtcacgctgggggacggtcaggtctttcccttcccacgaggccatatttcagactatcacatggggagaaaccgtcgaattcgaggggtaccga

SEQ ID NO: 533509 - DNA, 1375 bp, Homo sapiens
tggcattggcatagttccttaactagggctcaagggtgtttgagggtccacacttcaagaagaaggattcgggagttgggggaagggaggctcagtgagggaccttctgtggtgagcattctataggcctttacactttccagcacacctccgtgccggtgggccatcgggaaagcagtgcaggccaagaggcctttcccccttctgtggagcccccatcttcgagggaaaagagacattcatagagtttacagaaaacgaggcacaaggtggggaagccagaggcacgcccccctgtgtggcaagctttctttatagtggtgcctcccccagaggggtttggcggcaaataggtggctccagagagacacttgggtggtgtggggcacccacgactttgtgtgtagaaacaaagtgtgcgcctttgtgtgaagtgtctgtggggacgcccacggggtataaccacggtgggtgtgtctcctcactataaaacccatgtgggacaagccctcgggggaaaccacccttttgtggccccaaggggggcccttccccacacaagggggagaacctctctctcgagagcacaaaaagagcgcgtgtgcgggtgggtgtgaccccatataggggggtgtttcacaaaacttttatcacccctctcctatgtggggggacataataagacctctgtggtgtccaagtgtgcaaccactggtgggcaacgacatgtctgtgggcgccccaaggggaagaaggcccacatgcgggtgtggggggagggagacgccgagaatatacaatacaaaggggggagatatttcggtggggcacatacaaacaggaaaggatggcctttacgagggggggccaaaaaacctgtgttggagacgaggtgttctacaagatctagtgatcggaggagcgctgggacaatttacaagtggggaaggggtaataggggggggcgaaaattataaaatataacgcaccgtgctttcgagagggcgagaaatcgcaacgggggtctttatatttaaaaacccccctgttattccgcgcggtgggggatcaacaagtttgtggggtcaacctcggagtggggacccaaccatctcggcgggggatacaccaaatttataccttgttattttggggagagggacccctaaataaggacctcgtgggggcttcccaaacactcggacaaacaggcttctcggaggaagaagaggccctcttttttttccaacaacaaaggtgtaaaaaaggcggcaccactgagaaaggcgggttgttaggaaaaaccacttcccaccgggtgttcgggtgctggcttcgcaggcagagtagagggccaccctattgtgagaatatc

SEQ ID NO: 533510 - DNA, 475 bp, Homo sapiens
  misc_feature (92)..(93): n is a, c, g, or t
  misc_feature (116)..(117): n is a, c, g, or t
  misc_feature (120)..(121): n is a, c, g, or t
ccgtctctatggtcagggtctctcctagaccaagccccacccagcagccgaggcaaaagggttcccaaagtggagaggagtaagagatcccnncccccaaacaggtaggaaagggnnaanntctccttcaaccaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactctgtctcaaaaaaaacaaaaagcaggaggattgggagcctgtcagccccatcctgagaccccgtcctcatttctgtaatgatggatctcgctccccctttcccccaagaacctaataaaggcttgtgaaga

SEQ ID NO: 533511 - DNA, 1181 bp, Homo sapiens
gggcgatggcgacgtgtcgcagcaaatccaggctgctgactgcggtgtgctgtgtgcggcgtgcagcggcggtgactgagtgatagagagccacagcacgaggagctgccatggcctggacagccagtggctgccatgataggaaaactgtgctgagatgtgggcgagaactgtccactgctgtggcctggcgacaagctggttccttgtggacgaatgcactggtataatgcatgtggtgatggcaataccgtgcatgggatgtgtggaccatgtgacatccagacacacgttcccatggcgctgcgatcaagcaagtgcacacacatcgtttcaacgatgaggctaaagctggcagaccatcaagagagggacatgcgtggacaggcgcaggcattactgtgcgtgagatccacagacaggactgactatggacatagacgcttgtgtcaggagttggtagtgagatcgtagaagcacttggagacatgggcagggcagcagtgtgaaagcgacagaagggagtcagtaggaaggcatgcgcccaaaggagtagcaagaaaggggtcagaaaggatgttagccacgagggtaagaaccatgaatagaagaaagaaaacccaggggaccagcaagaacccgactaattaggctcgacaaaaaatccattccaagagaatcggttacaaggataaccaagaccgcaaataaccccatgaatttccgttatgttggggcaccatacgattattataggcgcccaaccgaagcgtaagtggggaaaggcagggggtaaccaatgaggtgaggaagggcacaccagagggacacgaaaccacgatcagagacaataatagggagaaacaaaaggaaaaaacctccgaggaaaacgggggcatccttatgggaaaatacaggcataagataattggaacaaaagtaaagaagaggattaaaacggggaacatagcttgcaaaaaattggcgaggggacaccaatagatgtaaggaaaagttggtgagaaacaagaggttgatgaaatacgaaattcgcaaattgggggaaggaaagacggggaaaaagagagaaaagagacaacatggggaacaagcatgatgggagagaccaaagacggtgaaaaaaaagtaggatgaaacgttgtagtagaaaagaaaaaaaa

SEQ ID NO: 533512 - DNA, 462 bp, Homo sapiens
ctggattgtgtcttagaggcataggagcctgaagggctgcgagctgggaaggggcaggccggcgctgggtgtaggggacagaggggagaggaggaagcgggccgcaatagaaagacgtggacggggctggacgtggtggctgacgcctgtaatcccagcactttgggaggccgagacaggcggatcacttgaggtcaggagttcgagaccagtctggccaacatggagaaaccccgtctctactaaaaatacaaaattagccaggcgtggtggtgcatgcctgtaatcccagctactcgggaggccaaggcaggagaatcgcttggacttgggaggtggaggttgcagtgagccaagatggcaccattgtactccaggctgagcaggctagcaagactcactctccaaaaaaaagaaaaaaagatttttttttaataagccaggcatggtgacacatgtctg

SEQ ID NO: 533513 - DNA, 460 bp, Homo sapiens
ccccaccgccgttcccgcaggagggaatgggtgggaagaaacaagcccaaagcttcctttgtcgggacccctccccaacagtcttcggcttaggaaaggaagggcccgaaaagggggaagaagaaaaattggctggttggcctggctcttaagtggcttgaggggagggtttggataatttcttaagaatggaaccattttttcccttccgtaatggaagaatggggcttcaaaaagaaggttaatcaaggtaaattttcaagaaacctggaaagccacctggaaaaatttcccccttgggttttttttcaagtgggtaaggtttctttttttaagcccctttggaccaccttttctaagaatgggggaaccaagaagtttttcttggagctggaaaaggaaataaaatggccaaaggtggaataaccgggtaattggcccttcaaaagccccaatttcc

SEQ ID NO: 533514 - DNA, 154 bp, Homo sapiens
gtgctgtatgggggttgcgtaggtcccaaaggaacacgcagttcccaccacctcctaggtcgcaggagctgttgcgcttcaggcagaaggatactagtatggttgtgtaacattaatggccatggcacatacttggtgtcaatcctgatactca

SEQ ID NO: 533515 - DNA, 201 bp, Homo sapiens
ctttgtttgggcatattgtgtgtttgttgggcaattttgtttttcagcccaggtccagtcattgcatgcagagctgcatccatcttggcacatattttattccgttcccagcacagcagcttgccatccaaccacaagtcacattgtcatttcatcgtcatcgtacacatcagcatttacacagcgttccattcatcaaca

SEQ ID NO: 533516 - DNA, 160 bp, Homo sapiens
ttctagactcgccagtgggtgtgactgtggcccatgctgatattgcgtgatgttatctactcagtgagggtggggagtctgttgaattgatcagatgacgcagactgcctccgtatgtcccgtgtgctccagcgtcatcgatgaataagcagtgtacctg

SEQ ID NO: 533517 - DNA, 177 bp, Homo sapiens
atgctccctcttcacagtctcaactagaaacttctcaacaccacgtggggagctcatgacccgctcccgcacagtgtagatccccctagctctactatcccttccctattccatactggcttgaaccaggggcccaatctctgaaaccatttcccatcttggacgcttgccttattc

SEQ ID NO: 533518 - DNA, 393 bp, Homo sapiens
  misc_feature (295)..(295): n is a, c, g, or t
  misc_feature (305)..(305): n is a, c, g, or t
ctccatcttacttggagcccagtgggcaaatcaaatatggttaccttgtaggagggccttccttactggattgggagataagctgtgaagcttgatgtttaatgcagtaacttgcaaacttgatttacttgaaattgcatacaaatttcctgagcatctaaaaactagccttattactgagctttgcctttcctgctgggagtagtggcaaaattagcactcatggctgtagaaagatcactgagtgaagctctgactcctcctttgccaacacacagcagagcaagaaatacancttgcctgtnttcatctaggtggcaactttgagggtcttgaatgggactgaggttgccttggtggtgacatcagcagagaagtcatagtgaagtcatt

SEQ ID NO: 533519 - DNA, 554 bp, Homo sapiens
  misc_feature (6)..(6): n is a, c, g, or t
  misc_feature (185)..(185): n is a, c, g, or t
  misc_feature (313)..(313): n is a, c, g, or t
  misc_feature (340)..(340): n is a, c, g, or t
  misc_feature (373)..(373): n is a, c, g, or t
accctnaaaacaaagtgcccgcgggcatgatcttacctacaatgaatggggagtcagtagacccagtggggcagtcagcactgaaaactgaggagcgcaaggctaagcctgctccttcaaaaacccaggccagacctgtttttgtcaaaatccccacttgtaagatctttgtgggggaaaccttnctgacgtcaccagaggagctctattgagtgtttaccacccaagagctggtgcaggcctttacccatgctcctgctacattagaagcagacagaggtggaaagttccacatggtagatggtaacgtgtntggggaatttactgatctggtccctgngaaacatattgtgatgaagtggaggtttaaatnttggtcagagggacactttgtcaccatgaccttgtccttttattgcaagaacggtgagactgagctgtgcatggaaggtcgtggtattcttgtttctgaggaagagcggtctcgacaggggtggtagcggttctactttgtgggtcttaagcagagctttggttgtgggttacgtttattt

SEQ ID NO: 533520 - DNA, 212 bp, Homo sapiens
  misc_feature (4)..(4): n is a, c, g, or t
  misc_feature (7)..(7): n is a, c, g, or t
  misc_feature (15)..(15): n is a, c, g, or t
  misc_feature (19)..(19): n is a, c, g, or t
  misc_feature (38)..(38): n is a, c, g, or t
  misc_feature (54)..(54): n is a, c, g, or t
  misc_feature (60)..(60): n is a, c, g, or t
  misc_feature (85)..(85): n is a, c, g, or t
  misc_feature (89)..(89): n is a, c, g, or t
  misc_feature (101)..(101): n is a, c, g, or t
  misc_feature (104)..(104): n is a, c, g, or t
  misc_feature (132)..(132): n is a, c, g, or t
  misc_feature (146)..(147): n is a, c, g, or t
  misc_feature (149)..(150): n is a, c, g, or t
  misc_feature (155)..(155): n is a, c, g, or t
  misc_feature (157)..(157): n is a, c, g, or t
  misc_feature (167)..(167): n is a, c, g, or t
  misc_feature (183)..(183): n is a, c, g, or t
ccgnggntacgcccncagnacactccacatctgtgccncatacagggactcccnaataancacgagcaaaacagacagccctgtntatntataggcctttncangaagagactagcaggagcagtaataaanacaggaaacccagnncnncattntnagggcttccnaaaaaacaggcttctnagagtcgtatcttttttctttttttatcc

SEQ ID NO: 533521 - DNA, 375 bp, Homo sapiens
catccggagttatgtgaacggaacttccgcatgtcctgggccagccaacacataagaaagtaagagaaatcatacctccaatccaaagtggggaaatcttcctgttgatcaagattatatctggaacaacaaataatgagggcaagaggggaggacataggcttattaagtagcgtaaatactctagatgagtataagaataggcttttcaggagttctgtcatggcttactagtaactaagctcaactagtatccaaggggacatgggttcaatccctggccccactcagtgggttaaggatccggtgttgccatgagctgtgactcggatctggcattgctgcagctatggcgttcacttaatgccgctagcg

SEQ ID NO: 533522 - DNA, 690 bp, Homo sapiens
gcagtgtttccttatttagtgtttggtgaggtgatttttgtctgagatggtcttgatgcctgtggatgttcaccaatgtttgggcattgaagatttacatatttattctaatcttcacagtctgggctgatgtgtacccatctttcttgagaaagctttccaagaattcaaagggaattgagtgttatgaaataagtttttggtcactgcagccatatgtgcattagggaacactccaagcccagtaacactgttactttgcagatttgtagaagtaccagccttggcaatcttgggtaatatctggaagaatagtctggattgccagagaggagtctcttgttttttccccctactttctcacaaacgaatgaagtctcactctccatgctaagctccctggagtttgtggagggatgacaaaagcactcctgtggccaccacctctaggattgtgctgggtcacacccaagggtagcacaatactaggccttgcccaagcctgtggtggctgctgcctggctactgctgatgcttattcaaggaccaagggctctttagtcagcatgtggtgaattctgaaaggacatggaccttctcttcaggcagtggcttctcttcttgcccaagcaggtctagtgtcatcttggaactggtattggggtttcggactctgcttatgcttatttt

SEQ ID NO: 533523 - DNA, 361 bp, Homo sapiens
tatggtggcaggtgcttgtaatcccagctactcgggaggctgaggcagaagaatcgcttgaacctggaaggtggaggttgcagtgagccgagattacaccactgcactccagcctggtgacaaagcgagactctgtctcaaaaggaaaaagaagaaaaaagaaaaagtgtccgttcatgtcctttgtaagactccactctctagtaaccgtgttcctgcccttctcaattcctaaggtaatcgccttaactcagatccctgagaaatccccacagcaggcagagatttggtctcctgacagtagctttgggattccattaagcaaatatgattgggggccagccccttctttctctttctt

SEQ ID NO: 533524 - DNA, 553 bp, Homo sapiens
agcgcgcaataaccctcattaaagggaacaaaagctggagctccaccgcggtgccggccgctctagaactagtgaatcccccgggctgcaggaattcgattcccttccccacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgtgggggaaggggggatcctctatcagccc

SEQ ID NO: 533525 - DNA, 172 bp, Homo sapiens
ctatccacccataaggcacctggggcttttcagcccccccgtggtgtaacaaatggaggaggaggagggggtgagaacccctttcctccagccctgtgccccactccttttatgtgtgtacagtgtccccaggcatcccccctttttcattaaaaacccagtttcctggtca

SEQ ID NO: 533526 - DNA, 657 bp, Homo sapiens
ggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcacctgccaaccatcgtcggaccggcccgatc

SEQ ID NO: 533527 - DNA, 751 bp, Homo sapiens
  misc_feature (216)..(216): n is a, c, g, or t
agctcggtaccgtgcttcaactccactctgtgaatggagagcttctggggctggttccaagtgggagatttcttcacaaggcacataccttagctgaattcagagatgttaaggacacatctcgctgacgcttctcacatcctagacaatgaaagtttaggtcgcaagcctgggacacaagtatacatgcagctaacagccggggcctctggtggnccggtgggaggggcaccgctcagccacgccctgctgtccgtctccccagaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctaggagcgtaatcggtacgagctcgatcga

SEQ ID NO: 533528 - DNA, 112 bp, Homo sapiens
cggcacgaggccaccacccctggatccgccgccccttctttcctttccactcccccagccgcctctttgaccagttcttcggagaggcggctgggggagtggaaaaaaaaaa

SEQ ID NO: 533529 - DNA, 441 bp, Homo sapiens
gactctacaggatccggcacgtggtgtgatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaaccaacgagcccgctacgagccaccccacgag

SEQ ID NO: 533530 - DNA, 3186 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccagccccggccccctctctccctcccttctctctaattccccttccggacgctgccatcatgttgaagcctcagccgctacaacagccctcccagccccagcagccgccccccacgcaacaggccgtgg

SEQ ID NO: 533531 - DNA, 465 bp, Homo sapiens
cccgagtttagacgggtgctgcactccactgacagtagttagacatcaaggaagaaaattaacaaacatattcaggacctgaactcaacattggaccaaatggatctaatagacctctacagaactctccaccctaacccaagagaatatacattcttctcactgccacatggcaaatactctaaaattgaccacataattggacataaaacaatcctcagcaaatgcggaagaaccaaaataatatgaaacatactctaggactatagcgcaataaaaatataagtcaagattttaaaaattgctcaaaaccatgcaattacatagaaattaaacaacctgctcctgaatgacttttgggtaaatcatgaaattaaggcagaaatcaagaagttccttgaaactaatgagaacagagatacaacttgctaaaatttctggaacacacaaaacagcattaacagg

SEQ ID NO: 533532 - DNA, 6278 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 533533 - DNA, 512 bp, Homo sapiens
  misc_feature (211)..(211): n is a, c, g, or t
  misc_feature (218)..(218): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (339)..(339): n is a, c, g, or t
  misc_feature (355)..(357): n is a, c, g, or t
  misc_feature (385)..(385): n is a, c, g, or t
  misc_feature (396)..(396): n is a, c, g, or t
  misc_feature (399)..(399): n is a, c, g, or t
  misc_feature (416)..(416): n is a, c, g, or t
  misc_feature (431)..(431): n is a, c, g, or t
  misc_feature (450)..(450): n is a, c, g, or t
  misc_feature (474)..(474): n is a, c, g, or t
gcctttgagatgtgattggatcgtaagctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtntagtgtntagtggatccaggccacaggagagagtgccttgtggagcgctgggagcaggactgnccnccnccaggaccccagaactgtggatcatggcagctgcagcgccccctgggaaagtttaggcnccagctgcaacccctnnnagcagccacgtagctgcacccagcgccncaggcacgggntanctgagcttgggggcccnatccctgctccatgngtcctgagcagcacacgantcgagatatctcttcccacaatantttctctcccagacctttcagcatcgcttcattccctc

SEQ ID NO: 533534 - DNA, 172 bp, Homo sapiens
tatggtcacgacaagtgaaggggagtatatctctgcaacgaactgaatgcccgacccttagacgtttcatgtgtagtgtgctccaacgacaaggttacggaggacggcttccgctggaatggcacacgtacacttgattacacacaagactcacacttggtatccagagtct

SEQ ID NO: 533535 - DNA, 6549 bp, Homo sapiens
  misc_feature (707)..(707): n is a, c, g, or t
ggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 533536 - DNA, 3369 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533537 - DNA, 600 bp, Homo sapiens
  misc_feature (211)..(211): n is a, c, g, or t
  misc_feature (218)..(218): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (339)..(339): n is a, c, g, or t
  misc_feature (355)..(357): n is a, c, g, or t
  misc_feature (385)..(385): n is a, c, g, or t
  misc_feature (396)..(396): n is a, c, g, or t
  misc_feature (399)..(399): n is a, c, g, or t
  misc_feature (416)..(416): n is a, c, g, or t
  misc_feature (431)..(431): n is a, c, g, or t
gcctttgagatgtgattggatcgtaagctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtntagtgtntagtggatccaggccacaggagagagtgccttgtggagcgctgggagcaggactgnccnccnccaggaccccagaactgtggatcatggcagctgcagcgccccctgggaaagtttaggcnccagctgcaacccctnnnagcagccacgtagctgcacccagcgccncaggcacgggntanctgagcttgggggcccnatccctgctccatgngtcctgagcagcccccgaagtcaaaaaagattatttttttcccccagataccttttttttcccatgaccctttaacagcatttggttcattcccctccccttcccagggtgatttgaggtaaactttgaagtaaaataaaagctgggtttgagcatcatttgtatttca

SEQ ID NO: 533538 - DNA, 6063 bp, Homo sapiens
  misc_feature (216)..(216): n is a, c, g, or t
agctcggtaccgtgcttcaactccactctgtgaatggagagcttctggggctggttccaagtgggagatttcttcacaaggcacataccttagctgaattcagagatgttaaggacacatctcgctgacgcttctcacatcctagacaatgaaagtttaggtcgcaagcctgggacacaagtatacatgcagctaacagccggggcctctggtggnccggtgggaggggcaccgctcagccacgccctgctgtccgtctccccagaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 533539 - DNA, 2036 bp, Homo sapiens
gatacacgggactcattgaaagagatctttgggacagggtctcaagccactccctccctcttctaggattttctcgcatccaattgtcctccctggttgggcagaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533540 - DNA, 1751 bp, Homo sapiens
tggaaaaacccccgaggggcccttttttttttaggtgggcccttataaaaaccccagagggggaaaagcccttatagagggggaaacacggggggagggggaattgaggggagggggggagagggtaaagagagggggaaaagaggaaaaccccgaaaacaaaagcccccctcaacaccccactttcgggggacccaggaagaagacaatagtgaggccctctcgggtgtatcacccacaagaggaggtcttcgcgcggggtccgcggggggtgttcacagagagcagagaggacacaaagaacacacctcgagggagagagagggccggcggcccctctctaaagaagagagggccgcccatatgggagagggagaacgcaccacagagagagacacagagtgtgttcgcgcggtggccccacaagagagagagggagaggggggcgctctccctctctccaccctcccccgcgagaggcccagaaaataaaatccaagcgcgcggagaggcgcgagagggagtgagggggtgacacccactcatctcccgagaagaggcgcaatatacacgaggagagagagagctcactcacacgcgcggctgctctctctatagagagaagatgtgctcctaccacgagagggcggggggagcagcactattgtaactctcacaacgggggggagagaggagagacacgccgcgaaaaactaattgagcgggcgcgggggggagaacccaacaaaagaaatcatctgtgtgggaaaaaaaagagggggttctccacgagaggaaacgacagctgcggtgatgagtaaaacagacaacactgatgtgtgacgcacacacccggcagagagtagactcaacataaaaaaacaatgcagacgaggggggggaggagaaaaaacaacacactctactactcaacagttgaggagagcaccgacgcccccaacagaggaaaggagggcggaagagtagacacacacaagagaggaagcgaagggccagaggattatgttgggagggcacccaaaaagaagatgagcccagtatcaagcagaaaccaacaacacacgcagtcagactcaagagtagtaggagacaaagaaactattcacaacagaagagagagggaagccatccactcaacactcaccatgcaagaggaagaatcaccaccctaaggagggagagagggaggagagaggcgcccctccacaaaaacaatccatcccaagaaaaaagggggcggccgggggaggcgaaagaaataagagacgatcctccctcctcaggaggaagaagagggaggagaccacgcttcacccgaggagggagagcaaactaaatagatgtcgtcgggccggccgaccatggttagagagggggtggagtactaacttaaagtacgacaagagcggagagggaggtgtagtagtccccccgtgaaaagagcacgcgagtattagcaatccgcaagaaaagtagtttcgagaataggaggaagaaaatctccccgaaggggggggagaaaaaagtatgctcccaccccagagggggcgcacggagaagaaggagcgcaatccagtagtggcacccagagggggagcaccaacatggcgagggagagaagacggggcgggcagccagaacaaatgcgaggtgggcacaccaatgatggaagcgacgaggagaggagcccaccaggcatcctactgatgagctaacaggagagagcagac

SEQ ID NO: 533541 - DNA, 353 bp, Homo sapiens
cccagctcattcttctgctgaaaagaggcaggagaacagtgagaacagggtggtggtccccaagggaagaatgatcaatggagacagtttcatgatgccattcatgaaattcatcagaatttcatgatgccccattgggtgactatcagggttttaagttattcttgagagtttctcgaacgcttttctgtctttgttttctaaaagactttgatgatggcagtgggagctcagattcatgttggagttaccattctggtttgccaaggtagtggaggaatgtggaaagacgtcgctgcactttagtcctgtacttctgacctgtactcaaaggcctttcccttcctaccctg

SEQ ID NO: 533542 - DNA, 3480 bp, Homo sapiens
gaccattgtgaggacaatgttaatttaaaataataacaataatagcaagaagaagtccggccccatgacaagaaaatctgctcccacctcagggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 533543 - DNA, 2607 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtacctgagaacagcctggatccttttcctccccggatcaattaaaggagagcccaaagggatc

SEQ ID NO: 533544 - DNA, 347 bp, Homo sapiens
accctggcggacttttgattgttcgcgtgatactcaagaccatggactgtaccgcttttatcatcacaacaacttgatacgctactggactgcttattagagtcacatagatttgcccatagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacat

SEQ ID NO: 533545 - DNA, 7809 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggtgatcccgataaacctgatcctgtgcacggggctttctgccttctcagtgtgtttccctccgtgttaggcctactccagccttgccccgggtgtttgctgtgagcccacagtttctgcggcctcccttacagagagcaagcaagacagcaaatcagcaagttttcttgtagagtaaaagcagattgacatcttgtgggtttgattcttaggaatgatgttgatgcatggccatgcctgctgaagcgggaagtccatggaaccgatttgttcctgctctccgcatgcgggtactgataggtagacctgtgtgtctccatggcctccaggaactgcctgcacaccgtgcgcccaagtgtcagctgttagagagttggccccccgcatgtggcttgggcagtgaaggggctcggctctcttaccaggtggtgagatgccagaaacccagcccacagacatccctctcctgcttttcatttcccaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaatgaattttattttacttgtcacacctgtcttaataaactggagttttgctgctaaagaactcttctctctgggggcagagcttctatttatggcacatagacatcagctaggcttttgggaatcgtttgtgttctttgtggaaatgtcctttagaagcacccatgaagtagtgtgttcagactgtgcacacagaaaacaggctctgccttcacatgtgagacggtggacttttcctctggacaaaatgacagcatcctggcgactccacagtggagctgagcgccactccctgtagccgatctgggactgaaacgcttacacctctgcctcagaaggagtcccccatgccctgcctgaaatgacttcactggacacagcggggctgcagctaacggggtacaggtaggagctaactaacttcacccctgagtccacttgcggggtaagagataaacagtaacccttccaggagcccactgacgttggagtgctaaaaatgccccttcagggggaaaactgcattttctcttccaaaaaggaaaggttcttccaggcgagaaacctgtggtctagaaccacagcaagaagaggaggcatgctggcctgcaccggaagactcactttgtctgccctgcgccagcctcacctcaccctgcagttcccgtttccgccatggatgcctcatcaccaaccctgaccttccccctcccaaccctttattcatcctcactcccactcatacccgcctccctggacagttccctgctgcagagttctttctgctttcagccctaccttggtggtgatttacctgaaaatcttcacaactgatcattatctccttctctttgagacctgactgaaaaaattaggtgtgcacacctgtaatcccagctacctgggaggctgaggtatgaggattgcttgagcctgggagtttgaggctgcagtgagctatgattgcaccactgcactccaacctgggtgacagagtgagaccctgtctcaaaaaaaaataaaataacataaggacctt

SEQ ID NO: 533546 - DNA, 2377 bp, Homo sapiens
  misc_feature (222)..(222): n is a, c, g, or t
  misc_feature (258)..(258): n is a, c, g, or t
tcggagcaagctggggaacaacagagggctggcgcaccatctcggtgatccggttcctcaacaagcaagatctggctcgcggagaaagtcctggctggggaaatcgaagattggaggactactttccgagaatttggctcgctacactaactccgtgaggatgctactcccggagcccgggaaaggacccagcgcgtgacccggggccaatgtacttcattncgagaggagtttctggaggatcagcacggccagtgngagatgggcgtcactactggctaccctcatttcacctgcgcgggggacacggagaacatccgccgggtgtccaacgacggccgtgacatcattcagcgcatgcaccttcgtcagtacgagcggctcagacgtctgagcagcggggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 533547 - DNA, 3130 bp, Homo sapiens
agtgatctaaggatccgatcacgtgcattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 533548 - DNA, 1906 bp, Homo sapiens
  misc_feature (1865)..(1865): n is a, c, g, or t
  misc_feature (1868)..(1868): n is a, c, g, or t
  misc_feature (1873)..(1873): n is a, c, g, or t
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagtacccttctgcagagcagcctaccccccaagccctttatgccactgttcaccagtcctacccacacatgccacacagtccatgccaccagcgcgagcgggtacacgctatggaagcagcggagtccagcatgggccccagtctgtcagctcaggggggaggcccacttgggnggnagccnggatttggtgccccggcctaagggccggctttg

SEQ ID NO: 533549 - DNA, 1672 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggtgagttatgaggtgactttgaggaagagggcagggaaggggatgccaaggaggtgggagggtaattggaggggtttgggtgtgttggaatgacgctgcatcggtgggaatgtaataggtcgtctgcctcctgacattttcttctca

SEQ ID NO: 533550 - DNA, 268 bp, Homo sapiens
  misc_feature (129)..(129): n is a, c, g, or t
tggccggcgcacagcttctcaagtagctgggattataggcaagtgccagcacacctggttaattttttcatttttttgtagagatagggtctcactctattgcccaggctggtctccgaactccctggngctgaagtgatccacctgccttggcctccgaaggtgccgggaacacaggcatgagccaccgtgctgggcccaataatttttttttttttttttggggcatagagtcgtgggcccgggtcactcccgagggcggggaggt

SEQ ID NO: 533551 - DNA, 947 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtggtaagttggtacttaacccccgggttgtttaaggaacgtaatgcatctactttctggagacactcttcttatttttcccactctgccagggctccacttgtgatgtaaaggtgaaaaatggtaccacttatgagggtatcttcaagacgctaagctcaaaggtcagtgtactcaaatttaattatttttggagttgcagaggaggaggagaatgaaatagccattgaaggtgtcaattt

SEQ ID NO: 533552 - DNA, 249 bp, Homo sapiens
  misc_feature (20)..(20): n is a, c, g, or t
  misc_feature (106)..(107): n is a, c, g, or t
  misc_feature (119)..(119): n is a, c, g, or t
  misc_feature (121)..(121): n is a, c, g, or t
  misc_feature (129)..(129): n is a, c, g, or t
  misc_feature (133)..(133): n is a, c, g, or t
  misc_feature (168)..(168): n is a, c, g, or t
  misc_feature (223)..(223): n is a, c, g, or t
  misc_feature (228)..(228): n is a, c, g, or t
  misc_feature (237)..(238): n is a, c, g, or t
  misc_feature (245)..(245): n is a, c, g, or t
  misc_feature (247)..(247): n is a, c, g, or t
gtaaattttttgttgttttnctaacgggtcccttttggactctgcagccagccacaggaactttttcttcccttctgttacagagaaggtagctagtatagatgcnncacctactgggngntcttccanagcncagggtaatctgctgctcagttcctcttgcaaatnttcaacaagacggtaaattattttgtgaagtttaatttttactcctttttttgcngctgnatgttggtnnaacttgncncg

SEQ ID NO: 533553 - DNA, 154 bp, Homo sapiens
cgtgctcagccatctcaagccgcgtctgcaccccgacgatttaccgctgctcaagcgtgcgctggtgtaacacctgaaaggccgcagcgaggattacctggtggagtaccgggtgcgccatggcgattgtgctattgaaacttctaaaactagg

SEQ ID NO: 533554 - DNA, 161 bp, Homo sapiens
cggtaaaactaagccctcgttattgccaattgtcacgccatcataatgcacctggttcattagcgcaacattttcctgatccatcgtggcatcagtgagcggatgtaggcgatcgatggcatcgcaataatcaaacggataatgcgtcgttggggctgctt

SEQ ID NO: 533555 - DNA, 1218 bp, Homo sapiens
  misc_feature (746)..(746): n is a, c, g, or t
tctcgcgtttcaggttggtggtgtgttgtgcgccgcactttcgcggtgggtcactcatcgtcttctccgaccactaatgtaacgtgggcgtacccccacgcctgttgttccccccccccgtaggtgtgcctcaccggggttttaccagcagttggtggccccccccacattattttttcggggggacccccacggcagtggtaccacacggtggtacttccccgggggggacccctcccccggtccccctcctcccctctttcacaagggaggccttttgacacctctttttcaaagaagacattctgggggaacaaacaagaagatggtctgtgcgacacaccagtctttgggagggaatcccgtgtgtccccacagaaccaaggccaagattcttgccttcccttggagagaaaggatcccctggcctgggggaaaattcgaaagggactttggagggaacttacttttcccgagaattttcgcctcccgtcaccctactccctgagggatgcctactctcccgggccccggtaaggggggacccccccgcgtgtgaacccggggccccagatactttcacttcgcgagatggaaattttctcgaggattcacggccctcgccccgtggaagatttgggccgttcaactaactgggttacccctccacttgtcacccttgcgcctcgtgggagaccctcgaggagaacactctccgcccgctgtggttttccagacgagctgcnccgtggagcactccactttcacgcgcaatgccacccttctgtccagtaccgagacctgctcttatagaagggagaccccccaaaatttatatttaacgcccttatagccaccaattaattataaaatgtaaacagtaattggtaccagaccaggttatatccccccccatagggcatgagtttaccaagccacctttccccttcccccgagtgagttttgcggagaaccccccttttccccttcagcttgcgttagaatgttcccaaatttatgaaagcttaaaggcggcctaccagaaaaaggaaaaaaggcccaccaaaagttccctctcactttccagtaaaaataaattaaaccagccagccagccaacaccaaattaaatgtaaattaaagaaaccaaatgtaaattaatattttgttgtgcagccatttaaaaaaatccaaaattaaaattaaatgtgagccaaga

SEQ ID NO: 533556 - DNA, 692 bp, Homo sapiens
ggtatggtccacgtgagctgatctcctctctggagcaccggggcagcaggagggagccaagacaatgcaaattccagtgaacattcccgtgcctgtgctccggctgccccggggccctgatggcttcagccgtggtttgcccctgatggacgcagagcccccttgaggccagaggttcctgaaatccaggagtgtcctgactatgctcaagaatccctggaatcccaggagtcagcgggcacgagccggccacttcgggagcgttgacctccgcaggcctgcgtgggccaatggatgggtcatgcaggtgagacttcacgttgcaatcgagggtgtgcgtgtgtgtcgcccacttgtggagccaccgacctgggatgtggacaactttctacgtgtcacagatgcagcattcccaataggtgtgcaaagccagaggcgctgactccgaggtgtagtatgacattattgttcactatacacttcaagccgagttagaagactactggtgttcacattgtgtctgctgtgagggctacagtgacctgtatcccaggggaacgtcgcccaatggttcccacgagctcagggaacctcgtggggcccgccagtgggaggtttaatgacgcgtcccttggacagtttttggagtcccaacgcctttaaccggcaacgctctggaagattccgtgaga

SEQ ID NO: 533557 - DNA, 204 bp, Homo sapiens
ttactagggagtacttcccctaccctaacggcaagccaagctcaaatgtatctccgagctcaaatgctgattctcacacccgctaccactgtggctgctgtacagtctgacattcctgttgtctcatcctaatcttcatcttcctgtcagtctgcagctactcatatcaacctctacactgctcctacacctgcagtcgacgcg

SEQ ID NO: 533558 - DNA, 229 bp, Homo sapiens
agactccgatctccaacccctgaccgtctcggtacccacacttccacatgctgactgtccttgtctatgcccaaaagaaatgaaaactagtactcaagcaaatacacacacaaatgttcacatggcactattcacaatagccaaaaggtagaaggagcccaaaagtacatcaacagatgaatagattaacaaaaatgagccgggcacagtggctcactcttgtaatccc

SEQ ID NO: 533559 - DNA, 709 bp, Homo sapiens
  misc_feature (478)..(478): n is a, c, g, or t
tgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacataatttggaagattctgaataattacttacttattctcaaagaaaatctttgaaagaatcatgaggtcaagtcaagaacatgaaaatttatattttagtacagtataaagaacatttgactctggtaattttatctgcattttctcctgacttttttttccctctatataattttaaataaatcagcctccctaactttcacttgtctcttcttttaaacatgaatacttaaccacgtaattaatatccgaagtcccttccaactctaaaaagctatcattctagattagaacttatatcaataaagatatgaccaatcagatttantcatccaaacatacctgtttaacttctattatagacttatctccatataatatgatatataccttcccaataactctttttttgtttcctttcagaacattttgcacataacgaaatcacatcatagagatgttaccacctaaccctttcttatcccttgcctttctttacccccaccttttactctttcatatcccatttatatcatataccatttacatataaaataaa

SEQ ID NO: 533560 - DNA, 116 bp, Homo sapiens
atcgatgaaggtctgtttttgtccccgattgtaatgcaaaatccttgctccagtaaataaaaaagaatatagaattctttttttttttaaagaaggaatcactttcctatacatct

SEQ ID NO: 533561 - DNA, 442 bp, Homo sapiens
atgcttaaggctcatggtgctccatatctctctgatgtgtttatcatccaaatctctactgtggattgaagcccatggacagagtgtggctcagggctgagagccaaggcacctgaccctcagattcctggattgaagagcccaggcacctgatcctcagattcctgggttcatgtctggatcttctctttccttgatatgggatgttgggcaaaattcttgaagttttgatattcaattctccctagcttcaatttttaaaatatttttttcatattatatctttgatcattatgtcctatgctcactccctatctccagaagagggtaaaagaggtttaatttgtaaaaggattagcaactgtatttaactggtaattatcaactgtgttgagttgtaaccccaggcacagtgtctataataaagtaagattattaaaat

SEQ ID NO: 533562 - DNA, 674 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaaggtaccacagcctccaggcccccctcccgccaagacctgcctggagctgccacccacactcttcctacctcaccttcccctgcatcttcctcctctgggaccccatgttggcactgggagtgagacactcacaatggagggagctgttgacacccccagctgtttcactggatggcagattctgagagcagagactgtgtctctcattcctcctagctctcaggtgcctgcatggagaagttgcttaataaaaatctgttgagttga

SEQ ID NO: 533563 - DNA, 451 bp, Homo sapiens
cctcacctgtgcgagtgggggcagtgcctgcagactagtgctccaggagactgggggcaactgtactgaatcccaacagaaattgtgacaatttaattctcggccgggtgcaggggctcacacctgtaatcccagcactttgggaggttgaggcgggcagatcacctgaggtcaggagttcgagaccaacctggccaacatggtgaaaccccatctctactaaaaaaaaaaatacaaaaattagctggccgcgatggcaggcacctgtaatctcagctactcaggaggctgaggctggagaatcacttgaacctgggaggcagaggttgcagtgagctgagatcgtgccactgcactccagcctgggcaacagaataagactctgtctcaactacaataaaataatttctataatttaggaggaaaatggagtagagtatttttatttttt

SEQ ID NO: 533564 - DNA, 114 bp, Homo sapiens
  misc_feature (37)..(37): n is a, c, g, or t
ggccaatgatcccccctctgatgccatgcctcccgangcccttccagaatgacggacccgccgtcgcagcaccggtaggtcgctcgcccacagccttcaaccctgatgtagagt

SEQ ID NO: 533565 - DNA, 176 bp, Homo sapiens
atcgagtcttaccagttctggtccccactcccggctgtcaccatattgatgccgaacttagtgcggacaccagatcggcatagcgcactacagcccagaacgcctggactcaagcgatcctccagcctcagctcccgagtagctgggactacaggcacgcgccaacgcgccgggct

SEQ ID NO: 533566 - DNA, 447 bp, Homo sapiens
ggctcggtactggggtaccctatcttacaccttatacaaaaattactcaagatggattaaagatttaaacatagacctaaaaccataaaaaccctagaagaaaacctaggcaataccattcaggacataggcatgggcaaggacttcatgactaaaacaccaaaagcaatggcaacaaaagccaaaattgacaaatgggatctgattaaactaaagagcttctgcacagcaaaagaaactaccatcagagtgaacaggcaacctacagaatggaagaaaatttttgcaatctatccatcttacaaagagctaatatccagaatttaaaggaacttaaacaaatttacaaaaaaaaaaatcaaacaaccccatcaaaaagtgggcgaaggatatgaacacacacttctcaaaaaaaataagatatttatgcttccatttctttagagg

SEQ ID NO: 533567 - DNA, 888 bp, Homo sapiens
ggcgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacattagcaaaaaatggggacaaggtagtagaagagggctgagagggctgatcaagcagaactcaaggaggcccgacgccagtggcaccacctgcaagtggaaatggaatctctccatgctgtggaaaggggccttgaaaatccctacatgccagcgagcagcattaccagatgccagtgaaggacctagagactgtgatggaccggactagaaaaagagctacaggaagtaaggcgcggatcgaaaagcagttcaagagcacgagatgcttctcaacacgaagatgaggtggaacaagaaatagcaattatcgccacctcctagaaaaggaagaatcagatatcatggtgtgtatccaaggtgggaaaaaaggacaaaaggcctaccacaagtagagtgggtttgggtttaccatcagcattattactgaaatatcttttactacaaaagtccccacaacagtttgagactgccatgtcgaaccgtcaccaaccaggcatctaaatgggagtttcggtaggggagcctgagtcattggcctattcagaccgacacagggtgagtattaagatgggggtctgcttaaggaacctcgatgggaaagttgtcctcgatgactcctttagagcctggtgggggtgtggctaccaggacccaatgagcggtagaaaaagggtcctaacccagacagaattggtgatgggggggaccccagaatttg

SEQ ID NO: 533568 - DNA, 435 bp, Homo sapiens
catagctgactcctgagcataaaacgccgcctggcagattcggagatcgtgctgaaggctggatcgtggacttgaagcccaccattaacggccatctggggtgctctttctgcactcccatgaaagagcctcggcatgctctgctggaaaaagcttattcaaagcttctagggtgttatgaggcccttggaggtttgaccatcactgaattattgtgccttcacgacacattggctgaaactgttgacatgcagaaaggaagatacactgagcttgttgaggagaagtacaagctattcggagaactgtacaaaacatttaccaaaggtggtctgatctgctgttccattgagtctcccaatcaggaggagcaagaagttgaaactgattggggtctgctgaagggccatacctataccatgactgatattcgca

SEQ ID NO: 533569 - DNA, 827 bp, Homo sapiens
ttttggggccccgcctgggggcctcttgcgacaaccggtccgagggtcccgtttccccctgtggggcccccccccgccggcgaatggtccggcgcgttacagacacacgttgtctgggttccttttcccccgccttagtggctcttgtgaccgcgtgaacccctgtttcccggggtcatggccgtgtgtcatcgtcgtgcggtttcgggctctcctcatgattctccctaaccttgcggggggcccccgggcttgttttttctcggccgtctcgaaggcccttgcatccgtcagtgggggctaacccccggggcccttctgaatcggcccccggttcgcctgagaggataaaaagccttcacgcccgtcccccgtatgtgaggattcttccccccttcggtgtttagcccgccgcggagcccgcccctgttttgttaggatgttccctgggagagatcccctctttctcagcagggtggtgtgggccgggctgttgttcccaacatacggggggagcccccctggcgcactctcgcccggctgcgtggttggcgcccggcgaatggagggtgcgtgcgacggcgcctattcttctggtgagcgggcctccgctcccccagggcccgcggtaggatagggcgcctctgtggaatcgcccccggttgttttgtcagggccgcgcccgctgcgccattcgttaagggcggttctgggcggctagcgctacgacgcctccccccgcctcctaggcccggtttctctacaactgttcttccccacgccctgggccccaggggaaaaaaaacttttgtgaccacaccaaaaca

SEQ ID NO: 533570 - DNA, 395 bp, Homo sapiens
  misc_feature (27)..(27): n is a, c, g, or t
aaaataaaaacagtatctgccttctgntcatttaatgatgactgcaatctgtacctgcaaatggcgcttcagtacctgtgttcagtgatccacatttgtgcttggactggaatgaaaaaataccgcttaattgccaagacaactgcaaatgagttcaatacgacttctcggtgcttgttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagtgcccccaccagcgccggggatcctcgtagt

SEQ ID NO: 533571 - DNA, 144 bp, Homo sapiens
  misc_feature (81)..(81): n is a, c, g, or t
  misc_feature (85)..(85): n is a, c, g, or t
  misc_feature (90)..(91): n is a, c, g, or t
  misc_feature (97)..(98): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (118)..(118): n is a, c, g, or t
agcggccgcggctgcggcgatcggccttgtgatctactacttggccttcagtgcgaagagccacatccaggcctgaggcgncacnccagnnctgccnngcttcctncaatancntncnaaggacctaggactacaaaagaaaaa

SEQ ID NO: 533572 - DNA, 239 bp, Homo sapiens
tgccaaagcgagtacccaatctactcagaaggctgaggcttgaggatcgtatttgagcctgggacgtccaggctgcatagagccatgattgcgccactgcacgtctagacattgggcatagagtgagactcttagctaattctctgcacttgttttaggccttataagactttataactttggctgggcacagtggctcacgcctgttatcccagcactttgggtactacgctttggca

SEQ ID NO: 533573 - DNA, 334 bp, Homo sapiens
cgctcactcttgaccgtctccccgtggccgccaatctgggaggtggtctgcaggtctggagaccctcggatggggaagagtcactgtgactggccctgttcccttctttctacttttcttctcggggactgaaagcccccttgactgacagaggccctggctgagtcggtaggcggtgggctggggggtcgtgggttgctctgtgtcacttccagctcccagaagaggctccgtctccctaatgctgaggctctggggctgggaccccaggaacccagctttgcctgtccaggccccgttctctccagttcactcacgacgtcctgcgccggga

SEQ ID NO: 533574 - DNA, 184 bp, Homo sapiens
gcgtatcatatctatgaccaagaggatttctttcttatttggagatacgagtctcacattgtcaccctgcgctggactgcagtgacataaacacggcttgctatagccttgagctgccaggctcaagtgatcctcctgccttaaccccttcaagtagctacaggtgctcaccaccatgcccagc

SEQ ID NO: 533575 - DNA, 194 bp, Homo sapiens
tgacaggtacaacaggcgcggattcatgatacacggacaccgcgtgctcgaccctgagctctgttccgaactcggtggtgcagtggactgtgggatcccaccaggacatcaccgaagacagctttaccctcttctggttgctggagacccggatagatcgtggtggtggggactggagaccgaacctcataacg

SEQ ID NO: 533576 - DNA, 416 bp, Homo sapiens
ggagcccgtatatgctgtctcactcctatagtgattgagccatacaaggtgttgatctcggatcttacgcagctggatcaggtcaggtttgatactattcttttttttatctatatctcggttgtccaaagcttgtttcttcaaatcctgctctagacgcatattgctatcatgaatctcacccagacgtgatttcattttatcacaattcatcataattcgttcgatctccttcttattaccccccctctgcgaaaacgctcaatatattctttgctataattgtgtctctgttgttttgaccctgctcttcaaatattttaattggttccataaaaagcttctattgcagtcctcttcatctagtatttcctgggatgttctagtatattcttcatacagggaatacaggggac

SEQ ID NO: 533577 - DNA, 189 bp, Homo sapiens
aatcgagactccgttagtagtggcgagcgaacgcggaccaggccagtgatacatcaaagacaatcggaaccagtcaggaaagctgggcctcagagggtgatagccccgtacgagtaatgcgatgatgtatccacgagtaaggcgggacacgtgtaatcctgtctgaacacggggggaccaccctccaag

SEQ ID NO: 533578 - DNA, 418 bp, Homo sapiens
gccagtgacgctgttgccgtgacctttgcagatcaaatttttggagtattcaattggataattccagtagcggttgcattctcttgctttggtgggctcaacgcctccatcgtggctgcttccaggcttttatttgtgggctcgagagaaggccacctccctgacgccatctgtatggttcatgttgaacggttcacaccagtgccttctctactcttcaatggtgtgttgtccctggtctacctgtgcgtggaggacatcttccagctcattaactactatagcttcagctactggttctttgtgggcctttctattgtgggtcagctttatctacgctggaaggaccccgaccggcctcgcctctcaagctcagcttttccttcccatcatcttctgcctcttgcaccatcttcct

SEQ ID NO: 533579 - DNA, 829 bp, Homo sapiens
  misc_feature (74)..(74): n is a, c, g, or t
  misc_feature (76)..(76): n is a, c, g, or t
  misc_feature (114)..(114): n is a, c, g, or t
cttgaaattgcatcgatgtaatcagtatgaagaccgcatgccatcccaagattatgtcctcacttataactatnanggaaaaggggctgggggtgggtctgtgggctgctgcantgaaaagcaggaagaagatggccttgactttttaaataatttggaacccaaatttattacattagcagaagcatgcacaaagagataatggcacagtgctacaattaggtctttgtcaaacattctgggaggggggaaaataatatgggaaagttcaatatcaacatgtatgtatatgatgatttttttctcaattttgaattatgctactcaccaatttatatttttaaagcaggggtggtgcttatcttttccaaaaaggggaaaatgtgaaaacagacaactgggaaatctcaaactccagcactgggattaaggggtctaaagcgtctgctcttttttttttttacggatattttagtaataaatatgctgggataatattagtgcaacaataggtaagttatgggaatatcacattattatgggttgagtttaaggggtggggtaaaaaatgaacaggaggtattggggatcactatgggaagaaggtgtggaaaaaaacatggaagacgggttaatgaagagggggggggttcataaaaaatgggagctagccctacggggttacaaattattggattgggggggaagggggggaaggcccatgaagaccatttttcttgggaagtgggtggaaaaaaagaaaaaagtgggctggggggctaggggggagttggggggcgtcctttaggaggggaatatgggccgggag

SEQ ID NO: 533580 - DNA, 515 bp, Homo sapiens
agcggggctggactgggtgagaggacagaggtggctcgatgggcggccgaaggccggggatcatggcgggaaggcgggcccagccaggttcagccccgccgaccgcgtcacgcggcatcgcgtgactttcccgcagcactgccgtccaccgggatgctgagcgcccaccgtctcacccgcaagcccccatcatgccaggctgcagagacatgccgatgggacaacatgaccggacatgtgcaccggagcgaacgagcgcagcccagcgcgaaaaggggagcaccgccatgcaccagcttgagaggtggtgcacagggataagccgccagagacccagcaccaccgagagcggagtcccgcaagagcagcggagaaaaggacgataccagacggaaccccggccagacgggcaacagaacaacggggaccaccaggaccaaggacagatagccgtccaggcacctcacgagggtgacaggcaacacagagcaggcaaacccggccggaggaggaga

SEQ ID NO: 533581 - DNA, 221 bp, Homo sapiens
ggaacctcccttcgggtaactgggttcctcttgggtaaattggaaaaatgggggtgggcgtgggcaaattctcacacatgttttcatgtctttgcaaagtgacccattttgatgccttcttgataaagtggtaaacattttgtagctttctaaaaactttgtattcatccggtatcaatgaaaaataaagaaaatgaaagtgtgggtccaaaaaaacccca

SEQ ID NO: 533582 - DNA, 249 bp, Homo sapiens
  misc_feature (18)..(18): n is a, c, g, or t
aaaggggccccccctttnaaattagaaggggggtttttttttgggcaaaccggggcccccccccccgggccggttcctttttttggattatttggcggggccccagggggggggggggccccccccccccccgcggggtgggggtgaaagggggggacccccaaggtgggggttttttttttttttttttgcccgccctttttcccccccccccccggggggggggggaattttttcctttggttccca

SEQ ID NO: 533583 - DNA, 361 bp, Homo sapiens
gtggttcaaacagggcaacaagggccccccttcacctctccggcgccccttgtgttttggaaaacaggtttcgagaaacccaaagttttcgccttggaaatttcccctcaggggcttgggttgcccgtcccaaaaaggtttcccccgggagagttttttagggggaaggggccccccctggttctcagtttcagcctggcccccccccctcctttgggcttttacccttttttcccagggggcccccccctttttggggtctccaggtttttttttcccccccccccccccccccccctgggtttttttttggtaatgttgggggggaattaattaataaagtgttttttttcccctttta

SEQ ID NO: 533584 - DNA, 709 bp, Homo sapiens
gttttactgtgtgcagctatctacatagcacttcgagttgaccccatgaacatttcactatacgttggtctatcacctctctatccatttgagcatcctgctaacgatgccttattatactttattttcttgatgcattgcaaagtagactagcacacatcggtctgttacgtactaaatatctcaccttgcataataaattacaggtggatagaaagggacatctacattcagaataaagctgccatggagctctggttgtgggccacatgctctaagcatatccggattatcatactccttcatacccgtaatctcgtaattcgcaaacgctgttcctgacacataagatatgaatgttcacatgtatactgacagatactagaggagacttttggaagaggtatcgtttgccacactgactaactgcttgactattgtgcacgccacccacaggcttgagctctacattctctcgaactgtaatcctatcctgacatgtttacttctgtcagctagagacatatgcgtacaatgcaacctgtgcggggttgcatgacacgctgggcccattccacaggatcgttgagattcactagaacagttgggtacttcgccaccttcatagagttgcacatgaactactcggacctaacatctggactcagtatcctcacagggatattatgttggagcgctaggcatcact

SEQ ID NO: 533585 - DNA, 411 bp, Homo sapiens
tagtattaagtgtgcagattcaagtttgtgtttctctctatattttaataagaatgacatttggcccagtaggtgaatctcctctatgatactatcaaaagcatgttgtaagagttgtcagtgaatgggtttactttttccttttcatacctttttgtagagatagatttttaaaaaatgctttccttgaaagcaaagtaattaaaggagttaaattggtggggaggagtggcaggaacgtggtgggaatactcagatattaatgaaaggtatattaaactctgcagggaaaatggagactattaagtagtctcatgtcccagcactttttggaaggctgaggtgggcagatcacctaaggtcaagagtttgagaccagcctggccaacatggtgaaaccctgtctctatc

SEQ ID NO: 533586 - DNA, 599 bp, Homo sapiens
  misc_feature (409)..(409): n is a, c, g, or t
gatgaagagcgagccctggacggcgcctctctgaacgagtgtgggcgcgatgcacgatgacgacctcaggcgccgcgtctttccgagcctggtgccaggatctcggggcgcgtccaacaaggtacttggtggagtatcgtgcggtaaagatgtcctctgaaggggaccatcgtgaactccgcgcatcacacctggaacaagggctaggttgtcacattctatgcacgacttgcgacggacagtcgcggctgatattctactttcttgctagtgaaggcgaaccatgtgaccgcttctgcgggaaccgtcggacagaacgactttgatccagtccctctccgcttgacgcgacctcgttggagtttacaacagacgcgtggtttgcaccgccaacgtttgcacgccaatnctggtggcacgagtggttactacggattgccatgcaaaggtatcgaaacgggccagtggggtatcccggtaagctggcgttttgcctttcctttgtgaattgccaagtgtatagccaccaaaggcactaggacctcaggattggaaggaagcatttgccactggcatagagtcgaaccggaggtctatct

SEQ ID NO: 533587 - DNA, 125 bp, Homo sapiens
cagaggatcctggtgactctgctctatgctgggacaatggcaccaggtcacttacatgtcatctttagctactgacaaccttgtcccacaagcagaagcacagaggggtcactaacaacttggtg

SEQ ID NO: 533588 - DNA, 937 bp, Homo sapiens
tcggccccagaaaagggtgtgttcacccccaaggggaaggtgtgtcgaaagtgcgggccaacacggctctggggcggaaaccaacctcgcgctggggggagactcccaccggttcgggggctaatgttcgcacacgccgtgtgtgtaggaaaaacaagtgccgccagggcgacaggcaatacaatgccgttggggtacagaatcggaacccacattgtggggaggggtcggccagacaccgaccacgacatggcttggggccgccgccacaccacacccgcgtgccaccatgtcgggccacccacttacggggcgacaactatttgggggcagacagcgtgcgtgggctccactaatgccgcgagggtggaggcctcaatcactgttgtccgtgcagcccacggcaaacccacggaggggtatctggcgggcggccaccccaaagcggccaacatggttcggccaccgcgtccagacagagttggtgaacagcggcgagcaccaaggggtccacccagcgggggggcagggcccccacaagaagtgccactcggcagagtcactaacgccgggcaccacacacgagcgttgcggcaggtcgcactcaccgcgcacataggggcgcaaaaggcgccctggccgctgcctctcacaaagagaaagacaatctcctccaggaccaacaacacctcccggtgtggcgggcccaccaatgcttcgggatggtctctgtgcaggctctccattcagacacacggtcataagtctctatcccctcctattggaggaacttgcaacacgctgcctccgcgcgcaggcgtatgtagatctaagatttagtacattgacccccaccgcgctgctatgagagagcttaaacgagccttcttgtggtcggcaaccccagcggaacaaaattttttcttcccacaagaca

SEQ ID NO: 533589 - DNA, 306 bp, Homo sapiens
tcagctaagactcacaggctagctgaacaactggatgtccacaggcgtgatagatattgatatatagatcactgatagatagatagatagatgatgactacaggtgattgattatgggaattgacttacataattcatggaggctgacaagatcccacagtagtgccacctgtaacttgtagacctcgggccgccattttccttggctcatttccttgtctgatatgcctcagaacctgagtggctgctttgtacagtgtccctctgtctgattgcctgatgaacctggtcgttgtgatgtccaag

SEQ ID NO: 533590 - DNA, 875 bp, Homo sapiens
gctctcgcactctgttcttccgccgctccgtcgtcgcgtttctctgccggtcagcaatggaagacgagatcgccggctggtcattgacaatggctccggcattgtgcaaatgctggttttgctggggacgacgctcaccgagccgtgtttccttccatcggtctgggtcgccccagacatgcatggcagtcatggtgggcatgtggccacgaaggatcgtcctacggtggtgcgactgaggtcccacgagcaagcagtggcgatcctgtaccctgaaaggtaccctcatgtgagcgatggctatcggtcagccgaactgcggacgatgatggcagcaagatcgtggctaccacgaccttgctacaagcgagctgcgcgtggccccgtgaggagcacccagtgctgactgacgcgaggctcccgcgctgaaccgccaaggtcgcaacaggagagacaggatgacctcaggattatgttctgaagacctatcaatacgcaccggtacactgttacggtggtcaatccaaggcgcgctgcatgtcgcctctacagccttctgggcagcaccagctggcattgtcatggacctctggagaccggggtcaacacagaacggtgccccatctacgaggggctacgccctcccccacaagccatccatgcgtcatggaccctggcttggcccgggaccctgacgcagactaccctcatgacagagtcctcacctgagcagagagctaccagcattcagacaaccagcggaccgagccgggaaaattcgatgcggcggacatcaacggaagaaagcttggtgctacagatcgaccatgggacattcgaggcaaggagatgggccaccgtccgcattcctccta

SEQ ID NO: 533591 - DNA, 165 bp, Homo sapiens
caagttattagaaaaaacaagaaaaaaaaaaaaaggaatacttccaacctacaattttcctcagccaatttctcttggggcttgatgtcccaaaccttcccccaacttaccccaaaggttatattaaaccctttcctaaaactggcttggattgtatgttccttt

SEQ ID NO: 533592 - DNA, 161 bp, Homo sapiens
aaccgagtaatcggattacacgcacgatgctcatgttgtcgagggaacttgtacaggcaggcatgcaccgagtggtgaatacactgtctaaccagtgctccagtcttaacgactattgtgagcaggtcatgcacggatgctcactgtgtcgcacggaagct

SEQ ID NO: 533593 - DNA, 908 bp, Homo sapiens
gccgagttgcgatgctgtacttctctttgtttcgggcggtcgcgctctgactagagcatgtgggcacggcgtggtcaccgatggccattcggactcagtacagatacgcagcccatagtctgattgtggaagcagacagggggtggacaggccaggagagcctgtcggacagtgtatcctgagaatgtgggtatttcgctgcatgaggggaggaatggtaggaggctagatggtgggtgggctggacgactcagtggggctcgagagaacctttcgtggagcctgagacatgagcatggaaggctctggggatcctggtctgaatcaataatgtagcgtcgaggatgtgtttacttctgggtaacgagatagcgtagtgagggtgagctagaagaggtgagtggactgtagatatgtgtaaggctcgatgatgggtagcgagcgtggggctcgtctcgcggtaggctctgtgtttggacacttgggactcccattgttaggaagggtggagcgtaggttgcacattgtcccaggacaccattaagtgctcgtggtcgcccccagaagcaaagactcgtgccctgttttaccacgggctctcttcgtgtcacctcatagacactggtactcgtgggggcgctcggagcatgtcctagagggagtgtagtcatctgcttccagggatttgatagtctaggagggtggagcggaatagtaaagcaagggtgcatgattatgctgacgtctattgcctatttatgctttatggcgctggattggcatcatggggttagaaaacaggtaggaatttgactggtctgaaattgcttgatatcagctgaatgaatattggttcagggttatggagggtgaatggatgggccgggttatagaggtgtgggaaccaa

SEQ ID NO: 533594 - DNA, 155 bp, Homo sapiens
cgctttatatcatccagggtctagttctttctatgaccaaaaacacaacacaggatagaaagcaaaccaagaagttgtaaagctaacctgcccacctcaccccttgtgatatcgtggtaccggtagctcgagattcgtaattcatggctcactag

SEQ ID NO: 533595 - DNA, 1213 bp, Homo sapiens
gcgactgcggtgcatggctggccctgggacatcttgcgtggggaggcagcggcggacccaggccctggtgtactccctgtcgcgataccgcggaatgcccggcttcccggaccctagctttccagcgcccggaatccgttccactgtcagtgtctcatggaccaaagcaaccgtacagtgcaggaatggcatgtagctatccagaagacgccaccgcgatatgggcagatagaaaggcggccacgagcagtcgagagaaaacgaagaacgagataagaagcaagaacgcggggacagcagggcccgatctgctgggtccacagagtggtacggccgaagacacgggccctgcgagcaggaaaaccgtacggacccccaggaaagcaaaaggtatcccccgtacaggcgacgtggagggggccccaagcgccagcaacaacaaggtagggcggccaaaggcaactcgaggactcggcgatgctaggctggcacggcacaaccatgggcaagacctaggggccttccaatgcacgcgcgaacgcacaaacccccaactctccgggagatgactagggagagacgacagccaagggcatcactgcgagcacggcaaagttccggaaagccaactccgacacgcctagagaaaggaaagcggcccgcctatggcccccccgaggacaccgaacgccgccacgccacatagcaaagttgtctaactatccacaatatgtgtcacgggggccacggaaccgtacgtaaaggggggacacttctagcgatcatgcggcagaactggccctcgcacacactgggccccgattgcaacgcggcgcccccttagcagggtggcgacacttccttccacagacaggcattggtcctagcccttcacattttccacggggcccacaaatagggagctagggcgcaaaaatacactgttggcattaagcagaaaattgtcggccagtgacaccaaacccccaacgggaaacaaactgcgaccaagcgaaagttcaccaacccagcagcggcacacatccacttgcgccaaacggcggcaccaccacatatcggaccagatcccatacagtgttaacttcgcggtgcacagggaaacgcggcccccatcaccacggccgccaactcgattctatttgtcgggaacccgacagtctgcgccccgcgtcggcaaacattggtaacaacg

SEQ ID NO: 533596 - DNA, 96 bp, Homo sapiens
  misc_feature (50)..(50): n is a, c, g, or t
cttctattgtactctttcagcccaagactccggattgtaaccaaaatgtntcccagtttgccccatgatctttacctcagtttatatgttataaaa

SEQ ID NO: 533597 - DNA, 105 bp, Homo sapiens
ggagacgggtctcatgcattgtgtagacttttccttgtttgttcctggctgggtcacggcagtgctgcgcgtggtggtggcactgatgagcctgggggaacaggc

SEQ ID NO: 533598 - DNA, 94 bp, Homo sapiens
aagggaagagaagggaaaggaagaaggaaggaaggagaaaaaagaaaaggaaagaaaaaaagaaaaggaaggaaagaaaaaaagaaaaggaagg

SEQ ID NO: 533599 - DNA, 439 bp, Homo sapiens
tgccaaagcgagtacccaagtagtgaacatagtccccgatagatagtttttcagcccttcccctcttccttcctcttcctttttggagttgccagtgtctgtgttctcatctttgtgtttgtgtgcacccagtgtttagctgccattgtgagaacatgcggtatttgtttttctatttgtgcattaattcgctagggataacggcctccagctgcatccatgttgttgcaaaggacatgattttgtttttttatggctgtataatattccatagggtatatgtctactatattttctttatctgatccacttgatggtcaccaaggttgattccatgtctttgctattgtaaatggtgctgcaataaacatatgaatataggtgtctttttgatagaacaatcattacggattgggtactacgctttggcagggtaccg

SEQ ID NO: 533600 - DNA, 432 bp, Homo sapiens
cacgagggtggctcccacctgtagtcccagctactcaggaagctgaggtgggaaggatgtgacatgaggggttctgctggctgctgtggtccatggcaggggggcagccctggtttcatgaactcagaacccagcctctgggggatggaagcactctccactgggcacgtgtggtccctgcagcctgtagcttcaaagcacggtgactggttccaagcccagtatggtggagaaggagactacggcaggaaccagggggattcgggggtggaggagggaagccgcagggcagttggtgggtacatcagatcctgtggacatggtgtgcagacccggaaccccggcagaggagcaaggattccttgcaccaagaggatggtggcccttggcctcctggtgcagagcatcagtcccacgctgggagtgtggaga

SEQ ID NO: 533601 - DNA, 368 bp, Homo sapiens
  misc_feature (21)..(21): n is a, c, g, or t
  misc_feature (111)..(111): n is a, c, g, or t
  misc_feature (113)..(115): n is a, c, g, or t
  misc_feature (117)..(117): n is a, c, g, or t
  misc_feature (128)..(128): n is a, c, g, or t
  misc_feature (133)..(133): n is a, c, g, or t
  misc_feature (137)..(137): n is a, c, g, or t
  misc_feature (145)..(145): n is a, c, g, or t
  misc_feature (167)..(167): n is a, c, g, or t
  misc_feature (172)..(172): n is a, c, g, or t
  misc_feature (176)..(176): n is a, c, g, or t
  misc_feature (180)..(180): n is a, c, g, or t
  misc_feature (193)..(193): n is a, c, g, or t
  misc_feature (197)..(197): n is a, c, g, or t
  misc_feature (204)..(204): n is a, c, g, or t
  misc_feature (207)..(207): n is a, c, g, or t
  misc_feature (212)..(212): n is a, c, g, or t
  misc_feature (220)..(220): n is a, c, g, or t
  misc_feature (224)..(224): n is a, c, g, or t
  misc_feature (243)..(243): n is a, c, g, or t
  misc_feature (248)..(248): n is a, c, g, or t
  misc_feature (256)..(256): n is a, c, g, or t
  misc_feature (262)..(262): n is a, c, g, or t
  misc_feature (267)..(267): n is a, c, g, or t
  misc_feature (283)..(284): n is a, c, g, or t
  misc_feature (296)..(296): n is a, c, g, or t
  misc_feature (298)..(299): n is a, c, g, or t
  misc_feature (302)..(302): n is a, c, g, or t
  misc_feature (306)..(306): n is a, c, g, or t
  misc_feature (308)..(308): n is a, c, g, or t
  misc_feature (312)..(312): n is a, c, g, or t
  misc_feature (320)..(320): n is a, c, g, or t
  misc_feature (332)..(333): n is a, c, g, or t
  misc_feature (342)..(342): n is a, c, g, or t
  misc_feature (348)..(348): n is a, c, g, or t
taaaagtatatttcctaaaanaaatatcagcagtggtagagaccagaaaaagtaagtgtgtgtgttctaaacagtgattccaactcaatgtgttcagagaaaacactttgnannntntttgtgttttntgttnctgntgatagtntactgtcgtttcctcagccttnttctntttntttnttttagctttacngagnttaggtntcnagttntgagaatntccntggttttcaggggctaaanttttntgccattnttttgntcttnccgggctcagaaggtnntgtcaggtgggntnngtntttntntttnagagctgnagaaagggtctnngctgcggantcagtngagaaagccttggtctcagt

SEQ ID NO: 533602 - DNA, 247 bp, Homo sapiens
  misc_feature (54)..(54): n is a, c, g, or t
  misc_feature (239)..(239): n is a, c, g, or t
gccgctgaggtagtaggacctcttaaggacagaagtttgagaccagcctgggcnatatagtgagaccctgctctaaaaataaaataaaatttaaaaattcaccagtcatggtggtacacctgtaatcctagctactccagaggttgaggtgggttgaagtaagaggatcacttgagaccaggagttatggcgaggtcttatcgcactacttcactccagcctaagcaccagaacaaaancctgcttc

SEQ ID NO: 533603 - DNA, 102 bp, Homo sapiens
gtggcataggtgaggaggacgcaggatgcttccaccccatccttctggaggtccagattacatgatgctgcagtactgcgggctctgggtacgggggctgga

SEQ ID NO: 533604 - DNA, 623 bp, Homo sapiens
acactgcagacgccatgccgacctacggggccccgaccctactgccttcgctcgacgccgctctccttcagatctccccagggacctgtttcatggatagggtccccattgacccgcgatgaaagtcgtcattccatccatcagctcagaaacactccaaggatctcggacgcccgtatacatggccattccacatcaatccagcaatacacccatcgatgcatcctggagtgatatccatatatataccaatttcgccaagcatccgcatagcttcatgtgacagagtcatacgacatatcatacaggcatgacgggccgattgtggacgcattatcgacaatcacacgaggttgccaggcgggacctcagagtggaaaacggaacatttggacttctgccgggcggcccatatggaatagcacacaactgatcttcggactacaccgagcgtaccacgtgggtcacaacggcgacaccaggacaggacaggacggattggttacagcgagtggccatggaccaaaacacacacacgaacggacacaaaaccaccgaaaacaaaggagaacaggcctcccacggaacagggagcataaaccccagacaggaacatggcgatc

SEQ ID NO: 533605 - DNA, 521 bp, Homo sapiens
ggaccgactctgcagtcacgatgggggaaggcttaaacgcagctggccaggtgtattttcaagtgtcaagatcccagtgatccctgacacccaccccttcctactcttacattcatgcgtctgtaagatagctgcctacaacaggtcagtagtgatgctcggatcagaaaaacaagatacaaaacaaacaacaaacacacttggtcccttcagaccagtaagatacacaaaccacctccacgacctccgaactcccccctccctccgtcttctctgaggagcacgtgcctcttccttgaccctgggccgggctggggcgggagcagcccagctgctctctggatgtcacaccactgttaactggcagtaacaaaaataattaaggtacatgctacacacacatccagctggaagccttgtaggcccctaagcctttgtttcatgctacagtaatgaagggtatgtgtccccaatgcacagtcaaccgcacacaactcaatgaacttcctgggaaacaatat

SEQ ID NO: 533606 - DNA, 217 bp, Homo sapiens
cgactctacggatccttattgctttgggacggcgctgtgctttggtacggcgaggcgggcggatcacgaggtcaggagatcgagaccatcctgactaacacggtgaaaccctgtctctactaaaaatacaaaaaattagctgggaatggtggcaggtgcctgtggtcccagctactcgggaggctgaggcaggagaatggcgtgaacccgggagggt

SEQ ID NO: 533607 - DNA, 543 bp, Homo sapiens
  misc_feature (22)..(22): n is a, c, g, or t
gtcatctctataatccctgtgntaaggcacagtagtcagactgagaagatgcttggaggcaaatattaattatggcacacactgtaaattactatatccatgagcatgttcctttgcttgctaacagaaaatcctgatttagcttggataaacaaagtgtccagtgtacaggtgatagactacagggttggttaaagccaggctggggcctatatgtaccttttagcctgatactagaaagagtttacagtagggactgtcctgtggtccacttactggataatgagacataaaggagaagtctgctgtgtcctatctaagaagatattcttcactggttaaaggcgagagcacacatcaagacaagccccctttgacatagcttcctccatcttgtagcctggagtctgaactaggtccatgaatggctagagctataaacagccatcctgtgatacatgaagctccaagggtaaaaagcagtaatatacaggaaggtggagctatggaacaactgataaaaggatctgggacacactaaca

SEQ ID NO: 533608 - DNA, 128 bp, Homo sapiens
gcctggctgcagggctgctcttcggcagtctaggcgcctcggtgcttaccaactgtatcaggatcccaggaacggtttgggtttactagccgctacatctgttacttgtgttgagggttattgggatt

SEQ ID NO: 533609 - DNA, 168 bp, Homo sapiens
tacccatggactggagatccttttcaatctggccataacatgtgcccacacatcttcacctgtggaaaatgtagcatttcaagcttaagatcagggctagattatcccttcttacacttacacaaatttatcacgttgctagccagcaagtctactcaagcattggct

SEQ ID NO: 533610 - DNA, 246 bp, Homo sapiens
ttcatcacatttagtcaaaaaaaaaaaaaaaaaatttctcttctcccggataatgggaagttctggaacgtaaaatatttttttcccagggggtcaaagggtccctaagtatatgatggcgagtggaaaaataggggacagaaatcaggtatgggcagttttcccatttccattggggtgtgaatttttaatataaagggcgggagacgtaaagcatgaagtggcaggtaacaaagggttccaggt

SEQ ID NO: 533611 - DNA, 368 bp, Homo sapiens
ccagctgaaaccggactacaagatctggtctagagtcacaaatcaggaagcagaggaatggagcggacggtcgtgatggataaatcgacaggagagcccgtcattagcgtgcaaaaccacaagcgggtccaaagagagagatgagtattgcctctgccatctcagggccagcgtgtatctcacgatggctccacggcccgtgtgatccgcattatgaaaacagcactgttttgcactcttaaaattagtaagttagtaggaggcgcgataatggtgtagatggcggatacagacacagacatgaatcctggtgctttctgcagagcagtgcccatccgtgttggcttcccttactggctcctgatcgg

SEQ ID NO: 533612 - DNA, 302 bp, Homo sapiens
gctcctggataccgtctttccttctattgaaaatctatcaatggctgggagcggtggatcacacctgtaatcccagcactttgggagaccgaggcaggtggatcaccttgaggtcaggagtacgagagcagcctggccaacgtggtgaggccctgtctctactaaaaatacaaaaattagctgggtgtggtggctgtgggccatgtaatctcagctactcaggaggttgaggcaggcgaatcgcatgaacctgggcggccggggttgcaatgggctgagatcatgctgctgacctccagcct

SEQ ID NO: 533613 - DNA, 530 bp, Homo sapiens
ccagttaagcggagagagaacagaatccatcatacaacgggctctctactatgatcttgatcatgcagcccagacattcatggtacctataaggatgctccttgatcacggtcaccgccccccagaacgaacctcaagagtgcctcccggatcgtactttgagaagaagctgcgcataaaatccagcttagtggctacctctggaaaagtcctatgggaccaggtcccatgagtcctgtacgggcaaccctcgcttggacctgccacgagatcacacaactgggatgcaggcgcagatgagtggggcggctcgccgggtccacaatggaaattcccgctgagatcagcattctccttctcggtgtggcgcacttcaaggggcagtgggtaacaaagtttggacgccagaaagacttccctcgaggatttctacttggatgaagagaggaccgtgagggtccccatgatgtcggaccctaaggctgttttacgctatggcttggattcagatctcagctgcaagattgccc

SEQ ID NO: 533614 - DNA, 248 bp, Homo sapiens
caacgatggtcctacagctgtcaagtggaaccctttgttactatactggatcagctgcaaagtagggtgtggggttttttgttgtttttttgtttgtttgttttttgcttttttgttttgagacggggtctcgctctgtcgcctaggctggagtgcagtgttgtgatcttggcccactgcaacctccacctcccaggttcaagcaattcccatgcctcagccacccgagtagctgaggaccatcgttg

SEQ ID NO: 533615 - DNA, 277 bp, Homo sapiens
ccatattgcccaggctggtttcaaactcctgaactcaagttgtggttttatttgttatctattctttctcttcagaattgataatctctttcaaaaaagtaagcaatttttataactcattttgtagctcatttaacccattttgtgcttggtgggggttatccagccactgatttctttctcacacaaacagcagctacctgaggcaggttataggacagtgtcttccctccaaatatatagatttgatgctaacattcagttttgcagagaagcc

SEQ ID NO: 533616 - DNA, 1929 bp, Homo sapiens
  misc_feature (754)..(754): n is a, c, g, or t
  misc_feature (758)..(758): n is a, c, g, or t
  misc_feature (1928)..(1929): n is a, c, g, or t
tggaccagcaggatcgcccagggcagggcaactggccagaaggaaatgagggaaggccgcgcgttgaggtttcggcatggggagaacacagcctccgcggtccacggacgccgctttgccacattttgagcgtttctggggaggacaacgcgcgcaggaagccgcaagtcatctcaactgacctccaaggctaccaggtttgagggctgagccgagtctgaaaaccccgacccgcctattggccggggactgtgggtccaccggccgcttggccccctcgctcggcgccggtccaggcgcagcgctcggggccccggcgacggtgagatgcggcgcggccagcttagctcggggtaggggccaccccagcctcgcccagccgccgggtccgcgacctcgggagggtccggtccttccctcggcccccgcgacgccgcgcccgggtgaggccctgggcttcttgccggtgaccacgcggccagcgtggcccccagcccaggacggctaccaaggcggcccagccccatccccgcccgcgggtcccggaaccgaagagctgggagcgggcgcttcctgacaacatgcggcggcgcccgggcgcctccccggtcccgggtgtctgcgtctccccgcgagccgtgggcaaagccggtgccgtccgacgacaggaggcgaaaggaacccaggaccagacccgcggggcgaacagtgctggaggaccatgcaccgaccacgcccgaagcagaaccaaggnccgncctgttgccgtggcgactgcgcgcggggtagacgcaggcgccgcaagccgtgagctctcagtgcaggcgcataggctgcggggttgaggcgcattgcgtgcgcgtgcgcgctgctcacacgcggacggttctgtgcgccgcaatggctgcccgcgagtatcggagaggcggagctctcagtcttttacaggaccgggtctcctgatgccgccggtggttcctcgaggcccccttccacgcatccgccgccgctgcttcatcaggacttcatttcggtgacgcagagctttggcgagagctacggcaacagcaagaactgccggcggctcttgtgctgcagggtgaggaccgcgccgggcggaccgaggcccggggtcgctgcgcccgccgccctcccagcctgcggctccgagcggggcctgggcgggcagactcgactccccccgacgccgccctctccacccttaccccgcaaaaaggggcaaatctgctttccgggccggggcagccgtggtcggcacgcctgcagcggtctcagcggcccaaattctgcggggcggtggtggtgggaggaagggttggagccccagcaggttgtctgggcttcgtttgattttcggcaaggtcctggcccaggccccagtccctcttggagcggaagcctctggacctgttgctcctaagaaagcaagcggcccctgacgcgttgctgtggcctggtttgaccctcgtagccagcccatgttctgtgaggcatgaagcgccacgcagacaccacgacaaagtgagatgaactaagacctcttcttgattctaagcagggaacgcacagctcaccctgtcacatgcagcgatcataagctgagaattaccctcttccttcccacagcgtctaatctttttttatgtttttgtggcaaggtctcgcttagtcgcccaggctggagcgcagtggcgatcatggcccactgcggcctcgacctcctgggctccagcgtgcgtctaatctagaaccaaatcctccttccttagatcatcccccaaatcacccaactacaggtgaaatcctgtaatagtttcctccgaacaccctgttgctgagacacctcaacgtctcaacctggtgtgtttgtacgtagagtaaaagacccaacttgtttaactcccccnn

SEQ ID NO: 533617 - DNA, 1878 bp, Homo sapiens
  misc_feature (754)..(754): n is a, c, g, or t
  misc_feature (758)..(758): n is a, c, g, or t
  misc_feature (1877)..(1878): n is a, c, g, or t
tggaccagcaggatcgcccagggcagggcaactggccagaaggaaatgagggaaggccgcgcgttgaggtttcggcatggggagaacacagcctccgcggtccacggacgccgctttgccacattttgagcgtttctggggaggacaacgcgcgcaggaagccgcaagtcatctcaactgacctccaaggctaccaggtttgagggctgagccgagtctgaaaaccccgacccgcctattggccggggactgtgggtccaccggccgcttggccccctcgctcggcgccggtccaggcgcagcgctcggggccccggcgacggtgagatgcggcgcggccagcttagctcggggtaggggccaccccagcctcgcccagccgccgggtccgcgacctcgggagggtccggtccttccctcggcccccgcgacgccgcgcccgggtgaggccctgggcttcttgccggtgaccacgcggccagcgtggcccccagcccaggacggctaccaaggcggcccagccccatccccgcccgcgggtcccggaaccgaagagctgggagcgggcgcttcctgacaacatgcggcggcgcccgggcgcctccccggtcccgggtgtctgcgtctccccgcgagccgtgggcaaagccggtgccgtccgacgacaggaggcgaaaggaacccaggaccagacccgcggggcgaacagtgctggaggaccatgcaccgaccacgcccgaagcagaaccaaggnccgncctgttgccgtggcgactgcgcgcggggtagacgcaggcgccgcaagccgtgagctctcagtgcaggcgcataggctgcggggttgaggcgcattgcgtgcgcgtgcgcgctgctcacacgcggacggttctgtgcgccgcaatggctgcccgcgagtatcggagaggcggagctctcagtcttttacaggaccgggtctcctgatgccgccggtggttcctcgaggcccccttccacgcatccgccgccgctgcttcatcaggacttcatttcggtgacgcagagctttggcgagagctacggcaacagcaagaactgccggcgggctgcgcccgccgccctcccagcctgcggctccgagcggggcctgggcgggcagactcgactccccccgacgccgccctctccacccttaccccgcaaaaaggggcaaatctgctttccgggccggggcagccgtggtcggcacgcctgcagcggtctcagcggcccaaattctgcggggcggtggtggtgggaggaagggttggagccccagcaggttgtctgggcttcgtttgattttcggcaaggtcctggcccaggccccagtccctcttggagcggaagcctctggacctgttgctcctaagaaagcaagcggcccctgacgcgttgctgtggcctggtttgaccctcgtagccagcccatgttctgtgaggcatgaagcgccacgcagacaccacgacaaagtgagatgaactaagacctcttcttgattctaagcagggaacgcacagctcaccctgtcacatgcagcgatcataagctgagaattaccctcttccttcccacagcgtctaatctttttttatgtttttgtggcaaggtctcgcttagtcgcccaggctggagcgcagtggcgatcatggcccactgcggcctcgacctcctgggctccagcgtgcgtctaatctagaaccaaatcctccttccttagatcatcccccaaatcacccaactacaggtgaaatcctgtaatagtttcctccgaacaccctgttgctgagacacctcaacgtctcaacctggtgtgtttgtacgtagagtaaaagacccaacttgtttaactcccccnn

SEQ ID NO: 533618 - DNA, 275 bp, Homo sapiens
ctatgatcgtgccactgcactccagcctgggcgacagagcgagactccatctcagaaaaaaaaaaaaaagggtaatatttaattggcccagctttttaaaggtttcctttagcagatttgtccagactcactagatggggttttattttaaaagaaaattaacacgtgctggcgggcccattgcagacaaatgatcttgatcagaggctttttcttgttttgggcccgcacctatgtgctggaaaactccacgctgccttcctttgggggggggc

SEQ ID NO: 533619 - DNA, 271 bp, Homo sapiens
ggaacatgacagggacctttccagagctcaaggatttcatggtagcattactaccaagattagatgcgcaccatgagcagcggtgggagggcccaggtagggcttacgtactgctaaatgttctccagagcatatattacaatctttcaaagtcgcacactagacttcagtggtttttcgagctatagggcatcaggtggtgggaacagcagatggacttgatccctctgtgtcttttagcttctggctggtagatcatgtcaacctgcag

SEQ ID NO: 533620 - DNA, 432 bp, Homo sapiens
cacacacatcaaagaacagggttatgcagctgtcacatggagacaccagagatgcacgaagaggaggaagtacagaatgtgtcaagactctatccatagggtgtaggtcaagttcactacactgcccgtgcacaggatacacatacatgtggtagttacacttaaagtcccttaagagaaggtcaatgggatggtccccagcacacaagggggcttttcatccaggtaaattatactagaatataattaaactgcttctcatatcgcatccaccagcgtgtccagagttggcttcataaagctgcatgcaggatatacttgagccagtctctcatccgtcgaggaacactgcctcacttcaaaagtccgcacaagtaggaatagatttgcaggctccaaaataatccagctggagttgatgcccctttaaga

SEQ ID NO: 533621 - DNA, 369 bp, Homo sapiens
acagcgtttcaccatgctagccaggctggtctcaaactcttgacctcagatgattcacctgccttggcctcccaaaatgctgcgattacaggtatgagccactgtgcccaaccaaagaatttaaaaattagatggttgcagtagtgtgtctctgtggtcccagctattcaggaggctatggcaggaggatcccttgagcctaggagtttgaggtggcagtgagctatgatagcatcactacactccagcctgggtgacagtgtaagaccctgtctctaaaaaatgaacgcgatgaagtggaggcacaacgcgatgaagtggaggcacaacgcgatgaagtggaggcacaacgcgatgaagtggaggcac

SEQ ID NO: 533622 - DNA, 112 bp, Homo sapiens
cagcgcggtatgtgctggaatgcggattgtcttgagaattttgagaattgagtcagtgagaagaactgcagagtcaaattacaccaacacagcaatgacctaaaatagatcg

SEQ ID NO: 533623 - DNA, 825 bp, Homo sapiens
cacttttgggttcccccctcttgacatttttcctaattgcttcctaagttcccgtaagacccccttttctgaacaaatccgcccaccaaaacgttacttattattatcaattttccaaacgctcctggggtattaagacacgcccgtttggacatatctcttgcccccctcatctatctttttgtctctcttttgctccctctccccatctccttacagccatcctcttttcgaaatgacaccacaacggggtgtcaacaagaatctactcctctccctttcgcgccctccaacatcctcattggcccccccccacgggttcgtgtgaccattcgggagtttccacccggctttcggccgggcgatttatattttctcacacattccctgacaagaagattctccccccactgttactttccctatggaacgccagggcgacacttccgtcatcccttgacagtgattacatcatcgggtgtggattacttcctcctcgatgtgtgtagcgccccctacatctcgattatattaaaattacacatctcaccccaaacatttttgcgacaacttcatgagagctgtctccccaccactttagagcgattttaaaacagaaagcccatttccccggacagtgtttaacccccaaccacttgttccaccgctgaccaccaccgcgggggttaatccgtccaattttttaaattttggggccaaccccccttttttacccctttttctaaaatttattctcccctaaaattttttaaaaggggcccttttttccccttaagccccccctttcccccttttgggacccca

SEQ ID NO: 533624 - DNA, 888 bp, Homo sapiens
  misc_feature (9)..(9): n is a, c, g, or t
  misc_feature (116)..(116): n is a, c, g, or t
  misc_feature (165)..(165): n is a, c, g, or t
  misc_feature (172)..(172): n is a, c, g, or t
  misc_feature (177)..(177): n is a, c, g, or t
  misc_feature (191)..(191): n is a, c, g, or t
  misc_feature (205)..(205): n is a, c, g, or t
  misc_feature (207)..(208): n is a, c, g, or t
  misc_feature (213)..(213): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (234)..(234): n is a, c, g, or t
  misc_feature (240)..(240): n is a, c, g, or t
  misc_feature (248)..(248): n is a, c, g, or t
  misc_feature (266)..(266): n is a, c, g, or t
  misc_feature (283)..(284): n is a, c, g, or t
  misc_feature (286)..(287): n is a, c, g, or t
  misc_feature (290)..(290): n is a, c, g, or t
  misc_feature (294)..(294): n is a, c, g, or t
  misc_feature (297)..(297): n is a, c, g, or t
  misc_feature (323)..(323): n is a, c, g, or t
  misc_feature (327)..(327): n is a, c, g, or t
  misc_feature (366)..(366): n is a, c, g, or t
  misc_feature (380)..(380): n is a, c, g, or t
  misc_feature (406)..(406): n is a, c, g, or t
  misc_feature (410)..(410): n is a, c, g, or t
  misc_feature (445)..(445): n is a, c, g, or t
  misc_feature (476)..(476): n is a, c, g, or t
  misc_feature (479)..(479): n is a, c, g, or t
  misc_feature (482)..(483): n is a, c, g, or t
  misc_feature (498)..(498): n is a, c, g, or t
  misc_feature (505)..(505): n is a, c, g, or t
  misc_feature (507)..(508): n is a, c, g, or t
  misc_feature (512)..(512): n is a, c, g, or t
  misc_feature (548)..(548): n is a, c, g, or t
  misc_feature (701)..(701): n is a, c, g, or t
  misc_feature (871)..(871): n is a, c, g, or t
gtatctctntctgccaagtattaagctatagctgagttcataaaaagggatgatttggccgtacggtcatctgccagattctgatgatgattcagaagtcagtgtggaagaagatnagttggagaggcaggcgctctttgacttatcatgctgctccctgaggcncaaaagnttcangtgtcagacttgtnaaatgtcatatatngnntagtngggnctngnccagcatttttnacttantccaggcnatggccagctggaccctntagatggtgctatctgnnanngcnaatnggngctccctccgggggtgcacatagganaggncgctcagcctttaccttcccggggctgtccgtgccagcngctccgcgtgttgnaggggcccgctcctgcttggtgaganagtnagcactgcagtgcctgcaggtaatgtttgcatctnggtgtcgttttcggccattctcacactgttntanagnnatacttgagaccagntattttntnnaganaagaggtttagttggctcacagttccacaggctgtncgggaagcatggtgctggcatctgctcagcttctggggatgcttcagaatcagtcacggtgaaggcagagtgggagcaggcatgtcacgtggccacagcagggacaaggggccggggtaggtgctgcacacttttttttccttttcttttttngagacggatctcgctctgtcgcccaggctggagtacagtggcgcgatctcggctcactgcaagctccgcctcctggtttcacgccattctcctgcctcagcctcccgagtagctgggactacaggcgcccgccaccacgcctggcaattttttctatttttagtagagangggggttcatcgtgtta

SEQ ID NO: 533625 - DNA, 295 bp, Homo sapiens
caaaaattagctggtggtggtggcacatgcctgtaatcccagctacttgggaggctgaggcaggagaatcgcttgaacctgggaggcagaggttgcggtgagctgagatcacaccattgcattccagcctaggcaacaagagcgaaaaactctgcctcagaaaaaaaaaaaaattacaaaaactagcctgatgaggtgggtgcctaatcccggctacttgggaggctggggcaggagaatcacttgaacccagggggcagaggttgcagatcacaccacttcattccagcgggta

SEQ ID NO: 533626 - DNA, 489 bp, Homo sapiens
aatggaataccagatatcatttctaatatcacagcatccctagaaaacagcatcaaatgtaggccgtctctagatacaggccagcatgactagtttaatatgtcaggtttttctacaaaaggagaatcacttctatacataaataaatactgacccgagtgccttatgatgagttctgtattgtttaaaatcatgcattaaagtagcaaaaatattttttagaaattcacaacagttgtctaggtttttcagtggcacattatttagtatgaaaaagtagtcagctggacatgagctacagcttgacagatagagtgcttgcctgtcacacgcaaaaccctgggattggtccccagcaccacatatactgggtgtggtgacacacgccttagtcatagcactctgaacacaggagcaaaagctcaatggtattcttggtgacatagggaatctgaagccaggctgggctacatgaaaccctgtttcaca

SEQ ID NO: 533627 - DNA, 191 bp, Homo sapiens
ccctgtggagggcaataaccctaaaattttccccatggggccaagtgaatgatttagttagtcccttgacatgctgaactattagtgtttttgggaagctggattttatataacctttttttgaaaaacccgatttatgaaattttataataaaattatcaataaagccctttcatttccataaaccttta

SEQ ID NO: 533628 - DNA, 118 bp, Homo sapiens
tgacatcattgatctctacacacgcgacatgtctggggatctgcgtgggcctagaatctgcgctcaacggaggtcgcagagatgctgaacaccattggtgctcagacgttccggagta

SEQ ID NO: 533629 - DNA, 859 bp, Homo sapiens
tggaagtcaaaagacccgttaattaagcacctccggtatggggaccccgggggggtgacctggggtgggggtcaaacctcccggtcatgtattcttccccgtgacctgaatctgggccagggctcaggaaagggaccagccaggggttcaggggcagaggagcagggcccgcacaaagcacgagcgcccacggggtactggtgagggggcacggggtaggcccccgggaagggctgctgcccccaaggaaggtgcctccagaccttcagctccagggacgagtcaaggacgggccagatggccgtgtggggctcagacgcagcgcctggaaggggacggggcctgagtgggcacccagagggtgtccgggtttgggacgcccttggtgggccagccctgccagcctctctggtcgttgtcagatgtctcggtcgcagcctttctctttgaagcgcgggtcttcacggctggatcctggccagctcagcgctagcgctggtgctcaaggtgagggtccttcccctcaaggatcagttgctacgtggtggatctctttactttgcgtgaaagtgggccgccctccagtggatcgtacacattctccggaggaagagggacggaggcggggcggtccgggaatacgtgaccccggaagtgtaagggcaccgaaaatcgctccggtcaaactcaaaatacatggggcgattacaacggcgtccctcagtggcaaacacagcgggcacaaattaacagcggtaatcccacaaaggggggccaaacctggccaggaaaacaggcaagaaaagacgggaatcgcctcaaaaacggggccaggaaaaacaggaaacaagaaacaaag

SEQ ID NO: 533630 - DNA, 382 bp, Homo sapiens
agcttagtttcagtgccagtagcttatgtctgtaccaaatgtatcaacttaattaaaaaatactttcatgctagaaaaatgctaaccttcatctgagactttagccaagtcataatctcatggctggtggagggtttgatgatattatgagaatgaccaaagcgtgacacagagacacgaaggtagaagatgctgtgttagaaaaaaatggtgccacaaaacttcagttggtcacaaacttgatatcagcgaagcatgtacagaccttaattaaatgatactttattgctagaaaaatgctaaccctcatctgagactttagcaagtcataatctcatggctggtggagggtctgaaatatgatgagaatgaccaaagcgtg

SEQ ID NO: 533631 - DNA, 222 bp, Homo sapiens
ccccgactagctcgactgatcacacacacacagacacacacacacacacacacacacacacacacacacacacacagagagagatagggaacaagtgtgttttgtgtggtgggggggaagtgatatgtgtggttggtaggaagaggtaccagtgacttccaaatgtgtgattctgtcttaagtgttctctatttaccaccggggggggcagtagtggggggg

SEQ ID NO: 533632 - DNA, 202 bp, Homo sapiens
ttgcgcttccacattaggtgcatagtaggtgcctgcagtaatgttagcggttaggcgtacggccagagctattgataataactagtatggggatatgtacaagcctataatcactgtgcccgctcataaggtgattgccatggctaggttatagatagttgggtggttggtgtatatgagtggcgccgtcgcctacgcaggt

SEQ ID NO: 533633 - DNA, 283 bp, Homo sapiens
catgagtcacctactatctcccttgggaataagcacataacaggctacagctctaagataagataggtgtaagtccttttaacatcgagctacttacccataataaccactttgcatccaacactcttcacccacctcccatacgcaaggcgatcgtggcatacttggcccaaagtaactggtggtcaggcatcttacaaacaagaccacttatacactgtctgtctagaggcagaagataacagcagcatctcgtctcttactcttgtaacctctacgtctc

SEQ ID NO: 533634 - DNA, 940 bp, Homo sapiens
ccacgacgtccgcaggtgcaggtgccacgccatgagtccccatgcaccccctcctgcggtgaggctggacgtcgcatcatctagtcctcatctgtccacactgagcgtacacatcagagaagacaggacacgtgaatccccgtcggaagatgctcatggatacgatatctcaggaggactacttgcacacaccggttcatgagccagggtcggtggttttgctcatctcgctcgtgcgttcggcgtcatccatggtagaatcactgagatctagcgctgtcggatcaaaggcgtctcagcgtgatagactatctgttggatcgctgtgaagaatacccgcacgatggggaaggcgccctggagtccagggcaaggcggtcccgtcccctcgggcactatgcacttctcttcacggggatcctcgttacgggagcacctatgttgagacgtgattgggaatagatggtcccgtccgttgaggaaactcttagatgctaataggggagaccggagctaatgatatacttggagggggtgcattgttactaggtggctccccagggactcacatgaggtagatggggggtcccttttgaggcagtcgatttaatatatcaaatgggcgatgacctgtatttaaaagacttttgggtgttctgtggggatccaaatggctaaataggggatttcaagggaaaggcgatacctgaaaattcgttttggctcggacaccgtcccgggatggtggttaccctgtagagaattggcagtcacttacgggtgaatattacatatttggcgggtggattattcggggtgaccttttccgaacaatttggtgacggatggaaacttttaggtgatggggatgatcaatgaggatttagtccgggggaaaaaaaagggtataaaaatggggggctcaccgaaaaagggaatg

SEQ ID NO: 533635 - DNA, 794 bp, Homo sapiens
cgacgggctcgtctggtccggacgtagcacctccgtgccgtcgccatgtcgcggtttttcaccaccggttcggacagcgagtccgatgtcgtccttgtgcggggaggagtctcgtctagcaaacctggtcggatgccaactatggctgaacagtcaatatgtttgcctgagcgatggatgaaggaatgataccagagagtatgttgttccgcagtgccaatggacaacgaggtttcgaggagctgaccaaccttatcctggaccatccgtaatgctcatgaagattcgtgatgtcgatccaagtgcctggaatcagttagatgctccgtgggaaatgcttctgggaaggccgaggaagcggttgtggaccgaatgataggtgtcccccgagtttctatactccgcggtcctgtgcctgacctagaggactatcttaatgagctttgggaacgataacggaacgggacaccgaagaagatgaacaagaatcaatgctcaaggtctctgaggctgcttgcgtcggaatatccgaactgtacaacccgtgatttcgagtccctaattgttacatgccgtactagtcagagccccgagcagtctgtggtgggatgctggggctgcctgcggggagtccgaaggtcttcgctgcggatgacgctgccgccggagtcagtgctgtgttttcttggaggtgaaccttcggcggctcctctgcggagagtggcggttcctcaagatggctgctcggctgggggccaagagtccggcatgtggccgctgtggccccgtgccat

SEQ ID NO: 533636 - DNA, 163 bp, Homo sapiens
ataacgaagagtttaacttagctatactaaccccaggttaggtcaattgcgtgccagccgaccgcggtcacacgattaacccatgtcaatagtaagccggcgcttaaggggtacctgagctcgaagttcgatacctcgtggtctatagcgtgtttccatgtgg

SEQ ID NO: 533637 - DNA, 390 bp, Homo sapiens
acagtggctcagtctgtaatcgtcagcggttgggtgaggccgaggcgggcagaccacctgaggtcaggagttcgagaccagcctggccaacatggtcaacgctgtccctagtaagggtacaaaaattagctgggtgtgggtgtgggtacctgtgttcccagttacttgggaggctgaggtgggaggatctttcgaacccaggagttcaggatcatagcagtgctgtgatggtgcctacgaatagccactgcataccaaccggggcaatatagcaagatcccatctctttaaaaaaacaaaacgggacgggacctatcttactcacggtattagtctgtgtcctctagagggacagacctattaggatccctgtctctaaaagggggagtt

SEQ ID NO: 533638 - DNA, 285 bp, Homo sapiens
ccagggtgtgagccatagcacccgggcctgcccccagtctggaccattctactaattcgaaagaacatctgggaatgtcacactcttggaatcatagtcgtagaatccttttttttgagacagagtctcacagttgtcgcccaggctgggcggtgcagatttatatatattttttataattttgttattttatttttttttaatttttatttattattttttttttttttttttttttatttttttattataagggggggggggggaggggggaagagaaacaaa

SEQ ID NO: 533639 - DNA, 369 bp, Homo sapiens
gtctggtattattactagttgttgtgaagacttttttacaaacagaaatctgctagtggagttaaaagtaacagtactcgcgtgcgggcatggtggctcacgcctgtaatcccaacatttgggaggcgaggtgggtggatcacctgaggtcaggagttcgagaccagcctagccaacatggtgaacaccgctctacactaaaaatacaaaaattagagttagtgtggtggtgtgggcctgtactcccagctacttgggaggctgaggcaggaggatggacctgggaggtcaaggctgcagtgagtggtgattgcaccactgaacctcagcctggacgacagagcaataccctgtctaaaaacgaaacta

SEQ ID NO: 533640 - DNA, 877 bp, Homo sapiens
agaccggtatttcctacggctccccgaccgcatttggacagtccgcactcgtgccactaagttgcgtccgcaatatgccgggtttctctttgccgcgtctctgtggctctccgtacccagtccaccggttctcagaaaacacggcgacactctttcctggaccccgcccgcccccaatcgaagttggcgagggcggacccaagctgttgttctagggggctgccccacaaacgctgcgcccggagtgctcccgcgtggtgaccactcgtcgtctgggtacccggcgacgcccccccgtggtgtggacccctgctaaacgcccttttttgtaataggcccctgctccccccggggtattaaaagaccgacgcagaattgcctcagagattattgcgccaccataagagggtgttgacagactcagcccacggggcccgtgggaatgaatccccccccgcccccagcgggtccatcaaacattcgtgcggcccgcttcattggtgggctatcaccttcagcgcgcagttatcggccgcacatcgcctatgacgcactaggggggccgatcctcgtgcccgccagaagggtgtctctgggcgggggcacctgtggcaccacagggtcatgtccccggacgatcctctgttcccgatgtcggatatcggcgaacattcgcccgcgccccctctgtggccacagagtcccagccactaggcacctgtcgttggctcccttccctcgccgccatcctccgtagtttgtggacgggcttgcccccccccccgagcatggtgaagaaccccgcacaacccgcaccgtggtttccaccggggctcgggataaacggaaaatgtttcagggaccgccccaacatgcg

SEQ ID NO: 533641 - DNA, 1034 bp, Homo sapiens
ccaggaaaaagggcccagcgcccacctatctccccctcggggctccttccccctcgcggcacacctccgctgtggacccccccccaccatcggcgacgccctaagtagccgcccctatgacgaaggagcgcccctcattctccctgcctcccttcacacaggcgctccagtctgatccaccgaccacccttaaggacgccgcctgaaccaaaccaacatatcacacgtctagacagcgtctacctggcaggacacacatggatgacccacccaatcacacgcatatcaaagagtccaaccctgcccaagacccctaagcaggggccctcgcaagccctcctaaaggaccctccggcctagccatgggaatttcactaccactcgcaaaacgctcctcataccttagccctaactaaacacaacacgctaaccatataccaaagatggcgcgatgtgacacgagtcagcacaccacgcaacggcccaccacacaccaccgtgtccgagaaaaggccttacgatagcgggataagtccctatttaattacctcagaagtttttttcttcgcaggatttttctgagccttttaccactaccagcctagcccctaccccccaattaggagggcactggcccccaacaggcatcaccccgctaaatcccctatgaagtcccactcctataacacatccgtattactcgcatcaggagtatcaatcacctgagctcaccatagtctaatagaaaacaacccgagaaccaaatatattcaagcaactgcgtcatgtacaatatttacttgggtctctattttaccctcctacaagcctcagagtagcttgcgagtctcccttcaccatttccgacggcatctacggctcaacatttgtttgtagccacaggcttcgcacggacttcacgtcacctaatggctcaactttcctcactatctgcttcatccgccaactaatatttcactttacatccaaacatcactttggcttcgaagccacatgacctgatactgacatta

SEQ ID NO: 533642 - DNA, 370 bp, Homo sapiens
gagacaaagtctcactctgttgcccaagctggagtgcagtggtgtcattgcagcctccacctctcgggttcaactgattctcctgcctcagcctcccgactagctgggactacaggcatgctccaccattcccggctgatttttttatttttagtagagatgggatttcactatgttggccaggctggtcttgaacacctggcctcaagtgatccacccgcctcggcctcccaaagtaaagtgctgggattgcagatgtgagctaccacatccggcctatatccagctaatttttaaaaataaatttttgtagagaggtggtctttctcccctcggccttccaacgtactaggattacaggcgtgagcca

SEQ ID NO: 533643 - DNA, 96 bp, Homo sapiens
  misc_feature (19)..(19): n is a, c, g, or t
  misc_feature (23)..(23): n is a, c, g, or t
tttttttgatttcaacganttangagctcgagaaccgtttggcaatatgtacgacgcggatgaggatatgcaatatgatgaggatgatgatgaaat

SEQ ID NO: 533644 - DNA, 791 bp, Homo sapiens
cacgatcttggctcactgcaacctccacctcccgggttcgagcaattctccttcttcagcctcccgagtagctgagattataggcgtgcaccaccacacctggctaatttttgtatttttagtagagacagggtttcaccatattggtcaggctggtcttgaactcctgacctcgtgatccacccacgctcagcaagtgctgggattacaggcgtgtgagccaccacgcccggccatgaaatatttttacttaaaaattgggaataagcttttcggtttttcgtgggtttttgtttttgttttttgttttttgtttttttttttttggagatggagtctgtgctcctgttgtgcaggctggagtgcagtggcacagtctgtggctcactgcaacctccacctccgtgggttcaagcaattctcctccttcagcctcccgagtagctgggattacaggcatgcaccagccacaccgtggtaatataagggtttagtaagagaccgggttcgcaaatttggggcggggggggttcaaaatccccgactccgagtgggacacccgcgctaaagcccccaagggtgagaataacaggatagaacacggggccgcagatataaattgggatccccatacaagtggggcatcgcgagatatatagagaacaacatctcagcggaaaacattatctagacatgcgcgacaaaatctgtcaccagcaattaggcacaccgtgtccaacctctctttcttttttctttttgtcttattactttctccaaaaaagagaaga

SEQ ID NO: 533645 - DNA, 108 bp, Homo sapiens
gtcatgctctttgtagcgtggtgcttctgttgctcacaggacaacttgcctttgatgattttcaagagagttgtgctatgatgtggcaaaagtatgcaggaagcaggc

SEQ ID NO: 533646 - DNA, 444 bp, Homo sapiens
ccagggacccccggaactggtttggatgggttctcttatgcttagtgaggtctgataactgcttaaagatgttgccacattcttcacccttgtctggcctttcttcaaaatgagtcctcttatgccaagaaaggctccacctggttctgaaaaccttcccacattcttaacatcggtagggtttctctccggtgtgaatcctcctgtgttcactgaggtgtgaggactgtgtataggctttcccacattcgtcacatttgtatggtttctcaccagtgtgaattatcttatgtttagtaaggtctgacaaccacttgaaaatgctgtcgcattcctcacatttgaaaggtttccctccaatctcatttctttggtgtttggaaggatttgggctgtggttaaaaccttggtaccatgtttcacatttggagagcttctctccag

SEQ ID NO: 533647 - DNA, 143 bp, Homo sapiens
ctggagcggagcgtccttgatcgcttcctccctgtgcactgatcttggccccctcttatttattttacatccttggcaccccacttgcactgaaagaggttttttttaaatagaagaaatgaggtttcttaaagcttaaaaaa

SEQ ID NO: 533648 - DNA, 145 bp, Homo sapiens
cttggccaattatcctcaagatctcctacaagaggagtaacttctatattaagatccggccgtgattagtatgagcaatttgagagcacaattggctttagagctcccaaaccaccggtcatcgcaagagactgcctcgccaaat

SEQ ID NO: 533649 - DNA, 301 bp, Homo sapiens
tcatcagtgctcccaggtcacctcccaagcctcctacaggctgggacacccaagatctgtgtttctctcaaccccattccagcatcttagcgagttctccccaaacacacaaagaacaaactgctgacctcaaagcagattaaccaagttttccctaattcaagccactgaaggcaaaggagtcagtgacagagaacaagggactgtgacaaggcaggagttgggtgagactgtgttaagaagagctacattttacaagaaccattcaggactccctttcaacctggtccacttaaaacaa

SEQ ID NO: 533650 - DNA, 282 bp, Homo sapiens
atgctttgaaaactgttggatgaaaaaaaaaaaaaaaaaaaaaaaaacagttctcaagagctaacaaagcaaataactggtgttaaatactaagaaaaattttaaaaaaattctcataaaataggaaaaagtcagtatttctcacttagcattttatatgtgatttatctgtgaccctaaatatatatagctaaaaaaaaatgttatgaatgggtatttcacatgcctctgtaaacatttacatattctgttcaggttactcccctccaataaaaacaaaac

SEQ ID NO: 533651 - DNA, 233 bp, Homo sapiens
  misc_feature (128)..(128): n is a, c, g, or t
  misc_feature (130)..(130): n is a, c, g, or t
  misc_feature (147)..(147): n is a, c, g, or t
  misc_feature (164)..(164): n is a, c, g, or t
  misc_feature (167)..(167): n is a, c, g, or t
  misc_feature (186)..(186): n is a, c, g, or t
ttgtaaatgggcacagaaattcagtacctgcttagacagcatcggtttggctgagctgagggatcataggagtgctttttatggtgttgaatttctttgaaaatttctttagaactctggagcccagntnccagggtggagtctttnttctcccactttctagntgnctgtccttcagcaagtacntaatttctgggcctaatttcctcatctgccaactttactgaaccggt

SEQ ID NO: 533652 - DNA, 612 bp, Homo sapiens
agcggacttaagccggcaggatgtcggaggtgcggctgccaccgctacgcgccctggacgacttggttctggggtcggcgcgtctcggcggctcccggatccatagcagacccgcgagcagatgagtgaccgagccgcgtctatcaactaacctccatctaacgtaccaaaccaaactaccgttctctgcttcggcatcggcctcgctctcgccgggttacgttgcggccctacttcattactgcctccctcgagcagcgcatggtatgtgtgcggtggccctctggcgatgcatggatgtgggcagtctgagacccgcgactagctgtgcgccgcgtgccgtcagtatgcgactcctgtcgatgtcctgccttggccgatagttgcttgccgtctggcctccgtggtgcttctgggtcgcgggcggcgcttgcgaccttcctgttcagcatcgccgggccggtgcttctgatcctggtgcacgcctcgttgctgcctgcgctaaccattaagaacaaggattgagaacgagagatcgagagcattggtctcaagcggacgccaatgggcctgctactagaggcactgggacaagagcaggaggctggatcc

SEQ ID NO: 533653 - DNA, 278 bp, Homo sapiens
tggcccaagggaaaaacaacccagtgaaaaaagggtttcccgtttttaaataaaaaaactccagttgaaaaaaaaaaaaaaatttcctgttccaaaaaatgttaacccccttttttgggttaaggaaaaatttttttatgggaaggggtttgtttttgttttttgtttttgttttttggttggattgggaaaaaactttatggggaacttccttatttagtttttagggggcaactttaaaaaaaaaaaaaaaggggtgagttagttaccccccccta

SEQ ID NO: 533654 - DNA, 424 bp, Homo sapiens
ttaaaaccagccctgtcgctctctagctgtacgtggcttaccacgaacttctactccactgggccggtgaccctagctgcttggattggtctggtggagggcgaggaacccttaccaccctccgggaaagagaggtcacaagaaaatcatacagagtgcaggacactatgtggtcacttggaccattacctcctccctccttggtgcaccaagtggccagtgagccagtacaaggcccacctgtcagcgccaggggattcagcaccccatcctcagccaggtgcagcatgcctgtgctgatgacaggacccagataaaggacagcacggttgtagcgtaatgaagtaaacacgaagaaggattttcatcctctccaaaaagcaccttggagatgtggaaaatacaatagttaaattattacctt

SEQ ID NO: 533655 - DNA, 841 bp, Homo sapiens
  misc_feature (841)..(841): n is a, c, g, or t
gtttttttgttatcttttatttgggcaagggaaatttattataaaataccctcagcgggcaacacaggcggtgcccaagccaacgtctcctgcaggccttcggagggccagggcctctgtggggtggcccccaggagctcacggctccgtgtgtgatggaggcacttccacaataaggaaattaccaacctctcatgtgaaaacaggcggggacttccagtggctcctttgggcccatgtgtacttgtgcggggctcctctctagagaggcctctttgtgaggttttcgaggcccagagggcgtgggggcgcgtgcagtgccccacctctccctgtgccgcgccccctccttcgttcctccgcgggaagaggggagtgtggggtggagtctcaagtgcggcgtgtgggttgagaagtgtgcacctagaaggggcgtgaaactccggctgcactcccttggagagacgccccggggggccacggccaaggggccaatcgggagggggggaaaaagggccagcgcaacggtggacacagtgtggcgcttgtggagaaaggcgcccaacgcaacggagcaaagagtggcagtgcattcggcccgggcacaggagagaaacaccggcggggaattcgccgaggtaggaccccgagggcccgtggggagggtggtaccaagaggcactcacgtgcgcgaacaccgtgggcgccgggaacccgaggagacaccctgcgggggggaaacaccggggaaaatgagtgggagacagatatacacaaaaagatccccacagggcacacctgtgaggaggagaccagtgtctggacgcccaagttccccgan

SEQ ID NO: 533656 - DNA, 270 bp, Homo sapiens
cacgaggcgagccctagcggcggctgtggatccgggggcggaagaggaagctgcacacccggtcccgtagggtccccggcgccaggccacgcggccgtcaccagcatgcaaggtaaacgcagagcactgaacttgaattttgcagatccacctttcaaatctacaggatgggttactctgaatcccattcctagaggagttcaaaacccacacatagaattcggtcaacagtggttgaaaaacaacagcatgaacttcttatggatttgg

SEQ ID NO: 533657 - DNA, 405 bp, Homo sapiens
tcagccggtcccgcagctcgctgtcgctgggactggggcgcccgccactcgcccggctgatttttgtatttttagtagagaccgggtttcacaatgttagccaggatggtcctgatctcctgacctcatgatccgcccgcctcggcctcccaaagtgctgggatcacaggtgcgagtcaccgtgcctggccaactaatgaaaagtttaaagaatttatatctagttttggatgttaggcatgcacacacaagtgcatgcacactcatacacatcatctccacaagccccatcctggctcagccctattctgatgggtcagcaggaccccaaggagagaagggtgggtccttggcactaagacagttcaccgtggttagctgactccttctgtgctccattctttc

SEQ ID NO: 533658 - DNA, 1276 bp, Homo sapiens
ctggatcttcccagcgattcctcctctacgctccctcctcttcttcaataaccccaaagagcaggagaagaacgtgcccgcgtgagctgctacgcagaccaccctctcgaccatgccccgggtgaggggggcggtagccttcagagcggcaacttgcacagcggactgcctgggacttaggcctaccgagctacgcgctcccgggacgcccggaattgcacggccgcagcccggttgggggcgctatcgtctatgtcttctatggttgccgccatgacgacactcggggtctcgttttttgctgtagaggagcccacgtgttggtggcttcatgggtggcttgctgccggtccgccggacgcggcgctgacgcgtgctagtgacggctcctgtccgccgcgtgggtgctacgagaaagagacatcgctgatgcgcgggaagaccctctcaaggcatgggaaggcactcggacagtgtgtcatgcgacaatctggggctgcacattctcgtcgaagcccagacgggggacgattttggccgcgaaacaattcacagattgcgattatttggatcctatgcgaggagttgacctagtcccttggaccagggcttgatctggcgctgtgtgaagtgccgatgttggtgcacttcgcatcgggaaagttgtgtcgcagaacttgttggtgattgctgttgttgcttgccccggtgttacgggggcttcccccccattttccccccccggttgattccccggttcgaggctggattgtgccttggggggcactgcaggcaagttcaggcaccggcactggcccagctagtgtcctggggcagcagatggcttgtcctcctttcgttcaccgggcccaaattgttccaatgcggttctttgcgaattactacaagggtccaaaccaagaagattttcaatctagaatgttgattcccaattggaaagcgagccttgggctcgcggcacatttacctgaggtgcacgccgtttggttcccagtgagccacaagcgcccttttttggccttaccacagggtatccccttatcatctaatcctggggcacgactttgggcctgcaaaccctcaaggccgttggggaagtctttttaggccatcctgttggtgggcgacacagcgggccggaatcggtccaatgtctacacacataggaagagacccagcttcaccaattgattctttcgaccccccatttttgaagaccgttctacgccattttaatcgacgtggcttggggcat

SEQ ID NO: 533659 - DNA, 792 bp, Homo sapiens
gctcttagcgtggtcaaagccatctgtagaggagtcgccagaccaacggagtgctctcggaggcgctttggagcccaagccccggtaaggcagcgagttaagactccgacgggtcctctgccgtacaagaagatcctgggcaccttccagaagctcaagagcatgtcgcgggccttcgagcaccaccgcgtggacaggaacaccgtggcgcttgaccacgcccatcgccgagctgctcattgtggccccacgagaagctggccgaggtgggcgagttcgacccctccaaggagcgcctgctcgagtactcccgccgctgctttctggcctggacgacgagacgctcaagaaggtgcaggcgctcaagaagagcaatctgctgctgcccatcacctaccgcttcaagcggtgatcgcaccacgccatccgcagccatccacaccgggccttcctcccccgtggaccccggtggatgaccatgccacacatcatcccacgcacagcgcaccactgcccccatcgatccatcgcatccactgggatctgggggctcccattagaccagggccacaccaagcagcgacaggccccggaccggcacgcggcaccacttcccgaacgccggcacccccattccgcttgggcatgcaccagcccatgtcctcgccgggccccttcctcctggaaaaccaggcaggcagggtgcccccccacctcgagtgggggactgtacagaccccgtctccagccatggccccgcggaggagctgccacacctgattcccggacaga

SEQ ID NO: 533660 - DNA, 107 bp, Homo sapiens
atgttgctgaccatctcctctactacctcttccctgtgctgttacacagtgtctttgttgactgttaagttaaagtcactattcttgcttcctctccagaaaacaca

SEQ ID NO: 533661 - DNA, 410 bp, Homo sapiens
gtgaagatttgttacttaggtaaacccatgtcactggggtttgttgtacagattatttaatcactcaggtattaagcccagtacccaattgttatcttttctaatcctctccctcctcccatcttccattctcaagtagaccccagtgtctgttgtttccttctttgtgttcataaattctcatcatttagctcccatttataagtgagaacatgtggtatctggttttcttttcctctgttggtttgctgaggataatagcctctagctacatccatgtacccacaaaagttataatctggttcttttttatggctgcatggtatccatggtgtgtatgtaccacattttcttagtcaatctgttgttggtggaaatataggttttcatgaaaagattccaagtttttg

SEQ ID NO: 533662 - DNA, 807 bp, Homo sapiens
gggcagttctgtgtcgctaggcttctgcccggcgccgcgacataagctgcgaggaggagctttacgacttcccggtcttcggggccgggcgcagcaaggggccagactctgcgctaggcagggcgctgcgcggccaaaccggccgggcacctgtcgcagaatggtgccaacccgattcgcactgtcgcgcaaaaaaagctcctcaaatggccagcggccagggttgcaagccccgggggccggcccacaatttcggccttcaaattgtggacgcctgggtgtggagcagtcccgtgcttacttccaattcaccatgttgggacttaggctacacactttgcggacgagacttaccctaacatattggcaggaaaatccggcgaggttggacccaaggacttggtccaggaattggccgtggggtaaacccgagggggtgtggccaaggttgcgtgtggggacacaaagtaacttttcacagttgggggcttccctttaccaggggcgaaccatgttcgcgcaggacaccacggaattctttccaattttcatttggtttcgcgcccccagagggggtgttggaattctctttgtgggaaattcctttctcgtggcgccattcagaaggtgtggacttccctttccacagagactcttgtggctttcttcccaccaaaaaatgggtggcggggggactttcacacatggatttggttggacctcttacgcaacaagccccaaagttcaaaagcggtggcagggacggggttcacccacggttggggattgttacggctctgggatcga

SEQ ID NO: 533663 - DNA, 533 bp, Homo sapiens
  misc_feature (157)..(157): n is a, c, g, or t
tggaaaacaacaccttatttattcagggtgtaatactgtctacttcctttcagaagacttgaaaaagatcaaaataggataaatggacagttactactaaacgattcaaatacttgggcagtatcttttttttccccccccctcccccctctttttnaaaaaaaaaaaaaagacccccccccccccccctctcctttttttttttttcacacgtttttaaagtgtcaaaattgatgaatggtataaattcaaaaggaaaattcttttctactgaaaaggacatccagctcgcacaaacggtggttcagctgaaggcaaggcgtttctggttttcctctgcactcgggcggatcgttaacttccccaagttaaaactgagttgctctttccaggcttttcgaagcatctttaagtttccccaccaagtcctgtaattgttccatgctgcaactaaaactaatctctggataggatggggaatcagtgttctgtacacttaaggtcacccaaaatgcagggctgtacatcctatg

SEQ ID NO: 533664 - DNA, 126 bp, Homo sapiens
ggtcaatttgctacacatttgtcagtatttttgccggctggtgaatcaaacaacctgcccaaagattgatttgtgtgtttgtgtgtgtatgtgtgtagtgatgtgtgtgtgtgagtatgagtagag

SEQ ID NO: 533665 - DNA, 869 bp, Homo sapiens
agcgatcgtgccgctgcgctccagcctgggtgacagagtgggactgtgtctcaaaaaaaaaaaaaagaaagaaagaaaaattaaccatcccagccataatttaaccagccccttctctttgctaggcagttagttggatcccagttttctactatgcacagaacatcttttattatacacacactttttctcccctttcttgggattctcaactgtgctatgtgatccatgctcgttttttctcctctatgcagggcgatatagcaaagagcacagggctctgggaatctggacagatctggggttcaaatcctgggcttcccttcttaatggtataacccttaagcaagtttttaaacttctctggaggttccatttcctcatctgtaaatttttagaattaataattcccttatgaggtggtggtaggattacctggtgttaaccgattactgaattcaatgtagatacagcactttagcagagaattatggtactttctgagtaaatcctcagtgaatatgagctggctgcaatggcatgatgacatatgattcttcatatcatggtccttattcagattcatctgcctccaaatggggccttaccccaattccgaggccggggaacttcgaagccaagagaaatggaggaacttttccaaaccagtatatctcagatctcatgatgcaagtttcctaatctagaggaaagttaatgtctgcaaatgatgagccaactagttattgacttgtaacgcagattggcaaaacacttcctgatcaggggccaaacttcacctgtctcttacaacctcacaattgattttcccctgtgactctcaactcgactttccttaaagctttcac

SEQ ID NO: 533666 - DNA, 965 bp, Homo sapiens
tatctccgtccggcttctctcctacctaagtgagtgccgacacccgatggaagattcgatgggacagtggacatgacccccctgaggccccagaactatcttttcggttgtgaactaaaggtcgaaaaaagattatcacttacaaggtggataatgatgaaaatgagcaccagattatctttaagaacggtcaagtttacgggctggtgcaaaggatgagtgcgcacatgtagaaagacagaggccatgacattacgaaggcagtccaattaaagtaacactggcaaattagaaatgtctgtaacagacaacggtttcccttggaggctcagaaataacaccaccagtggtcttacggtacgaagcgccggatgcacgggacagagcacttattacatggaaaagacacaaacaccgacatgtggacgaacgatgcagagtcagaacaatagacaaaggaggaagcgatgtgaaacactcacaccataataccggaaaagcggaatgaccccagaaggagagcagcaaggatacaaccagaaaaaacagctaacacaaagatcgcagaccgaacgatcgatgacgacgatgcgccagaagaggactcagaagatcacgacagagacgaataacagaagaagaagcaagcaggaagaaaggctgaccaagaaagaagaccaatagagaaaaacaagcgagcacagacaaggcacaccgcagaacacagacgaacacgaaccagacacataaagcaacaagccagaagcaaaacaccaaagaagacgaaaatacaaacacgagacacaagagaaccacagagaaagcaaacagaaaggcgcctcaaggaaaacaacagtgaagcgccaagcacaaagcagaaccacaagaaagagaaagacaactctaaagagagaagacaacagacaaaaagcggacaggagaaaaaaatagcagaggacacacaa

SEQ ID NO: 533667 - DNA, 131 bp, Homo sapiens
  misc_feature (9)..(9): n is a, c, g, or t
actgcgtanaccaggcacggtggctcaggctgtaatcccagcacttaggcaggcggaatatggcggatcgacttgagcttaggagttgcagaccaacctgcacagcatagtcaaacccctatccctaccag

SEQ ID NO: 533668 - DNA, 194 bp, Homo sapiens
acgcacacgggatacatgtgatatatgcaaagtaggcacagtttcttagttacagaacgttcaagcttcacatttagtgcagtagaaacaaaagtaggctacagtctgtgccatgtagatgtacagtttctgaaatagttttacacagactttgatacatacaaacccttaaacttatgttacgttccactatt

SEQ ID NO: 533669 - DNA, 169 bp, Homo sapiens
tggattggagctggctagaggacaaaatgagaagatttcataaaacagggagcccatttgttagaagggcaaaatgaagtagtatattttattatactgatgatcatgtgtttgaagattcatctgacatctggattatcaagatatatactggttgcatagaattctc

SEQ ID NO: 533670 - DNA, 407 bp, Homo sapiens
  misc_feature (24)..(24): n is a, c, g, or t
  misc_feature (32)..(32): n is a, c, g, or t
ggaagtttataataaatgcctacntcaaaaanagtagagatttcaaataagctaacgatcccctcaaagaacgagaaaagaacaaaccccaaatttatcagaataataattatcagagcagaaataaatgaaactgaaacttaaatgaaaagttagttgtttgaggccgggcgcagtggctcatacctgtaatcccaacactttgggaggctgaggccggcagatcacaaggtcaagagaacaagaccatcctggccaaaatggtgaaacccatctctactaaaaatacaaaaattggctgggcatggtgcgggtgcctgcaatcccagctacctgggaggctgaggcaggagaatcgtttgaacccaggaggcgtaggctgcaatgagccaagatcgcaactgcac

SEQ ID NO: 533671 - DNA, 421 bp, Homo sapiens
tacaccgagggactcctggttaaccggcctccgtgagacaaaggagccaagagatatgacccaggtgtgcatctctccagtagctccagagtcccagtgctcctgctttcttctcctgaaccagctgatgacaggactaatcaggcagatacatccagcataaaccgaggtgtatatacgagaaacctaacagatcgtgctgaacagaactcataaggcagtccaggcatcttgatccacactcgtcccacagtggcccacttcaccttcagcagcaagtgcacaaaggtgcaagcacattggcatcaatctccatccaaacatgcacaccaaagagcttcgcaatcaggcaatccaaggtctttgcatcagtcctcattccagcagccaaaatccgaacaggtcagcacagacaagcagc

SEQ ID NO: 533672 - DNA, 309 bp, Homo sapiens
gaagcgcacgatggcgtgccacagtgacaatgaatggtgatgattgaccaccaccggaacagtatgaaaatctaaaatggacacgtggagagaaaacttgaggagctcgacggtaagcttgctctggcgaggacaggaactggctgctggagtttgaatcgaaaatgcggaacagggagcacgaattcctgtctgcaggctgacacacatgaggcaacacagccttgtccccgggaggccttaagggttaaactaactgcacaagagagctggaggctctgaagggaaagccggggcaaaggcttgcag

SEQ ID NO: 533673 - DNA, 298 bp, Homo sapiens
  misc_feature (94)..(94): n is a, c, g, or t
  misc_feature (177)..(177): n is a, c, g, or t
agacaaacatctacaagtacaaaagacagtccatggaaacatgacctcaccaaatgaactaaataaggcaccagggaacaatcctggagatgcngcgatatgtgatctttcagtgcagaattcaaaaaagctcttttgaggaaactgaaagaaattcaggataacacagagcagganttcagaattctattagataaatttgataaattgaaatagttaaaaaggaatcaagcagaaatttgggagctggaaaaatacaattggcatatttgaaggaatgcattcagtgtcttttact

SEQ ID NO: 533674 - DNA, 562 bp, Homo sapiens
gcgaaccttcggctggacaccaagatgcctggcgaacagaggcagaggaagaggaggaggaagagatgcaggaggagatggtgctgtggtgaagggtgaggaggatgagggtgaggagaactatgcagagtggatcacactcaccgagtcacccgagtggacgcacgaaagacagccgcgggagcagcaggcgccgtggccccacccgccgagcgccgagcgcagatacaccacgtcagatgccaacgagcaccagctcgacccgcccgtacgacgacgcacgcaacccaaccaccggcgacacacaacgacagcacaagacacacacgacacaaacgaacacaaacagcagacaacagacacagacagcagcccacaccacgcaaacagcacccgcggaccgcaccaacagagccccaggcagcccacacacaacccacgagacaaaaacgcaggcccaagccaacaagcaaaccaggacaacagaaccaaacacacacgagcaacaccgagccacaaacgccacagacgaaacacacgagcaaggcgaaaacagaacaag

SEQ ID NO: 533675 - DNA, 361 bp, Homo sapiens
gaataaaggctcagggaccggcagttctactctggagcccaccagcctctcagtagctccggtgactggcctgtgtctccccctggatggacatgtggacggcgctgctcatcctgcaagccttgttgctaccctccctggctgatggttccacccctgccctgcgctttgtagccgtgggtgattggggagcctccccaatgccccattccacacggcccgggaaactgccaatgccaaggagatctctctgactgtgcagatcctgggtgcaatagggcacgcgaggaggcaaagcttcctcctaaatcaagcatctttctgttactgatgttcaataaaagaatatgttccaaggctg

SEQ ID NO: 533676 - DNA, 299 bp, Homo sapiens
ttttttttgccaagttggggccaaaaagggcaaggaaaacatggggggttagggccccggggggttttcccgccccagccccccctttatttaaaaaccccctggcccgggtcacccaggtggggtcccccccctgccggggccccttgtgggaatgggtttcccgggggaaaaaattaatcccttttcccctttttgggaaccggcccccgtggaaaggggtgagggtgggggggtgttccgtctccccccccctcccgggggcccggtttccaaaaaaaaaaatttgcccttttcca

SEQ ID NO: 533677 - DNA, 988 bp, Homo sapiens
  misc_feature (49)..(49): n is a, c, g, or t
  misc_feature (103)..(103): n is a, c, g, or t
  misc_feature (199)..(199): n is a, c, g, or t
  misc_feature (436)..(436): n is a, c, g, or t
  misc_feature (510)..(510): n is a, c, g, or t
  misc_feature (653)..(653): n is a, c, g, or t
  misc_feature (660)..(660): n is a, c, g, or t
  misc_feature (688)..(688): n is a, c, g, or t
  misc_feature (712)..(712): n is a, c, g, or t
  misc_feature (730)..(730): n is a, c, g, or t
  misc_feature (737)..(737): n is a, c, g, or t
  misc_feature (744)..(744): n is a, c, g, or t
  misc_feature (763)..(763): n is a, c, g, or t
  misc_feature (775)..(775): n is a, c, g, or t
  misc_feature (814)..(814): n is a, c, g, or t
  misc_feature (823)..(823): n is a, c, g, or t
  misc_feature (830)..(830): n is a, c, g, or t
  misc_feature (847)..(847): n is a, c, g, or t
  misc_feature (877)..(877): n is a, c, g, or t
  misc_feature (886)..(886): n is a, c, g, or t
  misc_feature (897)..(897): n is a, c, g, or t
  misc_feature (899)..(899): n is a, c, g, or t
  misc_feature (910)..(910): n is a, c, g, or t
  misc_feature (947)..(947): n is a, c, g, or t
atgcggatgtgggcaatcacactgccctgccaccattgccacagttacnatattaacagggcttttcccctgcacatgttcactaggactaaagctgtgactngctgtggaaggattttccaccttcactgaatccccccgtttctcccttgagtttatcctcttatgtttaacaaggcaagaaatatagaagtaagcnttctcacactcatcacagccatagggtctctctcccgtgtgagtcctgtgaggtacaatgagcattgtctttgtaaggaaggctttcccacagtgactgcatttatagggtttctctcctgagtgaattttctgaagtctaaagagttctgacttctgtgaacagggttgcccacattcaggacaaacaaagggagtttttcctgtatgaaaactctgaagtgctaaaaggcaaganttctggctgaaggccttgccacagttaatgcatccataaggtttctctccagtttgagttcgttgatgtttgtngagattgcccttctgaatgaagccttttccacattcactgcatgtttgaggcttctctcctgtatgagtgcgctgatgttcaacgagtagtgattttctggagagagctctcccacattcgctgcatttatggggcttaattnccgtgtnaattctttgatgttcagtaagctcaganttcctggggaaggctttcccacantcactgcacccgtatggnttctctnctttgtnagccctctcgtgttcagtnagcctgttcctnttgtagaaggcttttccacaaaagccacaaccgttgggnttctctccnctgttanccctctcgtgttcagtnagcctttgcttcttgtagaaggctttccanaaaagcganaaacgttgggntnctttctgtttnattctcttatgcccagtgagcggagacttctcgaggnagctttccacagtagttcattatgggcttctctatttgttt

SEQ ID NO: 533678 - DNA, 139 bp, Homo sapiens
taacgtacaaccctaacataaccattgttaagaacctatttatgtgatcctaactactaccgcatgcctactactcaactgaaactttagcactacggggtaccgagcatcaaggcctaatcatggacatatgggagct

SEQ ID NO: 533679 - DNA, 394 bp, Homo sapiens
ttctttgtaataatatcattttttggtgaattccttattcatattgtgaattaatgatttttttattgtttatttgcttttccataactcacagacctcatttaatgtcattattctgaattctcttttacagatgtcatgcatacaattttcactgaaatctgctgctggagaattatcttattttgttgttttgggggtgtcaaatttttaatttttttaaaaaaggtttattccaatttcaatagcttttggggtacaatttttttgtaatatggatgatttatatagtagtgaattctgagattttagtgcactcatcaccaagcagtgtaccttgtacctaatgtgtagtttttttatccctagaccccctctaccccctctagagcca

SEQ ID NO: 533680 - DNA, 114 bp, Homo sapiens
ctagaggattccccaatatacatccacgagcctgaatgccttcctcagagttaaaaggacttcataatgttcacttccaatatgatctgacacctttctattcagctcagtaaa

SEQ ID NO: 533681 - DNA, 132 bp, Homo sapiens
gactctacaggatcttactatacaccacttgagtgtttaggtctatgtatcaaacagttctgggatgataaccctgatttactgcaaaacttgaaattgctctgcaatttctgctggcaatggtggtatcag

SEQ ID NO: 533682 - DNA, 748 bp, Homo sapiens
tggaaacggggttttgtttttgcccaggcggattacgtttgcaatcaacgttgattggcagctttgacctccaggggctcaagggatcctcctgcctcagtctcccaactaatgggggactacagggcactgtgccaccatactcagtttttttttggtttggtttaagacaaagatgtctcgcttgtgttgcgcccaggctgggtctgagaatcccggggctcaacgcaatttttccacctcagcctcccaaagtgctgaagattacgggtttgaacccatgtgcacccaccccttcaaaactactttaaaagtgtctcgtgctcgtgaacgtgattgtgagaggaatttgtaagtttccagctgtgcgtgaatatttcgagctatttctgaacactcgggaatctttttattcccctatttgggggctccctacttaatttaataagagtcgtggtctatattagacagggttctcgggagagatagtttggtcataatatttaaatccataagatgtgctccatagctcatcagtcttatttcagtaaaaccattttttgggccaaattttctaacacgttttttacttcagtaggtgagggcatgaaaacgtttttattaaagaaagatcctattaaggggctaattgggttttggaaacgcttgcctgataataatggtccagtattggaggatataaaagaaggatgtgccttgacctggtgttgattgtcagcttttttac

SEQ ID NO: 533683 - DNA, 117 bp, Homo sapiens
aggcaccaaggagggcgacggggccgagcaggggctgccatagcactcagagccactggaggacagggactcctgcacatcctcgtcctcagccacctcccctgcctctgcctctgg

SEQ ID NO: 533684 - DNA, 689 bp, Homo sapiens
  misc_feature (351)..(351): n is a, c, g, or t
tcagcccttgccaagctctgcctcttcccccgctgactgggcctctgctgagatgtgggcagctggtcaggatggtcattcgggctcatggcacagcaactgcatgcccatgactcacgacattggtgtgaatgcaaacatggggctggacaggccatggagagcctgtcggacagtgatcctgagatgtgggagttgctgcagagggagtaaggacagtgcatgtgtcgtgtgcctggagctcattgaccgtcagatgatagctattgggtggacgacagagtgtggttggcatgaagatttgatgcatgacttgttgccgatgcagtcacgagtggccgtatgtggaangactcgtatatggacgcagttgtgcattccttgacgacatgattggagtgcagtacacatagttcacgaggccgactacgtaccagtggtaccccaagaccaacctggccgtctacactagcccttactgcaacctcacgaccggatcatggagctggacctgcccgatgggggccatctcacccacggctacatgtctgacgtcaagcggatatcaggcacgatccatcttcttcgagtctatgccctataagctcaccggcttaagcatgtaagtgtagtctgtccaagcccataactggcctcattgactacaaacagctggacattgactgcta

SEQ ID NO: 533685 - DNA, 713 bp, Homo sapiens
agcgggaaatagagccgagggccggcggtggtggcggccatgttgggagctgcaggtccggcggcggctgcctgtgttccgggcgcggagcgaatgccgctgagggcaggggaggagcgaggcaggcggtcggctgcggtggcgagagtaggcgtgaccggcgcggcccgggcgaaggcggccagtcccagcctgggggtcgtgaggtggggtgcggtccgagaagtccgctcggaggccggcgtcggtactatgacgctgaggtcggtcgcatcccagggactagttcgtgagccggctgacaccgggtactcgaccggatcacccggcacgctgcccatgacagactgggtgcttgtgctgtgagaacgtcccggaccggacacgtgacttcacgaggtcgatttccctttcaactgctgatttgcacatggaatgcatttattaggagatgtacccctactcactgatacgacatatcagcgcagcctatggatcccatggcagccttgtggaagagccacccatatagcgaatgccgttggaaacgagacagaaaggtgtataaccgagaggttagggatacaatcatgaggggtaaaaaaccctttgaagttgcaataaaactaaaaaaggttgaattaccaaatgaattgagcatacagagggaaggaaacactcaaaacatagttctgaattgtaaagaagcccct

SEQ ID NO: 533686 - DNA, 664 bp, Homo sapiens
gcacaaggcaaataatccccatgctcagaatgaatatatagagaaagcaattaaggaagaaattgacccctacgtataagagagctccaagatattgcattcgcttaaaaagagataattgaaggagatgatagatgcattttatgatgaaggagaaagcacatctttcgttgatcttaaaggagaaatgcataaacaagcacagttgcatcgcacactttagaagatcaagatgatgaacccagagttcattatgagggttgttgtcctcgagatgatacgtccgcatagacattgaacaatgtaccctgtgaatctgtgcagaactttgtccataattaccccattatcctgtgtaccttgggcaacagtgaggtaaatgttggctacgtgcagatgcctctgaagatacatcgctgttctattaaaagcttcaggcccagagactcaatcactctttattgttgagcggcatgaggggtcagaccatccccgtgtattataatcgctgaccccaatggcctttctaaggcttctaaagcctcccacagatacggtgcaatggtgagcattccttgagggacccatcagttcacaacaatccggcttttatgcattacagtttgacaggtccataaagattgctggggattaaagctgctgg

SEQ ID NO: 533687 - DNA, 870 bp, Homo sapiens
cacgcgtcggtgagaccaggattgacacgagatggcggggttcgtggtgagacgccgtcacggagtcgaaatggtatgcttacgaagcagattctaaaagcagtttctcttcagaacatctttattcataccacttgataagcatctagaaagaccatgtgtgtagactgcagtacaatgggtgatgtcaaagagaactatcttgaaacattatttccagtccaaaatggagctttatattgtgttagtcataaatctacgtattctcctctaacagatgactataattgcaacgtagagcttgtctgacttctgatggcaggacaaatagtaatgctaccacccttctgtggacattccatatgaacaccacaaaacctatccctcgagcagatcctgtgccatactaatgaagaaacacatgatcaagtgctgaaacaccagataggaagaaacaagttgaacaccttgaggaaggccctatgatagaacaattagcaaaatgttctttactactaagcaccgtggtatcctcatggaccggtatcacagatgtcgtaagaatctgaatcctccacaacgaaacgatgatgcggccaggtaccttgagggggatccaaagacgacacagtggctccatttgccatttgagaaacatccagctggggtatccagaaacccgcacagacaaaggaacaagcaccaaactagaaggacgaaaaagaaacagaagaaaagcaggacaacaaaagacaaacaaaaacagaaaacaagaggacaaaaagaaaacacaagacacgcacaacaaaagacaaaagagaaaaacaaacaaaaaaaagaaacaaaacgagcaaagagaaacgaacaaac

SEQ ID NO: 533688 - DNA, 513 bp, Homo sapiens
cagaatgtgtcttatgagcggacgcaggtttgacatgtagctccagctttcctcacagccgcactgagctggggccatctcttgcctcctgagaggtgggtgatggtataccttgtcaaacatgtttccgtaggatatgttgctgatttgtgggttgaggagaggaggctgcaggatagggttgcaagagcctagatgcagcattaacatcctggttggacccttacagaaacccttctattcctatgatccttcgttttctacgtatcgtcaaaagtagttcatgatcagggacagagcagagggctgggagagccaaggtgaacagagtcttaggcctttaagacttcatcgtccagttggcatgggacagtcacccataaccaagtaaccaaatcatccctggaagctcgggtgtggtctgctgagggtgtgtgcagagtgccactgacagcacagggccagaggttgcaggagggactatgtggacccaggttgttttgcctttcttct

SEQ ID NO: 533689 - DNA, 731 bp, Homo sapiens
  misc_feature (146)..(146): n is a, c, g, or t
  misc_feature (161)..(161): n is a, c, g, or t
gctatgatggtcggaatggcgtccccgaagatctcgattctgctgttctcggagggctctgtgccttgtacccagtatcgtggagcgggtctcaccacttcacatagagcgtattgcatacgagcgcatcacgatgttgccagggnacgcgagaacggagngaaggagtctctcgtatatcagtgagtcgtagtggacgtagcgtatggaatcggtacgagcggcgaatgtcgtgcaggtgcagacaagaggatctgccgcagagtccagaggatggaagccgagggcgcctgagtgatagagcaggagtgggccggatgtattgggaccggaacaaacggaatgtgaacgggccactcacagtaatgtatctagtgaactctggggtaccctgctgcggctagtactaactcagagacgaggactggttctcacaccatccagaggatgtatggctgcgacgtggggccggactgggcgctatcctccgcgggtaccagacaggacgcttacgacggcaaggattacatcgcgcctgaacgaggacctgcgctcttggaccgctggcgtgacataggcaggctcagatcacccagcgcaatgtgggaggacggcccatgaggctggagcagtgagagagcctacctggagggccggtgcgtggagtggctccggagatagcctggatgaacgggaaggatacgcatgcggacaacgtgaacccccgcaag

SEQ ID NO: 533690 - DNA, 422 bp, Homo sapiens
atccccctagctggagtgcagtggcacgatctcggtcactgcaaactccgcttccaggattcatgccattctcctgcctcagcctcccgagcagctgggactacaggcgcccgccaccacgcctggctaatttatttttacttctacttagtagagacggggtttcaccactgtgagtgaaacagccactgcgcccagccgggtttacattttattagaagggccaaatgcacagaaagacaaatactgcatgttctcacccatagataggagcttacaacgttgcactcatggaggaagagtgtagaatgataccagaggttgggacggctggctgtatagggtggggggaataaacagaggctggttcatgggtgtgaacatacagtgacatagaagacattagttccaatgttcattag

SEQ ID NO: 533691 - DNA, 774 bp, Homo sapiens
aaaaaaaaaaaaaaaaaaaaaaaaaaaggggggggccccccgcatactaaaaactggggtcccccccggggttttgttttttttaacctggattttggggggggaacttacaaagggaaaaaaaaaattaaaaggggggggagaaaggcaaaaattaacttattttgctttcaatcatcagaagggggctgtattttaccttgggagcagaaccaccttgcgggttaacaacccccggggggagaagatttcttctactaaccccgcgtgagagacgaatttttctcacaattgcctcttcttaacaagcactctcaactatagacattatctctatctgtcaagttattagaactttctaaccaacaccacaccagtgggtgcgtggtgcaaacacaaaatctactgtcgcacctacacgcggaggcacataggggaggctcaccctcattataggagtgtgggcgcctacaaagctctattaatacgtgtgtttttccttctggggtagaacacacagcgtcatacaacagacccatctatttttcttctccagcagagggggtgacgtgtgcccagcggcctccattctttttctctttatgacactctctggggcggcgcgactatattatttgcgcctgcgcgcactgcgagacatctttgtgtgcccccctactattggcgcgccaacataaactatcttctccccacaactcgtatgtctccccccctccgttgggaacaattttctagcgggtgcaccaccaaccg

SEQ ID NO: 533692 - DNA, 128 bp, Homo sapiens
taggatccctgtctctttcgggacggggccacacacttgtggagctagaaatagtggggcaggtccctttccttccttaatttcacccaggggctcctccatgggtccgtagcgcttcacctaccgcc

SEQ ID NO: 533693 - DNA, 462 bp, Homo sapiens
tagctcactactagaccccagttatacgcctggcaggcggaatcctattcgcaggatctgtcattactaacaacatttcccgccggatctcccttgcaaacaagaaaccccctccagctaaaactcagagagctcgctgtcaatttcctaggacttcgaacaggcctagacctcaagtagctaatcaacaaacttaaaatagccatctcgcattatgcaccttttatttcgtccaacgatacttcggattctaccttagcatcactacaacgtacaatcccctatctaggccttcttacgagccacgacctgaccctactcctcctagagcaaatctgattaaaaaagctattagctataacaatttcacagtaccaaatctccatctccatcatcacctcaaaccacctaggcgtaattaagctttacttcctctctttcttcttcccactcatcctgacc

SEQ ID NO: 533694 - DNA, 372 bp, Homo sapiens
  misc_feature (302)..(302): n is a, c, g, or t
  misc_feature (334)..(334): n is a, c, g, or t
ctcagaggatcccgaatctcgaaagtggtgcaaccctcatgaaaattcctttataggacattttcatcaccccataaagcacatacccactagtagtcaattctcattctccccttccccaccccaatcccgagataaccacaaattctgcgttctggtctccattagattttcctatctctgtagcattctctaagactcgtaagtaatttcatggtaaataggaatcatataatatggtggtcttctggggtctgggcttcttttaccggagcataatttcttcaagtgttcattcatgnttgtagcatcagattttttttacatgccaaantaatactccattttatacatgcacaacttgtcgagatt

SEQ ID NO: 533695 - DNA, 465 bp, Homo sapiens
taatatgtatttttaattgacaaaagaggagagtatatatttatgaggcacaatgtgatgttttgatatatgtttgcattgtggaatgattacatcaagctaactgacatatctatcatctcccctacttgtaatctttttgtgatgacaacatttaaagcctactgttttagcaattttgaaacagacaatacattatcattaactatagtcaccatgctgtgcaacagattcaccagaacctgttcctccggtctcagtgacactttgtaccctttgaccagcgtctctcctttcccagtccgtcccccgcacagcctccagtaaccgccattccactctctgcttccacgagttcaactgggtttcacttaaactcctttagcttccctcttggaacagatgcagcaaatgggaccatccatctggtaaacaaagtcctctcccagaataggccaagcaatt

SEQ ID NO: 533696 - DNA, 144 bp, Homo sapiens
aatctctctatccttagtccctttatccttaatctctctatccttaatctctctatccttaatctcacagttcataataatttctcttcgaaataatatgtgtgagattaaggatagagggattaaggatagagagattaagga

SEQ ID NO: 533697 - DNA, 461 bp, Homo sapiens
  misc_feature (10)..(10): n is a, c, g, or t
  misc_feature (12)..(12): n is a, c, g, or t
  misc_feature (15)..(15): n is a, c, g, or t
  misc_feature (52)..(52): n is a, c, g, or t
  misc_feature (401)..(401): n is a, c, g, or t
  misc_feature (455)..(455): n is a, c, g, or t
gcctcgcgangnctncattaccaactgtgatggctatgggacaaaactcctnctgcttgagaaaagcagagaaaaaagtaaaggggactttgccttgcacctaaggtaggatcgtggccatagaggtatagagcaccaagtgggcctttgaggtccctaattacaggacttgacccttggatggcatttctggaccagccctgggccagaggggagcccaaagcccttaaagggtgagatctagggcaggcagcattcaccaccagttgactgaaaagaccttgagccttaaggagacatcaccctcctttaaccttctacttctacctacgcctaatcttacttccacctgcaattcacactacttccccatattcttaacaacgttaaaaattaaaatngacagtttggaacatacaaaacccaccccatttcttccccacattcattggccnttacca

SEQ ID NO: 533698 - DNA, 653 bp, Homo sapiens
gcccactagcccgtatcacctcgtgacgcttctctttcatctctaaagcggattatggtacggctctgatagacccagaggcatagcaaagtctggatgatcagcggcttgcccatgtgccagataacagtcacagagcctaggcgggccttgcacgctatcggcgcttagaccggccatacgtcatggtagcggtcaccatgaacgctggaagccaccgaccgctgctggacgagtgagcgcctcaagtcctgttgatagactgacgattcactttggagctcaacgccagacacatcatggacaatggcaacgagctcttaaacctaatcgtgcagggctgactgatgtgcacgacgagcatgtagcacatcgtgctgatcgttgagatgcaggacgactactgcatgactcctagatcgccgagaccagagtgtatatcacttgcactagctgctatgagactatcgagacatgatgatgccatcttgaatgacactgcaggacacttcgtagtctctggcaattgaatgatttactaggtacatcgctatactgctttaacaagtagttaacgcacgggtaaacttgatgatgctagaaagctgcaggatttcaaccgacctgaggttctgtggcggcggtctgtgctg

SEQ ID NO: 533699 - DNA, 375 bp, Homo sapiens
  misc_feature (103)..(103): n is a, c, g, or t
tcgcctagggaagagcgcatgtggctatgctccacccagtccgattaagcttacaggccacttttcctgcccatctagtgcagatgtgatcgagaagcacatnctcaagctcttccagagcaacctggtgcccgctgatcctgagtgaaggccgcctgccgggtgactcagacactcagggaacaaaatggtcagccagagctgggaaaaccagaactgacttccaaggcagcttctggacaggtggtgggaggggacccttcccaagaggaaccaataaaccttctgtgcagaaatgagggactttgctgtgcttcccggagggcttcctggaggagacagcccctagagggctcacaccttcttcctaagaca

SEQ ID NO: 533700 - DNA, 376 bp, Homo sapiens
tggacaattggttattatagttttatattctcataatctcttaaactataactcgtgcaactccagcataggcatgtggagagggaacaaggaaaaactgtggacacccaagagggaaacgtgcaggcgagaagccacaaagaatctctaggaatacgggcgaagccaaagtgggggtgggagggggtgcctcctccgtggagctacagaaaggaagtgactcggggtggtataaaataaacacacagagctcaaactttttctcgagtgtgtggtccacgagtctccagcagaggggtgaatcttctgtggggggctctgtgccatctccgtggacccaaagggcctccagtggccctccagtgaatttttctcc

SEQ ID NO: 533701 - DNA, 332 bp, Homo sapiens
  misc_feature (262)..(262): n is a, c, g, or t
gctgatcgacttctaggtgcgctcgcagattgaagggcgggccatgccccagatcacctccattatagtgaaccagctcaagaagagcataaagcgcaagcacaccctatcgaattacacagatcagggtggattaatgggaatttacaaagtggtggacttacccttcgtcttgtccaggcaactgaggggtatgctgggcacgtcatcattgaaactgtggcttcaaactcgcctgctgcaattgcggaacttcagcggngagaacgacttatcgccattggaggtgtggtcctggtgtactatgaaagggctgttggccacgtcggtgc

SEQ ID NO: 533702 - DNA, 928 bp, Homo sapiens
gagataaacaaggctggacttcaagtgatctgtcaaccagatgtaattgggatttgacaaggactgtgaaaggctgactctccctgttctctttcatgctggtcaccgggcagtagtgtgggtaactgactgcctcaatacgtatcatagaagccattgagatcccgcagtttatcgggcgcagttacctgacgtatgacaacccagatatcttgaagagggtgtcacggatcaatatctaaatgtgttcatgaggtttacaagctaactgccaaggatggccttttgctgtgcggaggggagcacaggcccatgagaccctaacagctgattacatttccttgggaccttcgggatggagccctcgtgttcagctataacctgggcagtgcgtgtggcatacatcatggtgaatggctccttcaacgatggtcggtggcatcgagtttaaggccgtcagggatggccagtcaggaaagataaccgtggaatgactatggagccagaacaggcagattccccaggcgatgatgcggtagacttaagcatcaatgggagctctgtatgtggtgtggtaatgaaggaaaattgtgtctgcatcactatcaagggcaatatatgagagggctcgtggggtcttgtatctctgcaagttcagaactgtccaaccgattgacacaattttcccttcgtgagaagattgcccgtggattgcgaaccaagatcaacgctttgtacagccacgtttacatccagctgtgacttgttacatggggaacacgcgtccttgataagttctgagacattcacaagggtcccttcagatctgttgcctgtatggtatatgtgccaggcccagtgcatccacggtgtgatgactcttaaccacgaagtaagttctcggtatgagaaactgacacccagcacg

SEQ ID NO: 533703 - DNA, 113 bp, Homo sapiens
cactcggacaacaacgacagaaccagttctttcatttatttttccatccctcacaatagtggttctggaagctaggtccctagaccagcagcatcagcatcacctgggaactg

SEQ ID NO: 533704 - DNA, 359 bp, Homo sapiens
  misc_feature (81)..(81): n is a, c, g, or t
acggcatatattaaacttgattacatcacatgaaatagatgtgcacactcactataagagagccatgatatatgcagaagnccaggtgcagggatcatgcaatagtttcgtacccagatttcagaataccaggtagcaaggaaacacaatggaattgaaggctgaggtgaagtacaggcataagggcaaggaaagcagaacattcaagatgtacctatatacaccagttcttaaaacacgcaaatcatttcccataaggcactggctcatgtaattctgttgaggcagaagtcaatcttaggatgtggtctgtacatatctgcagataagatacacaaaagctgaattcagagttatta

SEQ ID NO: 533705 - DNA, 374 bp, Homo sapiens
aagcataaggcaaaggagaaaaggccaagaagtatcttcgaacagctgacagagtcggaacgtgtacgcagagcccacctgaatgaccttgaaaatattattccattgcttggaatgggcctcctgtattccgtgagtggtcccgaacgctctacagacatgctgcacttcagactatctgtcggagcacggatctaccacaccattgcatatctgacaccccctccccagccaaatagagcttcgaggtcttttgtgggatatggagttactctttccatggcttacaggttgctgaaatgtacattgtacctgtaaagaaagtcatacgaactcagcatccagtgggctggtacgacttctgtgctcccact

SEQ ID NO: 533706 - DNA, 338 bp, Homo sapiens
cacgagggcaagattactactgcagacatctcctgaagacttggctctacaaaatgacagtctgcaaataaatttatttatacaatgtatcctaagtcttaacggatgcaatgtaatcgtcgaaattttaaatctaaaattaaacactgttaacttcaggttaactctgctagataacaaactatgggccaaacgccacaacatctattccaatatattacgtttcctcggaggcgtttcctgcgctatgctaataccaaaaacttgacaactttatctaaatgcaatagcatcaactcttgtgcagaaatttttcttggcaatttctaaatcgggaa

SEQ ID NO: 533707 - DNA, 134 bp, Homo sapiens
ctaccacgaactggagaagaagcagaggaggttgacagtagctctcgcaggccattcaggagctagaggggcaccttgcaggctgaggagagtgcgcggcggaagctggtgctggtataacgcgtcctagtatg

SEQ ID NO: 533708 - DNA, 168 bp, Homo sapiens
tagcgcgtaatctactaacagtctctgatttgcctattccaaatatttagtataagtggaatcatacaatattcgtccttttgctatctggcgtatttcacttagcacaagtgccttcaaggttcatccatgttatagcatatgtcagaactttattcttttttatag

SEQ ID NO: 533709 - DNA, 821 bp, Homo sapiens
cagccaggaggaatgggcatgcttgtgcagagcctcagtgtagagtatcccggggaggctggggctgtagtggtgccagcagtctgggccagagtccagctcagcaactccgggttacatgtgcagcccagtgtgggcctagccacctggcagctgcactcagagtgccacatgtgtcctggctgagctcatctgcctgcctgctgggtggagaaagctggaaggaggagaggcagatctggtggagtggcatgcgatgtgtcccgtggcacccccctggccagcagtgcacccttccgttgtcctgagctgggttgccacctgctccttttcctggtgattccctggacaccctccaagggaaccaaggggaacatgctctgggtccagctgccccagtgaatggactgtgcgccccttccccacatggggtcaagtatcccttccaggcaacagccgtttccttgggcaccagcctgcatgcccagtgctgatgcagggatgtggccatgaattgactctgggaaagagtcattcttagcaatggacttttgtcagggtccaaggaaaggagttggccagccagacccgacccgccttgcaggagggcacgttcgtcatcccgggaactgtgccccatcagtgagccggagggctgtcaggcatctttgtgaaccgggtgctggggtttggccggaggcaacaattgcggggactacggctggtacccatgggctcgcccaagtggactggcttgctgaagcaaatggggaaggccgtcattgaaaaattcacgcttaaggggcagttcaaatagaaca

SEQ ID NO: 533710 - DNA, 440 bp, Homo sapiens
ccggaaaaggttggattaaataaattggtccttaattcctttggtaaccccaatatagtattctagccaacatttaatttttacaaatggaactttttagctggatcaacagaaggattcaatatctatttcattaaaattatttaacccttgttgggtgcgggggttaaaacctgtaatctaagcactttaggagactgaggcaggcagatggcttgagctcaggaatttgaaaccagcctgggcaacatgacaggacccctgtttttactaaaaccacaaaaggttaacctggcatgggggcaccacccgcctgtggtcccggttacttgagaggctggggtggaagaaccacttgagcccagaagttgaggctgcagtgagccatgatcatccactgaattccagcctgggcgacaggagtgagactgtatttaaaa

SEQ ID NO: 533711 - DNA, 362 bp, Homo sapiens
tcctacgagcgcacgctgcggggcgcactttctggtgccatgcagagcttggagtgatcactgcctaggccgatgggtaggcgctatctgactggtgttcaagcgtcaattgttgagttggattgatttctcgaaagccttacctttgcgggttagggacaaattgatgacttgacctttcttcgcattaatcaagctcgatagatgagccgcactgctgatgcgctggccatcaagcttctctatagtatctccgatcagtaagtcggctttgaaagcgggtgagtcatcggaaaccatcgtgattttcacgccatagttcgtctgacgagactgacgttctgcttcatccagttcaatag

SEQ ID NO: 533712 - DNA, 496 bp, Homo sapiens
ggtggtaaagagtcttgtacttcgtgtccacacatggtactgatattctgcatctcggacaggtcagcagagataagcaagtgttgaacagaccttgcacatgcttagtgagtgattcgtaattgagtttatagactcagaaggtatataaggacatttggaatcagtagcagagcacatgcctctttgaaaaaaaccacgtagctaattgggtttcaccaaagagtgcattttgtctcccccttacagccccccaacttcaggtccttagtggttcacaaagagcccaggagccaggcttggatttttccattgtagggccgtggttgtcccagctggggtagatttcagggcggccccccgaaatccctggccacagtgtcgcagattgcctggcttggcagaaagtccagatcacccaaatttgggtggattcttcatttctccactgtagttggggtcccttgattgtgccgggggaaacgtgccggaggtt

SEQ ID NO: 533713 - DNA, 508 bp, Homo sapiens
taatttaattttattttattttttattgatcattcttgggtgtttctcgcagagggggatttggcagggtcataggacaattgtggaaggaaggtcatcagataaacaagtgaacaaaggtctctggttttcctaggcagagtgtttgtgtccctgggtacttgcgaatagggagtggggatgactcttaacaagcatgctgccttcaagcatctgtttaacaaagcacattttgcaccgcccttaatccatttaaccctgagtggacacagcacatgttttatagagcacaaggttgggggtaaggtcttaaatcaacaggatcccaaggcaaaagaatttttcttagttcaaaacaaaatgaaaagtctcccatgtctaccttcctctacacagacacaggaaccatccgatttctcaatcttttccccaccttttccccctttttttttccccaaaacccccttttgcattttgggccccgttttaaaagaacttttcggggtac

SEQ ID NO: 533714 - DNA, 124 bp, Homo sapiens
gaggtgctgaatgagcagagaacaagaaaaaagaagccggctgtggggcggctgttggtgggccctggagggcaagagcgcagctcagtgccgcggcccagaccaactccaacgcggcaggcaa

SEQ ID NO: 533715 - DNA, 339 bp, Homo sapiens
ctgctcctcaccctcctcactcagggcacagggtgctcgggcccagtctgccctgacttaaacctgcctccgtgttttgggcttcttggcaattggttttcctctttctctcaaccggttcatataattacgcgtaatttatatatatactatgtgctctctcggatccaacaaacacacccgggcaaagagccccaaaactctctaattttttgaggggcacattatctcggcctctgggatatctgcttcgtcgtcctctgtctctacgatgtgtcaacatagtggtcctctgaacatatcttgtgtctgagtgcttggacgacggcgtcattatta

SEQ ID NO: 533716 - DNA, 224 bp, Homo sapiens
aggcccaggcccggcctttttttagccggcagtgattgaacccggatttggtcctgaccccaaggaccccatcatttatgtggtgggggcccccctcacgcccaatttgaaaaaacgacgggagtgggcctccagcttattttccgtgaaaaaaaccaaaaaaccgtgaaaggccccccggggtgtgggggacgctgttatgtaaataaagctgctgagttgga

SEQ ID NO: 533717 - DNA, 254 bp, Homo sapiens
ctctatgaggatcccaccttgcttaagatgctcccgagggctgtgggtctaggtggacgcctgccgtgttgcacgcgctcctgttggtgaggccccagacatcctgccaaagtgtctgagcgagcacgagtgttggggacgacggacccactctggccacacggcgaccgagggacagatggggccctgcgtcccaataggctgcctgaaggtgggtagggcggcctgcggaatagtggggtggctgtgggctc

SEQ ID NO: 533718 - DNA, 844 bp, Homo sapiens
  misc_feature (24)..(24): n is a, c, g, or t
  misc_feature (26)..(26): n is a, c, g, or t
agtatcaatagtgtattactctcncncgcaccgtccgtccatacacaccaataccaccaatcccaacactagtataggtacctcggaatacacagcaacactcaggcgcgctgctccaggaggctgcagaggggtcctttttaaccgtcaacaaaactggctatggacacgcccattgggaaactcattgctgcacttcaaggtgatggccacagtggcagaacctaggaagccacagaacaaaccacagaatggagacacatggtagccatggcaagccatcagacccaggatttcccaaagaacactggaccaggaagatgctctgtgaaaaagagctccctggacggacaaatttgcgaaacactttgcataatacttaaaagaatgtatggcacataaaagataatatgcaatgaaacaattcattcctttaaaaccaaaaccaaaaaaatgggttctttatggcctcaaaggtggaactctgaagacgattacctttaaagagggataatacatgatcctaactcactgactcaatgaactcggacaataagatgatgcaagcggcatcaacaaactaaaaggcagaaatactgaaattcacataattacgggtacactgttgatttaacatgtcatcaatttgtctaaaattggacttcaccaccaaaaaggcacagcacaatgaatatatcaccataagctactatcacactttcgaatatgacataaactatataataaagaccccacgagccacaaccatcacagtcgcatattattcattcatgttccccgccgtagccatcctgcacccatcacctgttttcaatttattcca

SEQ ID NO: 533719 - DNA, 154 bp, Homo sapiens
aactcttctcccgggcaggctgcaggcatgcggccaggggccctcgtccattttccaacagtcccagcagctcacatccaccaccagttatctccgttggcatgtccccaggtgcacacatccgccacgtttgctgcggtcacggcaggctcgc

SEQ ID NO: 533720 - DNA, 230 bp, Homo sapiens
tggtggtgggcgcctgtagtcccagctactcaggaggctgaggcaggagaatggcgtgaacccagaaggtggagcttgcagtgaaccgagatcgcaccactgcactccagctagggggacagggcgagactcctctcaaaaaaagaaattagccaaaaaaaaaccccggggggaacttttagggggcccggcccaattgatttccccccggggggaacaggaaaggccca

SEQ ID NO: 533721 - DNA, 114 bp, Homo sapiens
ttaagaatcacaactgtgcaatattgaatacttataggataggctcttatgattctagggtccttaaatcaggcactaatgatttcctatgtgctatgtctaagagtgcaatca

SEQ ID NO: 533722 - DNA, 585 bp, Homo sapiens
  misc_feature (5)..(5): n is a, c, g, or t
  misc_feature (63)..(63): n is a, c, g, or t
  misc_feature (178)..(178): n is a, c, g, or t
ttaanaggggggatggtgggcggggattaccctacataatgtgaatttttaaccataattttnacatgattgagatgtacttgagggttttttgtgttaattgagaaaagactttgcaattttttttttaggatgagcctctcctagacttggcctagaatattagggggggctccangaaggaatactgaagaggaaaagagaggcaggattggggtcacaggcggttcttcaggatggaccaagggggccttggggattggaggggtctcaaaggggctggaggactcggatttacagaaaggcacaggggggcaacttgggggtctggtaggaaggcaccagggggggtatggggtaaccacctttctatacaggagatgggaatctactttggcatttatccaccacagggacaaaggactgggcaggcattcatgggatccttcattggggactcctgaaatcagacatggtcctggagaaagaattttaaggtaggctttctatgcacctatcaagaatgaagagggataggttgggtcaaacaccggcaggggaatccttcaggaattctaatccact

SEQ ID NO: 533723 - DNA, 172 bp, Homo sapiens
gagctgggtccgacatgcctcgtgagcatgctcttctcgaccagcctggtagctgtggtcgtgcgctcgcccgcgggcagcgaaaagaggctgcacattctcaacacgaagcggaactcgaccatatgtgagctgaccttccccacagatatccgcgccgtccgcatgaacc

SEQ ID NO: 533724 - DNA, 373 bp, Homo sapiens
gaaaagaccctcgggggactttttttccccctttggggcaatcccagggccttactccggggggaactttcctggggttaatgaggctgaaaggttcagcaaagggtttccccccttccctggccccctaaggggggggggcccgggtggacttttttttgaacccagaaagcagagctgggggggggtgacttcccccaatccctgccttcatagggcccttttccaggggggactttttggggggcaaaggggggggcctttttggtaaaaactttttggccatcccccccctcctatgggttttttccgggggggacccgctggtgattcctaagggggcctttttccttaaaaggtttccccccggcca

SEQ ID NO: 533725 - DNA, 778 bp, Homo sapiens
  misc_feature (12)..(12): n is a, c, g, or t
  misc_feature (82)..(82): n is a, c, g, or t
  misc_feature (85)..(85): n is a, c, g, or t
  misc_feature (89)..(90): n is a, c, g, or t
  misc_feature (98)..(98): n is a, c, g, or t
  misc_feature (108)..(108): n is a, c, g, or t
  misc_feature (113)..(113): n is a, c, g, or t
  misc_feature (128)..(128): n is a, c, g, or t
  misc_feature (140)..(140): n is a, c, g, or t
  misc_feature (144)..(144): n is a, c, g, or t
  misc_feature (176)..(176): n is a, c, g, or t
  misc_feature (179)..(180): n is a, c, g, or t
  misc_feature (187)..(187): n is a, c, g, or t
  misc_feature (194)..(194): n is a, c, g, or t
  misc_feature (203)..(205): n is a, c, g, or t
  misc_feature (210)..(210): n is a, c, g, or t
  misc_feature (212)..(212): n is a, c, g, or t
  misc_feature (267)..(267): n is a, c, g, or t
  misc_feature (314)..(314): n is a, c, g, or t
  misc_feature (333)..(333): n is a, c, g, or t
  misc_feature (391)..(391): n is a, c, g, or t
  misc_feature (435)..(435): n is a, c, g, or t
  misc_feature (512)..(512): n is a, c, g, or t
  misc_feature (524)..(524): n is a, c, g, or t
  misc_feature (730)..(730): n is a, c, g, or t
agtcataaaganccagagatagtaactgtaagtgtgcctacttcaaacactgtataaagcagtggtcccctaaccttttttnaanaggnnttggtttngtggagatanttttnacagatacaggtgtnggggtagatggnttgngggtgggagtgttccacctcagatcatcgggnatnngattctnataatgngggcacaannnagatntnttgcatgtgcagttcacaatagggttcaggctcctgtaagagtctaatgcgaccnaggggtttgagagccctagtataaaggattacacaatcaaataaaantgactgcaccattatttcngttatttgcaggtaactgaggaatgaacaagtacttctgttagggttcaacttaaatnatttttaagacttatcaaatacaaatactttgtgaatgtaaaantaagctctcttagcgtttaccaaatgatcgggacaacaatattagagggttaataaatgactgatttggcatctatnagtctttttgtnagtgctatcagtcaggtctatctacaggaggtagtgcagaaagcaactgataattcacagaccatcaaggtcccttaacatcatggcaaatacgtaactgtagtttgagagtttaagtaggaaaaagaagtgtacttataaagtagtagtgtttcctagtatctgtaatttgagccatagtaaaacacgtaagttaaatcaggagnagccattctggaaaacacaggggtaacagaaattaagtaatcaagact

SEQ ID NO: 533726 - DNA, 179 bp, Homo sapiens
  misc_feature (86)..(86): n is a, c, g, or t
  misc_feature (110)..(110): n is a, c, g, or t
  misc_feature (167)..(167): n is a, c, g, or t
ccaggaggtggagcttgcagtgagccaaaatcatgccagtgtactccagcctgggtgacagagtgagactccatctcaaaacaaancaaaaccatatgaaaaaccatggncttaattcagtcacactagcattttataaaatgaggtgtctatgtagttaaaaatancatcaacagctt

SEQ ID NO: 533727 - DNA, 1430 bp, Homo sapiens
  misc_feature (722)..(722): n is a, c, g, or t
ttgcgagtaatcaacgacgtcatgtggtctaaggatcgtagaagatagtgtgtggtgtctcctcccctccgcaatgggtggttatttttcccgtcgagacagtatcttcggtgggtgatacatcacacacaggctggttttttgtcagaaagaaagcaagatctgttgtagcgcaccgctccgttgtcgcccacaccacgagaaaaaataatactggggggtcgtgcacaggaggaagacaccacgcccgcgttggtggcaccgcccctagtttttttcggctggatcagcgcccaccccttgtggggaagaaaggagattatgcgttgttaaaagaaggggtggagagggttgttttccctcacaaaagaagtgtgcgctcttgggcccccacagccccttatttgaagagtgtgtttttgtggtgccctcttgaagagagagtgtttccgcacctctgttgtgtaggaccccccccaactgggagaattgaagtggttgtgaagccacacaagcttggaagaggagttggtccgtcgggaaccccaatggggacgctagcttatcccacgggggattttgtaggggttctccacggaagactccccacggaagttggaaatttttctctgatgtccccccctggtttgtcctttgtttggagattggtgaccccccacgcagaaaaatatatatcgggccgttggagtaaaacacgcggngttgccccacagatataaagacatttgggagagaaaacaggcgagaaaagagacatgggtcacacactgtgtagagagacactcatttatagagagaagagaagccacgagataacaccccaaggggaacgcttgggacacacgtgttcgtgagactcgtggagctatataaccacgctgttttccacatatgaacttctctttctcttaaaactcttttttgggcccccctcccctcgaaagttttccctcgagagaattggagagaattcttggaattgaatggaatgggcctcgaaaaggctattccctctggctcgccacgagactttctgaaaaattttggtgcacctcttttgtaaccgctgagggccgctatataaatctcccaagagttcacgtggttaataattttaactcggaggaaagctatattgaaagaatgaatgaatgaatgaattattgacatgaaagaaaggtgaaaaaagcggaatgagaggtataatggtttacccaatgagggcaataatttctctcgtggttaacaccacttgagaagcacaattgaatgacttatgtattcctcttgctataatcactttctgtgatttgggatataaaaacacttttggaaaacatgattttagaattttacagcccaaccatgtatgtataaggtttccaataaataaattgccaaaactccta

SEQ ID NO: 533728 - DNA, 84 bp, Homo sapiens
  misc_feature (40)..(40): n is a, c, g, or t
ccggtcaggattccatctctctgaatctgttatgaacacngttggttggctgattcagtaataaatatgtaggcctttcttttt

SEQ ID NO: 533729 - DNA, 186 bp, Homo sapiens
gtgagcccgtgatgagccacttaatctccgtgtagtacaggaggctacatactggctgtccagctcatagagcaggggtgtgaactcgctgtggttcagtccccgggagcatatccagttcacggacttcactaccacgtccatgacgtggtccatcttcaacttctgagcacagagggattccgg

SEQ ID NO: 533730 - DNA, 1296 bp, Homo sapiens
  misc_feature (282)..(282): n is a, c, g, or t
gcggaggcgtacagaactgcttcaagatgaagctgaacaatctccttcccagccactggctggcagtaagctcattgaagtggacgatgaacgcaaagcttcgatactttgctagttgcatgcaagcgtatggcccacagataagtatgctggactgacgacatctggcgttgaaagaatggaacgggttatgtggtccgaactcggaggtcggtgggcaacgacacatagcaatggtttctctcccacatgaagcatgggtcgtctttgacctcgatgagncctgtgtctccactgcataacatgaagttaaaggtgggcattgtgcacctgttaacaggaatcacaacggcacgaagcatggcatgaaaacgagagagaagaagaagtcaaggtgtcgatgggtctgcgatagtgtggaatgcaaattcttgaagacggtgcttcaaactatgggttgattgtaaaaaacatgaaggagaggaaggagtgaatctcactgcgagagctgagcgttagtagcgtaacgagcgtggcgcgtcgtgcgcgaacgctgagggaaccgcctgaagagagcaggacgtaagagcagaaaagtcgcggcgaacatacttttattcaaaaatctcctactgaaaaagcaaagcagtggatgcgttcgcgaccaggttaatggtttggttacacgaaaaggctcgcgtttcaagatcacacacgcacacgcgtcacacgaaaaaccatgaaggtaactcgagaaaggccacccccaacagattatccaagccgttcctttggctttaaaccttcccaaacgtaggtcccctggccaaggtcaaggaaaaaccggtgccgtgctggcttattctcggctacttgaacaagaaacgcaggcgcggtaacaccaaatggaaaacacacacattataccgtgaaacgaaagggcgtgggccagcaaaactaattgcctatacaacctttttgtggggcccaaacgaacgaaattgacacgggacgggcctacaagggagaaggaaaaggtccggcccatggagagaagacaacagcatttgggccgaaaaaggcaatgaactcggccaacggatacatcttatctgccccttccgttccttagcatcgacctgtcttacataactctttcttaaaaggttctttggacaaattcccaggttctaggaacacacattacaggactttttctttctgaatcgtttacaccaacacattacagcattaaccgaatccacaggaacttcttggaaccaacaccaacacaca

SEQ ID NO: 533731 - DNA, 119 bp, Homo sapiens
caggtgtcttcgtgtgaatacagggtgtatgttgataatgtggtgactgagagaacccgctcgtgttgtggtaaatatgtagagtggagtataggagctgtgactcagtatgttgagtt

SEQ ID NO: 533732 - DNA, 922 bp, Homo sapiens
  misc_feature (866)..(866): n is a, c, g, or t
agcggctcgttcaaggaggaggcgagagcaagcgggacgtcgctggttggggccctaacactcgcgagcgaagccccgtaccttctcgtgctcggttcttgcggcttatcccctctgcctcgtacgctacgaccgggtaggcgctgcgccgtgcatttcaccgctctggagcacacatgcctggacaccatgtaggaccgtgcggcgggtgccaacgaggatgcgcagggacatcctcagagtttgcctgggctgctggtgtgctctggtccacggctgggggccggacaagggcgcgacgcgggaagtgggcgatgatggttagaccatcggctcgggcttgccagcgcgcagggtagggcactcgcgttagtagcaacacgcacaggggttcaaagaagctggagcaggcattcggtggtgcctggccacgtagctggtcgctttggagactctgccgcgctggtggcgcgccctgtcgtggcttgttgcttgacgtccaggcgcgtcagtgccggttccggctctgcggacgccgcactgggctgcctggttgcagcgaagaggtcacagtgcagaacaaagtgttcctgggagtacctgcgagcggtacatagtaagtagcgttgcttgtgtgcgccttgctggaagctagggcacagttaaccgcacccgtgtactcgttcaatgtcaatgccctgtggaacgtggaaccgatgcctttgcggaagacgggatgagggaacataccagccgctcgccaactaccaatgggactggaaggagtgggacgaactgggttgtagagcctcggctagtccagcgttaccggccaataaggtgtctaacgggcccccatatagagncacgcgaattcccatctacggcacaccctagtttttgcaagtccctgttgccccag

SEQ ID NO: 533733 - DNA, 422 bp, Homo sapiens
  misc_feature (297)..(297): n is a, c, g, or t
tgtgaagcttgatcttattcacgaatctatccttcataagggcatcaaaacacttttggaaaagaagaagagagtccaactcaaagatatgggagaggatttggagtggctcggtcagataatggagggacagggggacctagattagaccatggaacgagccaagtccttaatgggatcagtactttggccgaatgtgctcctggatgttaagtaaggaattggcagcaaggattcggtttcctgctggcagggataccggtagaggttgcgaggaacaccattggggttcctcgncaagggcttttcttggacaatgggaccaaaggacgaatcaatcaaaattcggtcaaggatgccagtaaacagatctagagggtgtattatttcctggctccgtatgggctcaagcggatgagcca

SEQ ID NO: 533734 - DNA, 182 bp, Homo sapiens
ccttcagtgccgtgactaaccccgtcatctacttacaatacctagatatttctcttaaaaccaaaaactactattgaattgacagtttcatgctagtagaatttcaagtgagagatcttttccttaatattgacgacacaatttaccatgtacttttaaagcaggaagtggggaaaagtata

SEQ ID NO: 533735 - DNA, 547 bp, Homo sapiens
agaacagctatacatacctccaatcattacttcatttcaatacttatttccaatcacaggaaacatttatttaaaattatctcgtacattttcacctgtgctatctctaattccttcccctgtttgttcccataccttttttgactttttatccccaacaacattatactacagggtttttctactacttattttttgaagcattcattttcccaacacaaaagagctttcttctcggtattatgcaaattgaaatcctgtgtgtattcgatagtagatagacgaattttattttttatttccacttgaagagttacatttcggataaaagtctacaaataacggtgatcattttgattttttcagtataaaaaaagttgccttgatggcatattatgatgtaatgctaattgcttgtaggatagtaaatggtcagtattgaaacctaatctctagctgccgtctggtagatatgaacgaatgttcaccaagcatgtatttggtatttggttgcattgtacactgcaactaataagccaacgaatcg

SEQ ID NO: 533736 - DNA, 462 bp, Homo sapiens
  misc_feature (24)..(24): n is a, c, g, or t
  misc_feature (34)..(34): n is a, c, g, or t
  misc_feature (39)..(39): n is a, c, g, or t
ataagccactatggtgaccactantaagaacccngtggntttaaaaacagtgtcgccggattcggatagatgcgcccactactcggacgcggtcatagcagccagcgcgtctgcgcagagaggcgagagccgcgctgcgcctagtcctgcagctctgcctccgcactcagcggggccctcgggaatcttccagcggcggaaccacgatctgcagcctccaccaggcctggggtggccctgggtgcagagcccagaagggcatcccagctgccctgagtccaggccctggccgattcttggcccgattcccagcccagcccagatcccaggcccaggcagagtctcaggtccaggtcccatcttaagtcctggtcggatgcgaagccctggctcacttccaggcctaggcccgattttaggcccaggctacggcccaggctcaagctcagtcccagtcagtcc

SEQ ID NO: 533737 - DNA, 612 bp, Homo sapiens
  misc_feature (1)..(1): n is a, c, g, or t
  misc_feature (60)..(60): n is a, c, g, or t
  misc_feature (64)..(64): n is a, c, g, or t
  misc_feature (131)..(131): n is a, c, g, or t
  misc_feature (140)..(141): n is a, c, g, or t
  misc_feature (143)..(143): n is a, c, g, or t
  misc_feature (147)..(147): n is a, c, g, or t
  misc_feature (150)..(150): n is a, c, g, or t
  misc_feature (229)..(229): n is a, c, g, or t
  misc_feature (261)..(261): n is a, c, g, or t
  misc_feature (264)..(264): n is a, c, g, or t
  misc_feature (276)..(276): n is a, c, g, or t
  misc_feature (279)..(279): n is a, c, g, or t
  misc_feature (330)..(330): n is a, c, g, or t
  misc_feature (356)..(356): n is a, c, g, or t
  misc_feature (381)..(381): n is a, c, g, or t
  misc_feature (401)..(401): n is a, c, g, or t
  misc_feature (439)..(439): n is a, c, g, or t
  misc_feature (490)..(490): n is a, c, g, or t
  misc_feature (518)..(518): n is a, c, g, or t
  misc_feature (521)..(521): n is a, c, g, or t
  misc_feature (525)..(525): n is a, c, g, or t
  misc_feature (611)..(611): n is a, c, g, or t
ncgctgtataccctcctccacttcccgctgcagccaatcaaaggccgttcgctaccatantgcngtgtcccgccgttcttttttccgcgagactgcagagttcagagggaagctgtacgccgcctttcgcnacgcgcgcnntntgcngancttcccctggacctcaggcctctccggctggagtagcggtggacgcttcacataagcttctctggtcgaacttacccgnatctccagatcggccgcgctgcgtcgaatgcnccncttgccgagccngangatgcgaggacgtcgccgcccctttgccgggtagcgcgaggctcgggggcngagtggagaggcgcaacgcgtggggncagagtggggagggtaaggtgggtncctcgtgcagtcaggacgtntagtccctgaaattgtgattctcaaaccgctactggtncggccgtgctgtgtgctggctcacaggctgctaatgctaacactttcccangccgaggcgggcagatcgcttggcccanganttcnagaccaacctagggcaacatagccataccctgtctacaaaaaaaattaaccgggcacgatggcgcctatagtcctaactactcagnt

SEQ ID NO: 533738 - DNA, 455 bp, Homo sapiens
ccatgttgttttggtaactttgaatatgccttttaacatgatgggtaatgtagagaggaggtgccagctgggcttcctgggtcaagtatggactcagaaagctgtgaaactcactcatttactgcaggaggacttacttcgatcctggatgaataatattgaagataaatgcttaaaatattcctaacaccaggatttgtgcatgtgttttcttccccaagaaagctataaacaatgaaaattttgctgtaagtttccctgtgtcctctcttcctctctcccttccccattcccgaaaactaaagtgaaagaaatgttaactgcctgtttttctgtaaccagtgggccttatctatactcctaattccagttccttgtaaacatcctttgtaaagtcccataagatcctgtctcctttgccatacagctgcaaggtcataaagtagataaaacct

SEQ ID NO: 533739 - DNA, 360 bp, Homo sapiens
aggacagtgtgaggggaaaggacaagtttgagatgccgttgcaaggaaaaaaaaggtctttatgctttcgcatgaggccacattcagctgctagtgaaacgtaatgtcttgaaccgagagaatgctgacgtttcctgcatgtccagagttgggcagtaggctacacttgaagagtagtactatttttataaaagggaatctattcaagtgtcttcacagatttcaagtctctcaaacatcaaggcaacttcagcaggcggtacaggtcacatttcattttgattgaatacatgatcttgaacagctcctggacttgctctttgtaaaaaaaaataaaattattttgagttattctaaaga

SEQ ID NO: 533740 - DNA, 371 bp, Homo sapiens
gcctattcgacggtgtctggggagagggaacattccgtgtagtgaccaacggtgtggttatgctgagtgtacagaatttaacagctcggatttgtgtgtttcgacacaggaaaattttacttcaacgccagtacaacggagggaggcatggttagctcacgcctgtaaccccagcactttgggaggccaaggtgggagaatcgcttgaacccaggaggtcgagaccagcctggggcacatggtgagatcctgtctcgacacacacatatacacacacaaacacacacacacacacacactctctgtataagtctattctagaattacccgcgcgtgatggcgcacctctaaggaggaccacatgcgactgg

SEQ ID NO: 533741 - DNA, 977 bp, Homo sapiens
  misc_feature (734)..(734): n is a, c, g, or t
gcactatgtacaggctccgcctgcccagtgacacatgtccaacggtcgcgggaccctaaccgggcaaaggtagcatactcactatgtggccttaaatagggacctgtatgaatggctccaggagggttcagctggctcttacttctaaccattgaaattgacctgtccgtgacagaggcgggcgatgacgcagcaaggacggagaagcagccttatggcagcttaaagtagattgaatattgcaaagacagtacactatacaaacccactagggtcctaagactaagccaagacctgacacttagaaacattactttcggtgggggcgagctctggagcagaaaccagagctccgagcagtacatgctaagacttcatcagatcaaggcgtacttactatactcaattgatccatctagcttgagcaacgggaagaggttatcctagggataacagcgcgaatcctatgctagagtccatatcgacaattgaggtgttgacgagctcgatgtggatcaggacatcccaatggtgcagccgctattaaaggttcgttgttcaacgattaaagtcctacgtgatctgagttcagaccggagtaatccaggtcggtttctatctacttcaaattcctccctgtacgaaaggacagagaaataagggctacttcacaaagcgccttcccccgtaaatgatatcatctcaattagtattattaccaaccaccaagaacnggttgtagatgggagcccggtatcggataaactaacctgaccgtccgagtcaattctcttctgaaatagcatggcaactctatctatgtgccatctatgagggtgctagctcgagaaattggattacatatgaggcagtgggcctggtatcactggagcgaatcagagcaacattaactaagggataggtttatcccccggggaagttttggctcgaacccgccctaaccttccccctctcga

SEQ ID NO: 533742 - DNA, 839 bp, Homo sapiens
  misc_feature (6)..(6): n is a, c, g, or t
  misc_feature (26)..(26): n is a, c, g, or t
  misc_feature (84)..(85): n is a, c, g, or t
  misc_feature (92)..(92): n is a, c, g, or t
  misc_feature (95)..(95): n is a, c, g, or t
  misc_feature (116)..(117): n is a, c, g, or t
  misc_feature (126)..(126): n is a, c, g, or t
  misc_feature (139)..(139): n is a, c, g, or t
  misc_feature (144)..(144): n is a, c, g, or t
  misc_feature (150)..(151): n is a, c, g, or t
  misc_feature (154)..(154): n is a, c, g, or t
  misc_feature (177)..(177): n is a, c, g, or t
  misc_feature (182)..(182): n is a, c, g, or t
  misc_feature (189)..(189): n is a, c, g, or t
  misc_feature (200)..(200): n is a, c, g, or t
  misc_feature (203)..(203): n is a, c, g, or t
  misc_feature (209)..(209): n is a, c, g, or t
  misc_feature (229)..(229): n is a, c, g, or t
  misc_feature (237)..(237): n is a, c, g, or t
  misc_feature (240)..(240): n is a, c, g, or t
  misc_feature (244)..(244): n is a, c, g, or t
  misc_feature (275)..(275): n is a, c, g, or t
  misc_feature (278)..(278): n is a, c, g, or t
  misc_feature (281)..(281): n is a, c, g, or t
  misc_feature (299)..(299): n is a, c, g, or t
  misc_feature (308)..(308): n is a, c, g, or t
  misc_feature (346)..(346): n is a, c, g, or t
  misc_feature (357)..(357): n is a, c, g, or t
  misc_feature (360)..(360): n is a, c, g, or t
  misc_feature (365)..(365): n is a, c, g, or t
  misc_feature (389)..(389): n is a, c, g, or t
  misc_feature (396)..(396): n is a, c, g, or t
  misc_feature (401)..(401): n is a, c, g, or t
  misc_feature (444)..(444): n is a, c, g, or t
  misc_feature (472)..(472): n is a, c, g, or t
  misc_feature (485)..(486): n is a, c, g, or t
  misc_feature (489)..(489): n is a, c, g, or t
  misc_feature (492)..(492): n is a, c, g, or t
  misc_feature (501)..(501): n is a, c, g, or t
  misc_feature (531)..(531): n is a, c, g, or t
  misc_feature (538)..(538): n is a, c, g, or t
  misc_feature (552)..(552): n is a, c, g, or t
  misc_feature (569)..(570): n is a, c, g, or t
  misc_feature (575)..(575): n is a, c, g, or t
  misc_feature (583)..(583): n is a, c, g, or t
  misc_feature (585)..(585): n is a, c, g, or t
  misc_feature (590)..(590): n is a, c, g, or t
  misc_feature (595)..(595): n is a, c, g, or t
  misc_feature (620)..(620): n is a, c, g, or t
  misc_feature (626)..(626): n is a, c, g, or t
  misc_feature (634)..(634): n is a, c, g, or t
  misc_feature (649)..(649): n is a, c, g, or t
  misc_feature (651)..(651): n is a, c, g, or t
  misc_feature (661)..(661): n is a, c, g, or t
  misc_feature (669)..(669): n is a, c, g, or t
  misc_feature (671)..(671): n is a, c, g, or t
  misc_feature (687)..(687): n is a, c, g, or t
  misc_feature (707)..(707): n is a, c, g, or t
  misc_feature (722)..(722): n is a, c, g, or t
  misc_feature (724)..(724): n is a, c, g, or t
  misc_feature (729)..(729): n is a, c, g, or t
  misc_feature (808)..(808): n is a, c, g, or t
tgaagngttccaactttatttaaaancagaaagccctgctaccatgcccccgctcctcagcattgctctagggggggggggggnngaactanggnccttctgccaagcccaggggnnagggggggnaccccttgcttgngaggnacaggnnggnctcctcacttcttctggggttgngcccnggcccgntgaatcttgtnagngggggncccatctgggggtcccgggnaggggganaanacgngggtcagctcagcctcattccggggttcganggncanatctgcagcctgagccanatcgccaanaagaagcaaagccttgaccttctgctcgggacccacgngggaagcatanttnttggnttcgtatttgttatgttgtttcangcagatntccanaaaagggagggagccaatgggggatttcttgctcttggaaaanttctctagctcttcccaatcttccaaanctgccaggggagnnagnttnagccaccanagcctcttgtcagggatgcggaagtcacgngccagcngctctgcacgcttnttgtgaccgccaaaaannagggnggtaactntnttatntaganacaggtctaggaactggccccccanctcgtnttctaggngccgctgcagccgtngngccgcatttnatcctctntngccttggctgcaaacncattcttggccttgtagaangcatcggcggctgtntncaganctgctactcgcccctcaatacgctcttctgcagcatagctggctcggatgtggaagctgcccaattcctggtgattgtnatcctgattgtaaaggtccttcagcgtctct

SEQ ID NO: 533743 - DNA, 470 bp, Homo sapiens
  misc_feature (304)..(304): n is a, c, g, or t
cggatctacagaagttcaagaaaatcctcgtggcaaaaagtaagcgagacacgggcgacttggtctgcacccaagtcgacgtgaagatcttcgacggtattcccgttatttcaacgccgccctgcggagacaactgcgttgctccgccgacccagaatcccacaggaacaggcgataacggtcccgaccaccaatgtgggggaacgtccggaggggagcttcccaagcctaggtcagcctcgaacttccggtcctgcggattgcccgtgaatgtggcaacgggagctatgtggcaccagttcancgacttctccattcccggaagaacaccggatacggaaatctccttcgttcgaacgtacacttcgagcccggctcagcagccaggcccgctcgggattcgctggcaacataattaccagactcacatcgaacgaagctcggttcctggctcgcaagacttgagctgg

SEQ ID NO: 533744 - DNA, 583 bp, Homo sapiens
ttgttatgtgagtgggcattaatctgggaagagtgggaccctgccagttagattagggctatcttggaggaatatgcggattcaatactgcaaatatttctgaaacaccttctgctttgtactctattagatacccaaagaaattttcatccttgaagcggaggaatttaatgatacctgaatgcctaactgttgtattctgcttatacagaatccaatctcaagatacttggggtgaagaatgatgattcacagaagggaagggacatcttacataaacaaataattgcagatacttgctaaagtgtatcccccaatctgggaaatactgtaaaggtgtatattattattgatgtaccaaagaagacagaataaattcataagagaaagtttatattcagtttactactacctagggttagattttagtttgttgttttttcagatgcaaatctacatgcagccttgcctggtagaagccagaagtgttgacagtattgaggacagcactcacatactgtgggaaagaataatacttgattaggacttattatttaatgaaatgaaaattttacaaaacaga

SEQ ID NO: 533745 - DNA, 195 bp, Homo sapiens
ctgttacgtgagcctagggtgttgtagcagtgtcacattcagtggatgcagtaggggcaagggcagcctcactcagggtgtagaataggaagtatgtgcctgcgttcgggcgtatctggctggttgcttgttcataattatgcctccatagggatagtacaaggcacaggggtcggctatgtgtttctgtcatgg

SEQ ID NO: 533746 - DNA, 1059 bp, Homo sapiens
  misc_feature (2)..(2): n is a, c, g, or t
  misc_feature (31)..(32): n is a, c, g, or t
  misc_feature (60)..(60): n is a, c, g, or t
  misc_feature (65)..(65): n is a, c, g, or t
  misc_feature (68)..(68): n is a, c, g, or t
  misc_feature (149)..(149): n is a, c, g, or t
anttcggcacagcaacctgcaggatctgcgnngacggcagcctcggcctgggcaggccanagcanctngtctaggacacaccttccctgagactcatgacatgagcctggggagacctcatttggtttccattcagaagaccagcgtanccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtgatggcgcgtgtatgttttattattgaggttgatgtgcacataatacgtcagtgtatatttttaccgagtgaggtctgtcttgtaaaaggagacaaggtgatcaccttgcccatgtttatttgtaagtctgtcaacttagcaatgacacagggtcactcctaaatgacttttttttttttttgccttgtgccttttgaagtatgtgttcattcagaggctgttttgattctcagactgaatcattcaaactctg

SEQ ID NO: 533747 - DNA, 461 bp, Homo sapiens
aagcagtggtatcaacgcagagtggttatggccgggatgactttataaagctacaagtataccccaaaaaaaaaaaaaaaaaattaaaacaaaaatataaaaaaaaaaagaaaaaaaaaatgtgtgtttggggccgccttgggccgcagcgaggaaaagttttcataacacccgtcgtggttgggggggcggggaccccaaggtatggtgaatcggctgcaaactgggcgccaaccccggggcttccccaaagggagacccccggcggcactcgcaccatggcgggcggggggcttccttcacaataataaaaaacgcccgcgggggggaaaaccgggccgggtctggagcacaatctcaacgaggaggagcttccggaggcgccacatacccggggctcccaatccacacggggcgtccacaagcgggcgccagatataaaaataagcccggggcggggc

SEQ ID NO: 533748 - DNA, 787 bp, Homo sapiens
  misc_feature (2)..(2): n is a, c, g, or t
  misc_feature (31)..(32): n is a, c, g, or t
  misc_feature (60)..(60): n is a, c, g, or t
  misc_feature (65)..(65): n is a, c, g, or t
  misc_feature (68)..(68): n is a, c, g, or t
  misc_feature (149)..(149): n is a, c, g, or t
anttcggcacagcaacctgcaggatctgcgnngacggcagcctcggcctgggcaggccanagcanctngtctaggacacaccttccctgagactcatgacatgagcctggggagacctcatttggtttccattcagaagaccagcgtanccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccata

SEQ ID NO: 533749 - DNA, 982 bp, Homo sapiens
gtgttgtggtgctagtttgtctaagtcatccagatgccatcctcgtcggtgcgaagtgacataggctactcgtcgccggcaagactgagcagatgacccttcgtggcaccctcaaggagccacaatggttgggtaacccagatcgctactatcccgcagttcccggacaggatcctctccgcctctccgagataagaccatcatcttgatggaacatctgagcacagtggaatagagaaccaaatcgtatggatatgtccatcgatgcgatggctctgctggggtgtcaagtcccagctttgttgatggtagatgtgtctatatctcctcaggatggcctaggttggtgcctctctcagtgctccttggggtatggaactcctgcgcctctggggatctcacaaagggctaccagacatagaggctgattagtggggccagaacgcaaggatgtgcttggagttgtgggcttctcctcgtgacaacctggcaggattgtctctggatctcgagataaaaccaatcaatgcttatggaataccctgggtgtgtgcaaaatacactgtccaggatgcgagccacttcaggagtgggtgtcttgtgtccgttctcgcccaacagcagcaagccctatcatcgatcatcctgtggctgggacaaaggctgcgtcagaggtatggaaccctggctaacttgccgagcttgagagacaacgacattgggcacaacatggactatcttgaacacgggtgactgtctctccgagattggatcccctctgtagctttctgaggacaagatggccagagcattgttatgggattctcaacggaaaaggcaaatacctttaaccaggctagaatgggtggggaacattactcaagccctgtgtaacgcctaaccgtctggcttttttgcacagccccactcaacacttgattcaggacagactttgatgactgtagaattcaacacaaaggaa

SEQ ID NO: 533750 - DNA, 282 bp, Homo sapiens
  misc_feature (1)..(1): n is a, c, g, or t
ntgactctaccgatccttaccgtagcgcacaacaaacagcatcatactgcagtggacactagctgggtgtactgtaattcaattccaatactatactacctggagataacatcagaatccacaggttgaaggctcagtccccaagactgccccccttcttcagaccaccaagtcaacaaagaccccagactctggaacttctgactcaccctgccttgaacgatgagtttcccatactccctccttgggcgtacgggagtaccgacgctacgcaatatccgg

SEQ ID NO: 533751 - DNA, 197 bp, Homo sapiens
cccacgatcacgataaagaccagcaactaggagccgctggagggggcagaacaggttggagcgtccgttcaaagcttcatgctcagtgagctgcaatacctggccactgccctccagcctgatgctaaagcaagacctgtctcttaatatatatgtgtgtgtgtgtgtgtgtgtgtgtgtagatcgtggggttagta

SEQ ID NO: 533752 - DNA, 261 bp, Homo sapiens
  misc_feature (51)..(51): n is a, c, g, or t
cgagtcggtaccctcgcgaacgtgtatccgcacgcactgcattcccaccgnggatacagggcgagacctgccacccaaaaaaaaagggtcatcagcggctacagggagagagcttcagagaggggcagcagattatccagttaggagatgatgggaatagaggacaagggtgatggagggtggctagctggttcctataaactttctttggatattctacctggtctggggttaatcgggtgaggataacaggttcgcgag

SEQ ID NO: 533753 - DNA, 334 bp, Homo sapiens
gtctgtaatgtgaggactctgcctggtgccagtctggaagtgaggagcgtctctgcctgccgcatcccatctaggaagtgaggagcgcctcttcccggccgccatcccatctaggaagtgaggagtgtctctgccctgggcacccaatcgtcgtgagatgtggtggagcgcctcatgccctgcggccccgtcttgggatgtgaggagcgcctctcgccggtgcgcgaccccctttctgggagtgtgaggacctgtctctgcccatgccgcccctgtctgagaaactgaggagacctctgcccggagagcaaccccatcagaggagaggctgcag

SEQ ID NO: 533754 - DNA, 336 bp, Homo sapiens
ggtgactctagcaggatcccttccctttgtctgcaaagaatataattaaaaattaggctgggcgtgggggctcacacctatatcccagcactttgggaggccaaggcaagcagatcacctgaggtcaggagattgagaccagcctgatcaacatggagaaaccccgtccctactaaaaatacaaaattagccaggcatggtggcgcatgcctgtaatcccagctactcagcaggctgaggcaggagaatcgcttgaacctaggagatggaggctgtggtgagccaagattgtgccattgcactccagcttgggcaacaagaccaaaattccatctc

SEQ ID NO: 533755 - DNA, 272 bp, Homo sapiens
gggggctgcaagtggctggcattgagacgtgggaactgatgctggatggattgcctttccctgccagaagactgtgggcatggttgtcctggggaatggctgcaatggtccaaatgggggacccgggattggccccctggcttaagcaattggcttgcccaacaattggtggggcccggccggcccctcaaagggctggggtaaatttcaaacttgaaaccttcgggaaacaatttaacttgacccttggcccaagggggggtttgggcccc

SEQ ID NO: 533756 - DNA, 349 bp, Homo sapiens
aactccattttaatgcttttcaatgatttcatgcaattgacagaattttcatactttgtgtgtgtggttttttttaaaatgactttttttgttaacttcagacatatttgattacttttagaaggtagaaattgctactaactttgtgtattgaataagtaagaaattgcatcctgattttttccttttattaatagcaagattgaatacttgtgtattttgaatagctacattttccctttggtcaaatgtcagtgtccttttccttgtgatatcttttggagttgctttgtttttcatatcaagttagaggatctctttatataataaaattacttaactgataaaa

SEQ ID NO: 533757 - DNA, 98 bp, Homo sapiens
tcacagttgatgagaaatagagcagcagcaaaagcaaacaatgctacagcacaaaactaaatgcacttcagaaaaacattttttaaaaattactcttg

SEQ ID NO: 533758 - DNA, 354 bp, Homo sapiens
  misc_feature (18)..(18): n is a, c, g, or t
  misc_feature (88)..(88): n is a, c, g, or t
  misc_feature (105)..(105): n is a, c, g, or t
  misc_feature (118)..(118): n is a, c, g, or t
  misc_feature (222)..(222): n is a, c, g, or t
  misc_feature (262)..(262): n is a, c, g, or t
aaaagtgattaaaatatnaacttaaaaatgtgtttgatggggtgcacaatataaatggcatgtaatggtctcactttatatttaaagnacatacataggctgagnaatgaagggtggnaaaaaaaaaactccatgcaaatggccaaccaaaagagagcaggggtggctacctttatatcaggcaaaatagactaattcaaaaatggctgcaagacacaaagnatggccataatgtaacgataaaagagtcaattcagcaganacatatatatatatatgtgtatatatatatatgtatatgtatatatatacgtatatgtatatatgtgtgtgtgtgtgtgtgtgtgtatatgt

SEQ ID NO: 533759 - DNA, 169 bp, Homo sapiens
gagctttgcagttttgcaccagctattcttctgatcagattaccttttccacacttcttcctttgaccaagccctactcctccctcaaggctcaacccaagtgtcacctcctccgggaccctgccaacatcctgtgctcacctccatcagaattctcaaccaccagtca

SEQ ID NO: 533760 - DNA, 397 bp, Homo sapiens
cagattagccttggttcctaattttcaatcggtaccagggggatgataactttacctacttcctaaagttgatgtgaggaatactggggctaatatatttaaccagttatagcaaggccaagcatgtaataggggaatttaaaagctggctgttttaatgtaaaatatagctgcctaattattaagcctctttatggggggaaataggctactataattttaggcaaaataattgggttgtagagaaccaaaccaggtggttccactttactctttgaccattaattggaaataaatacttaggtccattaattaaattaacttttaaaactaagcaggtggttaatccaaggagggaatattattagcaggaactgcatatttaagctggttcttt

SEQ ID NO: 533761 - DNA, 250 bp, Homo sapiens
gtgttttccatggctatgtagggacctaatcaaagtcgagttccataatatgcgacataaattcttttcctccatattcttaaattagcagtagctagtgtagttattttgtggtcattctatcgatctctctaggactctattccatcagaggatccaagtgtgtagatcgcatatatacgatttcgctctcttcttcctcccattatttcccttcacacaattagccccttccaagggctttcactat

SEQ ID NO: 533762 - DNA, 1152 bp, Homo sapiens
gggcttgtcgaggacagccatcgcggacctggctatctagtgcttgtgcgtcattcgcggtaccataagtcccgtagccagtatgccgtagaactgaatcacgatcctggatttaggccagtgttgtctgctcaagaattgcgagagtgccgtactgtactggatgcattctagctgggggctttaatactagcggcgactcacatgtcctctgaatgcgtgcagtacttgcgtgcaacatgagcgacgtaacatatggcgaggcattgatgatgaacccacttgctacatgttccaggcgttaagccggacggcgctggcttgacgcaccagtcgctacgccgtaggcggggtcgtcccagtaagactaaggcgatagcgcgagttgggtcgattcagactagtaaagattcagcgagcctaggcgtttcctttacctgtcaaagcgaccttagcaagcagtatggagactgatttctcatatccaccatggctgagaaagaaatagttgtcttgtggccacccgctatgggcgtattgcccacgcgcacgggcgcgcgacgttaacacttcgactgtgatgccacatgagttcagtacttcccggtcttggagcccatactcggttgagtctcgccgagggccgggatagtttttccggatgaccatgcccttagtgggtctccgctatgcccatgggtggtcgatccccgcgcccctttctacgaaggcgggaagcctcgctcgttgtgtggtttccgttaccctgaaggggggcctttcaccggtgacgacaaggcgcgcacaaaacctgggtgtgctcctgttgcgggttttcggatcgcggttggcccctcctgtgtcggtgcaaaagttgggaaaaaaagggggcccctgtgcggtgctaagccaatgtcgcacatggtgagtgttgtcacaccaagggaacgcggcggtaacgaaacgttcgcctgtgctcattccttagcgattcaccgaagtggtgacaacactccaataaaatatcactccgagagggaattttcccacatccaaggggcgttgagtaagcattatggaaggacggcacggtataaggatggtgcacatatgacacgttgctatgcaggcgaccaagtggaccgaagcggt

SEQ ID NO: 533763 - DNA, 402 bp, Homo sapiens
agcatttgacattgtatatatacttcaaaacatcatgttttacagaaaaaaatgcattttatgtcacatcaaaaaattcatttttaaaacattatagaaagataataatgtttcaaatactgtgtctgtttcataaacttggctgaatagtatcaaaaatacttagttcttgtgtggcttttgtcatctgtcataatcacagaaactctgatatttaacagcatgttctggacccagtacagtctgtgggaaaagccagtgtactttagggtttttactttaagcttggggtacctggagtttctggtacagatggtaatggtatgaaagacactaaaagggcaggtgttgcttatggtcccatgacaccattctgtgaaggcagaacacaaatttgcatgc

SEQ ID NO: 533764 - DNA, 292 bp, Homo sapiens
  misc_feature (213)..(213): n is a, c, g, or t
aacaagtttgtttactttgacacccacgtataactaacaaggatctattgagtcagagattgagtaacttgccagagcctgtttggaaatagaccctgaggatttttcagtatcagtggttggttatgcaatgtctgtggcacgccctataaactaagagaccaaaccttaaaagtgttaaaacaggaaaggcatgttattacttactacatnactttgttatacaaggaactataacttattacagtccgatcatttctggccttgatagtttagggttttagagaagctg

SEQ ID NO: 533765 - DNA, 461 bp, Homo sapiens
aaggcagtggtatcaacgcagagtgcccattatggccgggggggggaaaaaaaaaaaggaaaaaaaaaaaaaaaaaaaaaaaaaaaaaatattggggggggcgtggacgtggaaagaagttttttataaaccattgcgtgttgggggcggcgcggccccaatatgtgtttagtgcacatgggggtgaaagagggggtaccagagagaaaaccccggcggcacaacggacaactgggtggcgtggggtttcttccccaattaaaaaaaaggcggcggggcgggacagcacaggaggcgggtctcctgacacaaactccaacaaggggggccccgagggagggccaacagcggggagactctacccaacccacaggaggcgcccacagggggaagcgcgcggcgagtacaacaaacttaaccgcccccgccccgggaggctaggacaaacatagacagagaga

SEQ ID NO: 533766 - DNA, 892 bp, Homo sapiens
ggcgggagggcgctgaagatcggggcgctcggcgcaggccgcctccagcgccgcgggatgtagcgcgggggaccgcggacctcagtcagagcccgcctgcccggtcttgtctaccatcatgagggagatctctgcctccctggggtctgagagaccccaaactttccccaagctgaagctgcagggtattgacggtacctgccagatggtcttcccacaaaggatctgtggtggctacaggtgaatggggctcctgcctagtaacatgggcaagtctgtacacggtggaactgtgctgatactgggacccctgctagaatgagaaggtgcaaacgggtaatcgcctagccacccaaagttgaagaagagcaaacatgcccagtgcccctaggaagaagaggaggaggtgcgggtacttgcgcacttcccccttgcatgcccaccacgccgtggaggactatggatgagtttgtgtcccaggtcttgggaggtgaccttggacggtctatcccgatatgatgtgctcgctgattggtgtacacggacaatgacatatcttgtgtacagtggtcggtatacctcgcatgcactcttttcgcgcttgtttcaagaagcatcttccggcatttattccagaaagtggcagcacatctggaccacatcatgcttggcttgtcgtgctgtatgtcttttgtgagttttgacctattgctcagactacaattgtctccatgccccttacgggaaaggggctctgggcagtctgtagcgtgcagggtcttctcgacttccctggctttgaaaccggactgtcgtcacgaacgcccggacttcagttgctataggatgcttacaagggagcttgtccgggctttactcatgcccacaggat

SEQ ID NO: 533767 - DNA, 796 bp, Homo sapiens
gcgtcccccggtagagctttatggcccccaccccgggtacagttgggtccatctttcggtgaaaccctgttcgaacctggttttttataacgggtatctgccccgggtccgtgactacttgacccatctttcaaggttactgggaaatcactttatcttcgccctgatgccctccctagatattgtactgttgcttaaccaaggattctccacttggtggcatccggcaccagcctttattatctcctgatttctatggatccaaaatgctaggcaccctttaattgggtgctcctgggtcaaggtctttgttgaggttccagccaactattggcccgggctgtggtctcatctgaaggcccgagagagagagaaaaaggggagggaatctgttttccatttcacttacaccattattggccggtccttctacgctgggctgaatgaccacctggtagctgacttcccctaggaagagagaccaagaaagccggagtgagaaagtgagagttagagccgaccagagagattgagccagaaaatgtgccaccatatgcaccccaatggccctgaagaccgaagtccaccatctttctgtgatctaatcttgaagtaaccatctcatcagtttttcatatttgttagaagcaagtcaacttcagcacattacccaggagagaaattacacacaggttgtgaaataccacgaaccctggctcgttgtgatccatcctagggagtatttgatgcactgtcctgggccaatggcagaaataaattccatatccaaccccca

SEQ ID NO: 533768 - DNA, 244 bp, Homo sapiens
  misc_feature (24)..(24): n is a, c, g, or t
  misc_feature (28)..(28): n is a, c, g, or t
  misc_feature (165)..(165): n is a, c, g, or t
  misc_feature (175)..(175): n is a, c, g, or t
agccgctcaggtgaatggcgctanaacngggcactgtgctctgtttgctggctctcctggttctggtgaacagctgatgagctcggctgtcaggacatgaactgcatccgccagcccaccatgtgccctgctgcgcagtggtggaggggccgacgcctcgtggtnctgctcagtngcctcgtgctgctggtcaccggcctgaccctggccggctggcgccgcccctgcccctgctcggccgctg

SEQ ID NO: 533769 - DNA, 101 bp, Homo sapiens
acttcgtggacccaatcctactattcccgcctaggcctcccaaagtgctgggattacaggcatgagctagaatgccaaacgaatctttttcctaaactaca

SEQ ID NO: 533770 - DNA, 822 bp, Homo sapiens
  misc_feature (102)..(102): n is a, c, g, or t
  misc_feature (330)..(330): n is a, c, g, or t
  misc_feature (493)..(493): n is a, c, g, or t
  misc_feature (496)..(496): n is a, c, g, or t
  misc_feature (500)..(500): n is a, c, g, or t
  misc_feature (504)..(504): n is a, c, g, or t
  misc_feature (507)..(507): n is a, c, g, or t
  misc_feature (521)..(521): n is a, c, g, or t
  misc_feature (543)..(543): n is a, c, g, or t
  misc_feature (546)..(546): n is a, c, g, or t
  misc_feature (558)..(558): n is a, c, g, or t
  misc_feature (580)..(580): n is a, c, g, or t
  misc_feature (585)..(585): n is a, c, g, or t
  misc_feature (591)..(591): n is a, c, g, or t
  misc_feature (595)..(596): n is a, c, g, or t
  misc_feature (617)..(617): n is a, c, g, or t
  misc_feature (622)..(622): n is a, c, g, or t
  misc_feature (633)..(633): n is a, c, g, or t
  misc_feature (642)..(642): n is a, c, g, or t
  misc_feature (644)..(644): n is a, c, g, or t
  misc_feature (652)..(653): n is a, c, g, or t
  misc_feature (663)..(663): n is a, c, g, or t
  misc_feature (671)..(672): n is a, c, g, or t
  misc_feature (677)..(677): n is a, c, g, or t
  misc_feature (700)..(700): n is a, c, g, or t
  misc_feature (739)..(739): n is a, c, g, or t
  misc_feature (743)..(744): n is a, c, g, or t
  misc_feature (754)..(755): n is a, c, g, or t
  misc_feature (761)..(761): n is a, c, g, or t
  misc_feature (782)..(782): n is a, c, g, or t
gaccggccgggccatgggcgccgggggcagaggcggaggcggcagaggcggaggcggcagaggctgcccgggcggcggcgaggggccggcggcgcgggacgngggccgggtagcgccgggccgagcgcggaccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcgcaggccccgcagaggctgtccttctacagctggtacggcagtgccangctcttccgcttccgcgtgcccccagatgctgtgcttctacgctggctcctgcaggtctcccgggagagcggcgctgcctgcaccgacgcggagatcaccgttgcacttccgttccggcgcccctccggtcatcaacccggctgtggcaccagctttcccggnacnacanccgnggntacagaccctcctntccaggttcgggggttgccggntgnagcaccaacagncgaggaagcaaatgccttccgntcaangttttngggnnccgggcccccgggggactggnttccntggccgcccancttgccccncngcagtccnngaaaaatcgnattgaaannggctnggtctcccaccctgtgcctgcgntcttccagcccggaatctgctgggtcacgcgggggggtngagnntttccatcannggggcnggacgttgccccttccctcanaaccctcctctcccaatcccagactacctcaagggtcttt

SEQ ID NO: 533771 - DNA, 332 bp, Homo sapiens
tccccatcactaccatcaacatttttcatagaattagaaaaaaatttaaaagttatataaaaccaaaaaagaaatcgcagagccaagacaatcctaagcaaaaaaaaaaaaaaaaacccaaggtgggaggcttcacactaccggatttcaaattttactacaaggccacagtaaccaaaacagcttggtccgggtacaaaaacgggcacttagacaatgggaacagattatggacctcaaaattaacaccacacattccataaccatcgtgatctcaacaaccccaatgaaaaagcaagggggcagggattcccaatttaaataacgggggg

SEQ ID NO: 533772 - DNA, 511 bp, Homo sapiens
  misc_feature (3)..(3): n is a, c, g, or t
cgntttatcataggaggtgggttcttaccaccctgtttccctcagcaaaatgaaactgtcccttttgcctctgtaggcaatcttctgaacaaggcattcctaatattcttatctcatcttattttatcttatcctcttctctgtaccttgtttacatgcttctggaacacttgtgtgtcttgcacccatctcctgcattatttaggcaatcctaacagaaggccgctaggatggattggaagagaactgctggcatattgagccctctctctttgtatctggaactttcataattaccttagttctccatgccaattttgcacttatctttgttctccacttcaaaatacatttacctctgacagctactcaggaggctgaggcaggaggatcccttgagttcaggagtttaagaccagcctggacaacataggaagatcccatctcaattttttaaaatgagaaaaaaaatagataaacttaaacatattaaaattttaaagagtttatt

SEQ ID NO: 533773 - DNA, 1214 bp, Homo sapiens
tataacaaactgtccttattttcaaagtgaaaactgcggaacattaataatttttcacccggtggagctccccaaaagccctggtgtgcccagtaaacccctgtgtgtgggcgagaggacaatgaggcggggacctccgggagcttccttgaaaggcgccgtgttctgtgggcagcacaggtgacatttatttcacgttcaggcgacgcggaacatttgacatctctaggaagttggggacaacgtgaaaagaacccattcctcctcaacttcccgaggacggggtgccaggtcccccttaaaaaaggcaacaatgtggcaggtgcaggttgtgggcacaagtgtggttgtgagtctgttcaggggtctcgacacaaagggaccaccactgagtgattactcgttgtttgtccccccgaggactcacgtgtgagttaaagaccccctcttctgtgtggaaaaagcgtgggagcttgaaggcgagagggaccccgagcggtggtgcacaggagagtatgtcccccaaggggcgcatatcaccttcgggaggcgacaagggccagatataccacccaaagagattcgtatatagacgtcccgagagaataaacgccggtgccaatgacagcaacccttttccctcttacaataaaaggtgcccaagggggcgccttttttggtgacgcagttaagagaggcgagaccaaaaccatgtttgcagaagaggggttgttaagaaaagtacgtcgtctcgatgatacagacacatcctcagttaagccgtttagttttgcgccccagagacataagcacggacatcacggagtgttatgactccccactattttgagggcatccaggctgtatcacacaagtgagaaaacacccatcataagcagcgtttctccaaattgcacaccactcctagcagcaccagtggcagcacgcaatgtttttaggtgattcgtttggcagatacaaaaccccggggttgagggaacacatactcaagaagctgcctatccccattaacgagaaatttaaaatctcggggggaacgcccccacaacaaaattgtaccgtggctcctctgagagacagacataagattcctacagatacatcgacaacataatggatgcttccacatacgagtataatccaaccacacaaacaactatagtgctatacaaacgtgtgataatgacaaattg

SEQ ID NO: 533774 - DNA, 143 bp, Homo sapiens
cagccccgcaagacgccatgtatacgggcattgctgacaggatgcagaacggagatcaccgccctggtgcccagcaccactgaatatcaatgatcatctgcacccccaagagcgcaagtactacggtgtggatcaggtggctc

SEQ ID NO: 533775 - DNA, 793 bp, Homo sapiens
  misc_feature (1)..(1): n is a, c, g, or t
nggaaccaggtttaaaaatccccgaaatgtaaaccattctttctggcgatggccgctgagtttaataaggaatgggttccggaaccaacaagttggtggtgctcagaagtcccaatgttaaaattaagagcgttcccgttcaatcaatcaggtggagggtcttgggtaaaaatttgcctcaatcctgttctctcaagcatgactttcgcattgtgaccccaagtgaaaaatcaatattgcctaaattgaattgtatgtaaccgcattccaacagatttttccggtctccacaaaggtcacagattgtaaatggacgaacgacctttttttttattcccaggacccaagacagttaatttcacttcaaaaactgttttagacctctgtgggctggtttatacaacaatgtgcgaacccttgttgctctcatgaaagcagattgttttacgaggtgggtcagaaaatataggctttcgatgtaaaaataggcatgtttaaatgtcagtcttagtcctaggaacatcaagttcacccattttgtatcatagagctcaagcagtgtttgtccctttccattcataaagtatagttggatgttatatgtaacgtttgctttgctagttctcccctgtacaggcacaaaagggaaagctccaccctatcaataacagccttttccctccccgcaaaaaatatgtggttcccaaatattgttatttggtgcaccctaggtatcgcagccgcctaaaacatggctaacgaattctgaccttttgggaggctctacctgcac

SEQ ID NO: 533776 - DNA, 122 bp, Homo sapiens
gggtgttcaggtgcagttcgtccacattctcagatttgaacggataatatcgtaccaagtaataaaaaaaatactagatgctacgacacttaacactcatagtacatacatatggggatcct

SEQ ID NO: 533777 - DNA, 380 bp, Homo sapiens
  misc_feature (35)..(35): n is a, c, g, or t
  misc_feature (75)..(75): n is a, c, g, or t
  misc_feature (80)..(80): n is a, c, g, or t
  misc_feature (90)..(90): n is a, c, g, or t
  misc_feature (102)..(103): n is a, c, g, or t
  misc_feature (123)..(123): n is a, c, g, or t
  misc_feature (125)..(125): n is a, c, g, or t
  misc_feature (157)..(157): n is a, c, g, or t
  misc_feature (163)..(164): n is a, c, g, or t
  misc_feature (172)..(172): n is a, c, g, or t
  misc_feature (187)..(187): n is a, c, g, or t
  misc_feature (194)..(194): n is a, c, g, or t
  misc_feature (199)..(199): n is a, c, g, or t
  misc_feature (217)..(217): n is a, c, g, or t
  misc_feature (235)..(235): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (260)..(261): n is a, c, g, or t
  misc_feature (294)..(295): n is a, c, g, or t
  misc_feature (313)..(313): n is a, c, g, or t
  misc_feature (315)..(315): n is a, c, g, or t
  misc_feature (329)..(329): n is a, c, g, or t
  misc_feature (340)..(340): n is a, c, g, or t
  misc_feature (350)..(350): n is a, c, g, or t
  misc_feature (352)..(353): n is a, c, g, or t
  misc_feature (356)..(357): n is a, c, g, or t
  misc_feature (361)..(364): n is a, c, g, or t
  misc_feature (366)..(366): n is a, c, g, or t
  misc_feature (368)..(369): n is a, c, g, or t
  misc_feature (374)..(374): n is a, c, g, or t
  misc_feature (377)..(377): n is a, c, g, or t
ttgtcagtgcacagtttgcgcagttccaatagtgnttgattcacatttttttccaaatgtaatgcacactccatngcatncagccgtctntcacagtcatcnnagtgtggtttcttgatatcntnaagaaagattcgcccacctcgttggttccgcngcttcnncagtttcncggcatgttccctcncctcatnagatnggtaaagaaagtattggncaaagttcttcaaagccncntcntcncggtcaaagtagtaacnnatgcacagtgtaaccgtaggaggcgtagagccnnaggttgatctggcggttnanggccgcctcagagntctgggtgtanctctcgcgcncnngcnntgtnnnngngnntctcntgnccc

SEQ ID NO: 533778 - DNA, 137 bp, Homo sapiens
  misc_feature (120)..(120): n is a, c, g, or t
gggcaggggagaaaatattcatgtggaacacttttgtaaaaccccttaaattgaggagactgaaattatgagctctaggccgggcgtggtggctcacacctgcaatcccagcacctttanaaagtcaatcacactgt

SEQ ID NO: 533779 - DNA, 729 bp, Homo sapiens
  misc_feature (9)..(9): n is a, c, g, or t
  misc_feature (12)..(12): n is a, c, g, or t
  misc_feature (98)..(98): n is a, c, g, or t
ggtcgtctnggncgggatgttgttgatgccgcaaccgctcagcacgctgctgatcagtaacagcgccgcagccttgaagccccagcgataagtgtgtnctgcttgcatagtgtttctcctgcccgatctgatggaatgtgacgactaaccctataaaccacgcgcttggggcataatccgccaccactggaatgcttcgagccaatcagctacaaagatgcccagcgcgaaaaagagttcagagtgtgctgcatttatctgaacaacacccgaacaacaatagacgttccccacattttggccgacagcatctctctgaatgctgcgcagtcgccgaaaaaggatattcatgaaaaagctgtgcttgctcggccttgttgccactctggccagccaccccgtatgggcagaaacaaagcctgctgcgcttaacgacaaggacgccttcgtcagcgacctgctcaagcaaatgaccctggatgagaagatcggccaattgcgcctgatcagcatcggcccggaaatgccccgcgagctgatccgcaaggaaatcgccgccggccgcatcggtggcacgttcaactccatcacccgcccggaaaaccgtccgatgcaggacgcggccatgcgcagccgcttgaagatcccgatgttcttcgcctatgacgtgatccacggccaccgcaccatttcccgatcagctggcctggctcaagtgagaagaccagg

SEQ ID NO: 533780 - DNA, 858 bp, Homo sapiens
gctctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctactcgggagactgaggcaggagaatcacttgaacccgggaggcagaggttgcagtgagctgagatcgcgccacggcacttcagccgggggaacagagtgagacttcatctcaaaaaaaaaaaaaaaaaaaaaaaaaaaaaaaaaaaaaaagggggggggcgaaaaaagcccccgggggcgcctcaagagcaggggcagctcacccccgacttttcggtagcaccaggggggtgggccccagaaaggggaggggccgagtgaatagaaagaccaacggaagcagggagcgggaatctacaagggatgtgactggagcgggaacacaactcgcatgaggcggggctctatggggcaggggagacccacttccatgggggcggggggaccatcacggggagcaactagcgcaacaaatatcacggccacgggcggggcacaacagacactgtgggcagcgaagatacgcggtgtgcagaccgccggattatgcaggccggaacaaattcgttgccacgacgatgggttgaggaacaatttttccggggggggcggtaaacccgctctcaggccatgtccacaggtctcgcagtacaggctcaggaagcggtcacactgaatggcacaagatgacacaaccgaggggacagaggaagggcaac

SEQ ID NO: 533781 - DNA, 248 bp, Homo sapiens
tatttgcaggatcctaatgggtgaggtggtatctcattgtggttttgatttgcatttccctaatgagtgatgttgagcatctttttatgttcttgtcagccatttgtctatctttggagaaatggctattcaagtccattgaccatatttctaaaaaaagagattgtttgattttttgttgttgctgaattgtaggagttctttatatattgtgaattttaattccacatcagttacataatttgcca

SEQ ID NO: 533782 - DNA, 129 bp, Homo sapiens
ctttaagggacatagacatttatgacagaattaacaaatatttacaacagaatacaagtactacctataaaaatgttagctgtaagcgcttcttaaaggtaaacatgtaatcttcattaaattacttac

SEQ ID NO: 533783 - DNA, 1582 bp, Homo sapiens
cccgccccccccctcgctaggtagaggcctggtgttaatcggccgaggccaagattgcacagcttggaggagcagctggacaacgagaccaaggcagcgccaggcagcctgcaaacaggtgcgtcggaccgagaagaagctgaaggatgtgctgctgcatggtgtgatgactgatgcgtgagtgaactgcctgatgcagtacaatggaccatgtgccgacaatggcatctaccctgcctgaatgcatgctcaatgctggcagcttggaggaggcctgaatgcaggatgtgcccatgctgggccaactgcctcccgaccggaaaccttgcatgctgcgacgctggacggaccgccacgtagagacaggcctgagtgccattgaaacctgcgagagtcattcgctcctctaacatgaacagaggctcaagtgctgcagtggtgatcctgcccggttcgtgtccgctgaccacgcgacccgcaaactggcacccgtcgcacaagtgccgcccgtgcgcgactgcgccctccggaaccgaacgcacgcgcatagacatggtcaaacgcacggtcctggcgccctgcacgcgcccacacaccccatgcccggacagtcagatgacccctcctatatcgatcagcatatgcaaggccctctgcagaaactagtgaatgggacacagccaccacgtaccaacgcaacacggacctatcagcggtttacacatagccacctagcccgtaccaaagcgcccgggcccttcctacgacacaagcagcttcctatatggcggaaacagcctatgatgcaatccacttgtccctacacaatcacattgacaccatcacatacaacttcactacaccactaaccacaattcaaaccacaaatatcatacctaactaaacataacaaaaacaaaaacagaatcaaacgaaactctactcttcaccaccaacaaaacaaacccaacacataaaaactacccactccacccctatgacccggatttaacgagaaaaaacaataacggagagaactaggagcacgatacaacacacaggagccagctcactacagtgaatgcaattaactggaaccgacccgaacagcgagctatcagagggccagacatacagctacgtcaggaatggcattcaaccctgacgccccaccaaaggcagccagaacggatggggacgcgaacgacagactagtcagcatcagtgaaagagaacatacctcgcagcaacctccaccgggtcatgctaaggacacagatggatccggacgtcatataggaagatgaacgagccggtgacggcatcgaaatacatgactgactcaatcactatatcactctggactatcataccactccaccatcagacaccaatcaccagcatacacaatgccactcacaccaacaccccatcactccctttcaccatccatatccaacactcagacttatcaatcacactcctccccgcccatcaccactgacaacaccaaacaaccacagcctcaccactcacacatcaaacaaacacatctgccaccaccacaccacaccgaacctca

SEQ ID NO: 533784 - DNA, 114 bp, Homo sapiens
catggagagtaccgggacgtgtcctggagccatacctgaatctcacccttcttagtgacagctcctccccctcctctgtgctgtccaactcctctgtgctgtccatgctgtcca

SEQ ID NO: 533785 - DNA, 199 bp, Homo sapiens
  misc_feature (26)..(26): n is a, c, g, or t
  misc_feature (36)..(36): n is a, c, g, or t
  misc_feature (68)..(68): n is a, c, g, or t
  misc_feature (105)..(105): n is a, c, g, or t
  misc_feature (162)..(162): n is a, c, g, or t
cgcttatacttctcatttcatttccnggtatgaagnataagcgttgagagaagtataaagcgttgagngaagtataagcgttgagagaagtataaagcgttgagngaagtataaagcgttgagagaagtataaagcgttgagagaagtataaagcgttgagngaagtataaagcgttgagagaagtataaagcgttgag

SEQ ID NO: 533786 - DNA, 257 bp, Homo sapiens
ggacttatcataaggtcctacatacttccaccattattcctagaaccaggtgacctgcgactccttgacgttgacaatcgagtagtactcccgattaaagcccccatttgtataataattacatcacaagacgtcttgcactcatgacctgtccccacattaggcttaaaaacagatgcaattcccggacgtctaaaccaaaccactttcaccgaaacccgaccggggggtatataacggtcaatgctctgaaatct

SEQ ID NO: 533787 - DNA, 344 bp, Homo sapiens
  misc_feature (180)..(180): n is a, c, g, or t
agtagccctgtccagcttgaggtagtagccctttcccagcatgaggtagtagccctttccagcttggaggtagtagctctttccagcttgaggtagtagccctttccagcttgaggtagtagccctttccagcttgaggtagtagctctttccagcttgaggtagtagccctttccagcntgaggtagtagccctttccagcttgaggtagtagctctttccagcttgaggtagtagccctttccagcttgaggtagtagccctttccagcttgaggtagtagccctttccagcttgaggtagtagccctttccagcatgaggtagtagccctttccagcttga

SEQ ID NO: 533788 - DNA, 715 bp, Homo sapiens
agaggtgagattccgtctcaaaaaaaaaaaagaaaaggaaaaaaaatagcataatacctcttcctggtctcaaccgccatgaaaattctgaacactccaaatttcaggggaattaatccaaaacaaaattttataacgtataagaataatttctacttgcttatagtaatagtatactttaaaaagcctcaggggtatattatcttctaaacagctacaagttcagtggcagctacatttaaccaactatgtcctctagtggagaacaactaggcctatttcactggctgtgtagcctcagtggcctaacatgggtgccaaataaatattcgtagaattacactggaattggtaaaaaccattcgttttggtttacaagttggccaaaaatctcaaaaggccctgtatttatgtaattcttggaaattataatctatttaaatttctcagttatggactggctggggtgtgacttagtacataagtactcaatattataaaaagctcaaataatggactggattttagcacaagatccttcccttttctaccaagtaattttttaacaaatcatggggtaatctcctaaataggttatattatggttctagaaccatgttcaaaatatatgtgcattatcagtataatcggataaatatgtccaacaacattttcataattcaaagatattctgactgagatttgcaggaaggac

SEQ ID NO: 533789 - DNA, 413 bp, Homo sapiens
  misc_feature (57)..(57): n is a, c, g, or t
  misc_feature (386)..(387): n is a, c, g, or t
ctcactgtgttgctcaagctggagtgcagtggcatgatctcagctcactacaacctntgattcctgggttcaagcgattctaacacctcagcctcccgagtagcgggaattacaggcatgtgccaccacagccagctaatttttgtatttttagtagagatggggtttcgccatgttggccaggttagtcttgaactcctggcctcaagcaatccacccatctagcttcctaaagttctgggactacagaggtgttagccactgcacccggccttttctcttttttattcctcagtgtcttatttggatggggccgtatctaatgggtttactctaggttgggtctgcaatccttcagaaatatgctcgtaagattagaacacttnntataggagaaaccagacttcaccaaa

SEQ ID NO: 533790 - DNA, 351 bp, Homo sapiens
tgagaatgagtcttgctttgtcacccaggctggagtgcagtggcacaattctcgctcactgaaccctccgctcccgggtcagccattttctggctaagcctctgagtagctgggagacgggccacaccacccacccagtaatttggattttagaaagaaggggttaccatgtctccaggcgggctaaactcctaccttaaggattcgcctgcctcaactccaaaggcgggataccgggggagccttcagtggccaacaacttgttttgaaaaggggtgggggtttatccctagacctaaccttagagggtggaattcacttttacttacggttgaagggggtataaattta

SEQ ID NO: 533791 - DNA, 147 bp, Homo sapiens
acggctgcgtcgcgtacgctgtggtgggtacatgcttatgtgtatgcacggcggagctggagccctgacatcacgtaaggtttgactatgcttggggtaaccccagggtaccagaaccgtcggggttaccgaggctcgaaatttcgg

SEQ ID NO: 533792 - DNA, 928 bp, Homo sapiens
  misc_feature (39)..(39): n is a, c, g, or t
  misc_feature (442)..(442): n is a, c, g, or t
actcatctgagacagcatcagtatttgactaaatcattnttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctagaactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaanaaaacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcaaaaaaaa

SEQ ID NO: 533793 - DNA, 259 bp, Homo sapiens
ggaggtgggtgtaatattttccatgagacacttaacgtagtacgtaaatatatcaggcagcctagtgtgtcaagtactgtgggtatggtagacaacagattagttaaatctctgctctcgagaaacctgatgtgtgtgtgtgtgtgtgtgtgtgtgtgtgtgtgtgtgtgtgtagaagtctgatgctctctcgcgcgcgatagtatatgagctggcgatagcgctgtcttgtagaaatataaagctaggtaaaggagga

SEQ ID NO: 533794 - DNA, 795 bp, Homo sapiens
  misc_feature (26)..(26): n is a, c, g, or t
  misc_feature (61)..(61): n is a, c, g, or t
  misc_feature (210)..(210): n is a, c, g, or t
  misc_feature (309)..(309): n is a, c, g, or t
ttttgcgctatggaagctgcagcgcncagctgcgcatttgcaaatggttcagcattattanaatatgaggtggtggatgcatatgcagcaaatggtgcgcatgctgttgaggagcacgttgggtttaaaataaaaattaatgctgggtgcttttggaaaaaagagcgcgtggctgggggcggcggttgggctgcttggcgctcgtaatgnggcaggcagcttttggggaggctgaggcgggcagatcacctgagatcgggagtttgagaccaagcctgaccaatatggagaaaccctgtctctactaanaaaacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcaaaaaaaa

SEQ ID NO: 533795 - DNA, 565 bp, Homo sapiens
agtaactgcctcagcatcagccgcaaacagcatgctactatatgctatacagatccactgtaaagaggtacctgtgacattacagcaagcctcttattcaaagcagaggaataatcccaagattcttcctcaaataaactccattccagtaaatggtaaatacataaaaattacagtaagccagacacttaaaaggacagccaagaagtcttccaacagtttattagaaagaatgtagacatttaaaaaaatccccactgtcatgaacataaattgaggttttcagcccgggtataagctgaatcaaaaaaaggaaataaaaaatccaatagtgtattaaacatttttcactcatttgccatactgacagtgcaaaatacaaatctggactaaatgtacagactctcaagcaacaatgtacagctttcttcgtcctccatgctaagagatgtaaaagcttaagggtcaaacaataccaattgtataggcttcaaaaaccatctaagttagggcattctctagttttagctaagatacacctggaacactgacaagtcatcactta

SEQ ID NO: 533796 - DNA, 426 bp, Homo sapiens
gtggggaatgccttctacgtacacactgttctactgtttgaattttttaatatgagcccaaattgtataatctttttttaataaaggggagaaaaatcaaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcaaaaaaaa

SEQ ID NO: 533797 - DNA, 187 bp, Homo sapiens
ctccagtttatgaaatccactatagtataggaggattaaggaaaacttctggctcttcattttctttttttttcgagacggagtttcgctcttgttgcccaggctggagtgcaatggcatgatctcagctcactgtaacctccgcctcctgggttcaagcgattctcctgcctcagccttcagagta

SEQ ID NO: 533798 - DNA, 486 bp, Homo sapiens
  misc_feature (37)..(37): n is a, c, g, or t
  misc_feature (124)..(124): n is a, c, g, or t
  misc_feature (253)..(253): n is a, c, g, or t
  misc_feature (482)..(482): n is a, c, g, or t
aactcttaaatgaacatctggcaagttaaaaccttanaattccctttgtccaatttaagtttcccccactatccctaggtcaattattttgcactttgtactctccccttcaaaaattcttganacctattccccctccctccctcactttcagctgatgacccctgcttcttgctttactgtcaaaattgcagcaatcccagccgggcacggtggctcatgcctgtaatcctagcactttgggagaccgaancgggtggattgcttaagcctaggagctcgagactagcctgggcaacatggcgataccccctcgctgctaaaaatacaaaaaattagctgggtgtggtggcacacacctgtggtctcagccactccggaggctaaggtgggaggatcatctgagcccaggaagtcaaggctgcagtgagccatgatctagccactgcactccagcctgggtgacaaaaatgagacccaanctca

SEQ ID NO: 533799 - DNA, 279 bp, Homo sapiens
ggaagatacagcacggcaaaaaagaggcctgtcacatggaaggcactgacaacacaagtcaacttcagatagagtcatgcaccagataatgatgcttataagatgattggctgcgcgcagtggctcatgcctataataccagcacttagggaggccgaggcaggtggatcatttgaggtcaggagtttgagatcaacctggccaacatggagaaaccccgtctctactaaaaatacaaaaattagccgggcatggcagcgtgcgcctgtaatcccagct

SEQ ID NO: 533800 - DNA, 745 bp, Homo sapiens
gggtccatgctctagagatctgtggaagtttgaacttaagggtgataaattagtgtatctggccaaagggatttctaagcagcaaagtattcaagatgttccttggctgcttctaacaacctgtctcagatgtaggagaaaaggaaagacttaaagttggaatttataattaaaagagaagcagagcataaaagtttggaaaatttgcagcctgaccatgtgtagggaaagaaagagcattttcggagaagaaaccaagcaggatgctgaggaaccacttgctggagagctttgcacgactaaaagggagccaagtgctactatctaaaacaatgggaaaaagcccttgaaggcatttcagaaatctaggcccctcccatcccaggcccagaagcctagtgggtaagaatggtttcgggggccaagcctggggccctgctgctctctgtagcctttggacactgctacctgcatctggctgatccagctccacccatggctcaaagtgccccagatacagttcaggccactgccttggaggacacaagctataagacttggtggcttccccatggtgttatgtctgcaggagaacagaatgcaagagtgaaaaaggttgaaagttacactaggtttcagagggtgtatgtgtttgaaaagccttgagtgcccagggaaaagcctggcacaagggtcgagctcctacagagagattttaatagaacagtgtcatggaaaatgtggg

SEQ ID NO: 533801 - DNA, 89 bp, Homo sapiens
ttcccgtgatgttatctgcccaaccactgacattttatgacaattttgcaaggactctgaatttttgcaggcctacttttggatactgt

SEQ ID NO: 533802 - DNA, 960 bp, Homo sapiens
tggaaactgggtcttgctctggctgtcactgaggctggagtgcagtggcttgatcctggttcactgcaacctctgcccttctggttcgagtgattcttgctgcctcaaaatcctgagttatctgaaatgacaggcacctggccaccatgcctagctaattgtttttggtattttttaggtagagacagggtttcgccatgtgggcaaggctgggtctccacactgctgggctcaagtgatccaatcgccttggtctcccaaagtgtggggataacaggcatgagccattcactgcacctggccctttaagtatatttcttaaaatatctttcaagatgggctttgaacctatggtgactttctagcagtgtttgcacttccaaaatatttgtagttcataaatgagacttcatatggggtctcttctgaagcacagactacttcacggtgtatttggtctaccctcctcccattgggcctgtcagtccagcatacgggagatcgcttcacagaaattccttattctgtcaccttagtctgttaagacttggaggatttaagcccttgaatgtggggactggtatagcaaccttaccttgtgcgggacaagagtacaaggtttattcatcccccacattaatgaattaacaatatcccggtctgcacaggtgcaacggattgcccattgcgggttgacaggtcgggcaggacaataggcgacgaagacaagggctcagttagccacacgagaaaagtgcccgttgcaaagaacgtcgtttctagaaacccaggtgacacaagtctaaatgagacgtcgaagccgacacaatcggaagccagttcttaccaaagcggcgcatagtagcaccatggtcagcaaaacaacaggagccgaacaaagctaaaccaggagcggacaacaagaccacgactgcaacacgcagcatgcataccatgaat

SEQ ID NO: 533803 - DNA, 351 bp, Homo sapiens
  misc_feature (52)..(52): n is a, c, g, or t
  misc_feature (351)..(351): n is a, c, g, or t
atcctctagccaatcatcatgcatgctacgggtctaatactatgtagatcgncccatacactctctctcagttttgactctcgaggtcacattttttcaagctaactacactgttcggatacgtttcaggtaacgatgtgccggacatgctcaccgttttgtgtcatctacttgacgaatcctgattttttcccggtctggccaagaacacgttcttcatgtcagacaggtccttcagcacctcctcgagaaccaactctcgtgaaagccgagaagtgtaagttccaccgctctacaatctcctttctgggatatatcatcgctgagggaaatgtccagatggatcctggn

SEQ ID NO: 533804 - DNA, 124 bp, Homo sapiens
cccttccccacagttgaaggacagaccaggtgaacctatggggtcgtggaaccaaaatgttatcctacacctgaacagaagaccaaacttgatgtactttgcgatgagaactgacagcaactaa

SEQ ID NO: 533805 - DNA, 368 bp, Homo sapiens
gacctctctattatttttaaaaccagtctaggttggttgtggtggctcacacctgtaatattcccagcaccttgggaggcagaggtgggcagatctcttgagccccaggagtttgagaccaacttgggcaacatggggaaatctctaccaaaaatatacaggataaataaaaaaatagctgggtatggtagcacacacctgtagtcccagctacttgggaggctaaggtgggaggattgcttgagcctgggaggtcaaagctgcagtgagccttaatcactccagtgcactccagccggggcaacagctagaccttgtctcataaaaaaagtaagaaaaagtcgacgcggccggaagttagtagaagg

SEQ ID NO: 533806 - DNA, 90 bp, Homo sapiens
  misc_feature (30)..(30): n is a, c, g, or t
gttggggctgaggggggaagatcgcctgantccagggtatcaggccactcactacacgccagcctaggcaacagagcgagaccttgcctc

SEQ ID NO: 533807 - DNA, 262 bp, Homo sapiens
atcagatcaggcggaccgattgctgtctcatttaataattctgcaatatttcaaactttttcattattatcatacctgttatggtgatctgtgatcagtggtctttggcgttactgttgtaattgttctggggcaccatgaactgtgcccacatgagatggcaaagttaattgatccatgttgtctgtgttcagacgactccaccaactggccgactggcggcttctggtctctctctctctgcctaggcctccctctttcc

SEQ ID NO: 533808 - DNA, 1147 bp, Homo sapiens
tccctttggtgtcgttctcttcagaaatttgcccaacattcaacacaactatattcaccattcactcctctctttgtgttctttcacagtgtgattgaacacaagagttcattcaccgggttccactcagtgatttacaaatgtgcctttcaggtgcaggcaacatctccgaacccctcccgagaaacctgtgtttctcactctcccttctacatgtgcataagagtagaattatctccaacaatctcacttaccattatacagggtggtggaagattaacgccttctcttttattttaaagggggaccccaaaaggattgtgccaccgtggcatagtgacgaggttcacagtgagtgttattttcacatgttggggataaccacattaaccttctcataccaccacagtctattacacgccatctcttctcgaggtgctgtgccacacaagcgctttgtgaccaccgtgccataatttctctctagtgcacacgtctctgtggtttctccctttctctctctatggagccttataccctctcactattattccatctcgtggcgtggtgtgtgtatacagcggggagtctgcgcgaacattttctcaacccaccacccaccaccttatatcttttctctctgcgctcaatatctctctctctccccgcgttctatgtagaggcggcgagatataaccatttctcaccttgtgccgcgtgtgcaagtctctccctctatataaccctccgtatctccctttcaatctactatttccccccaaccatttcaatataggccccacccatatacaacccgcttccctttaataacccgttctatagcttttttattaccaactatataacaccaacaacaaacgaggggcgccggcgcgcgtcctccttgagcagtttttccccccgccgagaggggcgccccccacagctgttcttccacgtctgtattaaccccccggcttcttttctgtgtgctccaccaacgtggcgtggctcccccccttattaagtgggcgcgcgtctccctcattttaattacgcgctagatgcgccacccgtggtcctcccgtccgtattttttaacacaacaccgtcgtcgcccgacacggctgtgcaacacaccccggtc

SEQ ID NO: 533809 - DNA, 1610 bp, Homo sapiens
gaaatattttcttattaatgcagttcccttcatatgtatatatatatatttattaccttaccttccttccttccttccttactttctctctctctctcttaacttatctttacttacaacagagtacttagctactagttccccaggctggagtgcagatggcagacaatctaggacacactgcaaacccctgacttccagtataagaagacaattctcctgacctcagcccatcctgagtagctgggacttataggtgtgcacacatcaccacccgacctaaaatagttcaatcatacatcagctatgtactgtattactagacgaacggagattatccgccttgattcgcgccaagagctgtgtctatgaacactcccatgtacactaccaggtgactcccagctatgtccatagagcatatacccacgaaactagcagaggaataaggccaagacaacgcgaacgccacaccatatagaaccatggcccctacctcacgccaagaccaccattaccacccagctaccattccggccccaccaaacgcggctgaggacacccaacacgccccaaacagatgggcccccacaacaaaccgaacgccttgacacaatactaaaacacccacacatcaatgacacacaccaacgaggtacacacactacacatccgcacgaaccagtcacaaacaacagcgccaaacaacacaagctacacggcaacgcagaggcactcacacgcacacatcccaacatcaaccacccatagagagacacaacaacgaccacgtaaggagtatcaccaacacagaccccgcacgtacacgtccccaattgccactgcgacaacaacaccgaactttcgcagccacacacaaccccgccgaccacgcaaccgcacgctaatacacgaaccaacacgcaaagtcactcaaagacaagcgagcacgccacaccagacctccaccagatccccgaaccgagaaatacaacgcactacagcgactctgccacaaacgcgaatactatacagcaactcaaatacaaagatgcacatatattaacctactcatcagtcacacactacacctctcagcagccagactatcaacatcaccgtactcccgacaaatgcatacgaatacacctctacacacacccaataacataataatcatcacacacaacacactcacatcataacacaaccgcacacatatactccaccaactctaacctacctatacaccatacatcacatatatcatatatacgacatagaactaacacaacagagacagagcacaccatagacacagacacgcatgaacagccacacatcgtaaagccgacacgacgagcagaccgtggcaagacgaggagcgaaaatacaggacgcgtcatcagctacgcgagacgtcgaagtatcgcaagactacaagatagaggaaggacgatgagtcaccccaacgtgacgccccggacaagcacacgagaaccgaagacgccagcttgcgctaaagcggagcagccagtcgccatgcgagtctacgccaccacacaccacctcaacgacgaccccacgacgccaaccgcaacacctactgc

SEQ ID NO: 533810 - DNA, 293 bp, Homo sapiens
  misc_feature (17)..(17): n is a, c, g, or t
  misc_feature (106)..(106): n is a, c, g, or t
  misc_feature (109)..(109): n is a, c, g, or t
  misc_feature (224)..(224): n is a, c, g, or t
  misc_feature (290)..(290): n is a, c, g, or t
tcgcaggtgtgcctggntcgggctaaagtgcctgtgcagaaagaggctgcctggcggggttaggagtcggcgccctcgtcctcctcctcgggcaggatttccaggntgntgtcgggctgcggggatgtgtcagtggagggcggaggggtgggcggggcccgggtgggcgaaagagggagcggggagggggtgggcgaggggctgtggggatctgcgggcggggncagccccaggattttttgcacgttgtggggaagcttggggaaggcggttagttggcggtgcagggnttt

SEQ ID NO: 533811 - DNA, 220 bp, Homo sapiens
caagatgccacttgcatgatgctgtgggtgccttttcattgcaatgcctccatttcagatgtgagaaagttctgggcctgtagggcatttcaagcctaggtgtgtatgggggaggaggggatagatgtcctagtatgctccatatgctctgaatccctgtagtgtgttgctggttaatccttagtagtttatgtttttatctatgtaattcagtttttgt

SEQ ID NO: 533812 - DNA, 335 bp, Homo sapiens
caaagcttggctgtggcatttatcaatagtatgatcttgagcaaatcgtcaaatcattttatttttctaagcctaaatttcagcacttgtaaaacagaaatgatgacatttgtaagattgttgtaaggattaaatgagaaaatgtacataaagtggttaggtacatagaaaacatcccaaaatggaactgcttttatcatacaattattgtcatttttgtcattgtaccataataattcttagaatcatatcttttagagattgctcttgagattgtagtagacatcaaatgtctccttactgatttccctagctgctatagcttctatttattt

SEQ ID NO: 533813 - DNA, 438 bp, Homo sapiens
tactctgtcttttagtgtctttattgaggatgatgatgatgatgatgatgggagcttatattaatcgagccttagtgtaagtcagacacggttatatgtactttacatgtgagccttagtttctataaggtagtacatgtgggttccatgacgacgaaatgacttaattcaacaacagtataaaggatggtctgatattatccctgttctacttgtgaaaaaaccgaagcacgagaagctgaaggaacttgtgcatgttcacacaggttaaggggtagatctgggattccttgccaggtagtctagctttctttctggaacacaggtagtgagtccttatccagtgtgattcgcggatccactttatttctcctctcactccacttgattaagcaggggtgtcttccactcccatagattcccgggttgcctgtcggg

SEQ ID NO: 533814 - DNA, 646 bp, Homo sapiens
gccctatcatataataaaagccagcccagagagcgccatagcagggcttgtcgtcggggcgctctctaatgacctcgggcttaaccatgtgatcacctgttcgcactgccatacctgctcctcatacataggcctagtaagtggaagacacgtaagacatataccatctgaaggatcgatgggaggacgagaccacggataaccgagaggcactaccgagcacaccaggccgtgcacattaaagtgcaccttcgtatattgagggcctaaatcctaattctattaccatcaccgaagattgagagcgtcagtcagagaaattagctagactctattgccattgtgtccctagacctatcgcatgaatatcaggcgacgggcctgcgagactcaagatcaacggagatgccatcctcacaaagtatatcacatttcgcgttcaattactttgccaatatttactctccttaaggcgaggtcatgacacctgcatggatgtcaaacaattgtcctacgcttgaaaataaggaggcaggctcatctaattcaatcgtcgtgcttatacaaatgtagctcaggctcgttatcatacccaccctgactcggactctgaaaggcagaatctcccctggactgtaccttcgct

SEQ ID NO: 533815 - DNA, 361 bp, Homo sapiens
tggtttcatcacttgcctttttgcattttgggtcccagcctcctgtatccaaaaatgcagtggctttccattgcccctttgattcctccttttttttggtcacaaaaaaaggggactttttctgtcaaatttcaacttaaacttgacttcctccaaggagctttggctatactctttcctcccgaccccccccctggcatactacacagatccctttggggtcccttgcctgcctaatggtcatttccccagtaaactgtaagctcctttagggcaaggattgtgttggaatttttgtattaacagggcctggcttggggcctggcccctaaaaaaccctcaataaatgtttgtttaatta

SEQ ID NO: 533816 - DNA, 215 bp, Homo sapiens
tggggagatatagtgataaatttctcaggggctacctatcgctattaaaattggaacgggccactaaaggagggggcggattttaaacactgggtaggttactccaaccaaaaggcaagaccacatcctttaggagaaaggcagaaattttagacttctagatacagaacgtatgatgtcactgaacacacagatatcctgctgatcagggggaa

SEQ ID NO: 533817 - DNA, 98 bp, Homo sapiens
ggccccggggggggggggggggggggggttttttccagggcccccccctttttcccccccatttaaaaggggttttttttgggcccccggccctttta

SEQ ID NO: 533818 - DNA, 833 bp, Homo sapiens
cggctgtcgacggacggacgctggactgaccactgtgtctgtcgacggacggacgctggactggacctgtgtctgtcgacggacggacgctgggtgccctgtccctgtcgcggcggcgctgggctggacctgtccctgtcgacggacggacgctgggctggacctgctccctgtgtcgacggacggacggctggactgaccactgtccctgctaccacgcgcccgacgtctggtactggacactgtggtccggtccactgacgggacactggactgaccctggtggttccgttacgcatcggacggccggtctgcgtacccgaccatccggtgcgtcccgctaccaacgggacccgccgccctgcgtacttgacacgctggtcgttcatgctcccacgagccgcgcacgtgcttagcgtgcctgcactaccctgcgatgctccctggcctcacccagtacacgcctgtccccggcgccctacgcaccctactggttcccctgtgcactcgccatgcgcctgtgggcgtacgtgcgtccccaccccccctacgcgtgcgcgcgtacctccgcactgccccgtgtcaacgcgcgtgttcccgcgccttctacgtacgctgcagctacgctcacgtctaatcgccgcaccgccaaattgcggcgcaacacgacccataacgtaagcaaccttcctcaccctccagcacgacgcacaggtcgtgcaagacggtcactaaccgtaatggacactcaaagcaccttacaagacgagatacctacggcgttcgtacacctctactctccaaatggcaacgatccacagacactacacgca

SEQ ID NO: 533819 - DNA, 300 bp, Homo sapiens
ttcctccatgtgtactcctctgctcagctcccacgtatgagtgcagacccactgcatgtgtccggtttgctgttctctgtgatagttagctgagactgagtgtgtctgtccacgtcttcatccgtgtccctgccttgtacatgaactcatcctttctcatggtggcatagtattccatggtgtttatttgccacattttcttattccagtctgatccttgatggcacaatcatgggttgggaccctatctgggctattgctcatactgccggagatcctctacgtgggcctgtgtctttt

SEQ ID NO: 533820 - DNA, 687 bp, Homo sapiens
actgccccccgaggctgctagacgtaggtgttaggcatgtccacccacccgccgcctcccacggcacctcgggacaccagagctgccgacttggagactcctggtctgtgaagagccggtggtgcccgtgcccgcaggaactgggctgggcctcgtgcgcccgtggggtctgcgcttggtctttctgtgcttgcgatttgcatatttattggcattgctggtagagacccccaggcctgtccaccctgccaagactcctcaggcagcgtgtgggtcccggcactctgcccccatttccccgatgtcccctgcgggcgcgggagcccacccaaagcctgctgggctgcggccccctctcggtcaggcattggctcagcccgctgagtggggggtcgtgggccagtccccgaggagctgggcccctgcacaggcacacaggtcccggccaacccagcggccccccgcacagccacccgtggggtgctgccttatgcccggggccgggaaccaactccatgttggtgtagtctgtgtagtttttcaagaaatgattcaaatgtgtgtttggctttgggacatttactgtaactgtcaagtgtacacgtcgtggaccccgtttcatttttacacccaattgtggtaaaaatgctggtctcaagctcccacaattaaaaccgatgtgatctc

SEQ ID NO: 533821 - DNA, 696 bp, Homo sapiens
atggcacatgcagcgcaagtaggtctacaaagacgctacttcccactatcatagcaagagcttatcacctttcatgatcacgaccctcgagtaatcattctatgcgccttagtcgtgtcttgcctagagtactgtgtaatgccctgttgtaccgtaagcacctcacgaacaaaaacgtaactgaagtactagaaatctcagacagctcagggaagatagaaagccgtctgaacatatcctgtcccgccgatcatcctaggtcctcatcggcctcccatcccgtactgcatcctttgcataacgagacgaggtccaagtgatcccatccacgttaccattcaaatcagattaggccaccaattggtactgaaccttagcgaatacaccgatgtacggcggactaatctttcgaagatcctacaatagctgtaccctcgcattgattcgctaggaaccaggcgagactgggacgtccatatgacagttggacaatggaagtagtactcctcgattgacagcccctattcggatagtaggtgacatcagagtgacgtctagcgcgtcatgaagctgtaccacacatgaggcttaataacagatgacaataccccggatcgtctaagcagaacactttcaccgttacatgaccgggggtatactacgggtcgatgctcggaaatctggggagcaaacaca

SEQ ID NO: 533822 - DNA, 407 bp, Homo sapiens
gggcgcgaaaaatggggaaggataacccggtgagagggggccccccggggggggtggtcctcttgtattttggggggccccccccatggggaagataacaccccccggggggacgcccgggtatgttggtttagggttgtttcccttgttttagagggaaacggggggcgggggggcccggttcccccaaatttttaaaaagaaccctttccccgggggggcttttggggctcttgggttttaaacccttttgacccctgacttggggcgggcaggggggggggggggggggggtttcggccccccccccccccttgggggttaaagaaaatccgggttggggcccttcccagggggaaagggggggtttttttttttttttttcccaaaaaaagccccttaactta

SEQ ID NO: 533823 - DNA, 404 bp, Homo sapiens
taaccaaaacccacctgtactccaaaaaaaaaaaaaaaaaaaaaaaaaaaggaaaaaaaattaaaaaaaaaaaaaaaaaattaaaaaaaaaaaaaaaaaaaaaaaaaaaaccttgtgggccgcttgggccaagtcgattttaaattggggcaggtttatgcttgcggccgaatttggggttaattgggcaaattggccttatggggggtcgtttaaaatttaatgggccgtggtttaacaacgtgggaatgggaaaaaccttggggttcccaaattaaatggcttggaagaaaatccccttttggcaagttggggtaatagcaaaaaggcccgaacggatggcctttccaaaaagtggcccagcttgatgggcaatgggaaatggaaggcgtaaatttttggta

SEQ ID NO: 533824 - DNA, 890 bp, Homo sapiens
agacagtgcagccacctccgagagcctggatgtgatggcgtcacatgaacgagaccctcccaggaggcacggatccaacataccgtggccacagacaagtaccatggagccatgccatggcatggcttcctcaccaatggcacacgatgacacggggcatccttgactccatctgggcgctatctttgtgcgagtgacatgtggtgtgctgcccaacgcggggactctggcaagggacgtcacacctaccctggccaagaacttgctcacgtactggctcccatgcgcccagagagtcacactggcctggaccccaaggattgaaaatcccccgtaggtcccacgttccttcaatgaaaccatttgtgacctgcctcagcacgaccgaccccccagtcagcacgggcaaagggggggccctgaagcgccagaagaacccagggactttggggctaacggggcagggccagaacgccggttcccggaccttacttcgcatagttccgtgccttccaacaaaacgggggaactttcccaacggggcgcaaggctcgcgattttgccccccaaggggggccaaccggccctttatttcccaaatataaactttgttttacaagggcctagggcggaaacggtggacactcgaacagacctcaacgattcctgggccttccttggtgagacatgtcaaagccctccaaatttgggtcccttaaggaaacctggccctttggcgagcacagatagcccccaatgccccgttggggggattcctcccccgggtggcacactcttccccgcttgagtgacccccatctccacacggcgccatttcactcttattcacagcgtacaactttacacacccattgggtgcgcccttataa

SEQ ID NO: 533825 - DNA, 115 bp, Homo sapiens
cagcacttaatggaagatagatggtagcgtgcccaccttgctggcctcccgcactctgctcacccctgtcccaatacactcgagccaccacttcattttcacctggcggctgctc

SEQ ID NO: 533826 - DNA, 141 bp, Homo sapiens
  misc_feature (2)..(2): n is a, c, g, or t
angaggaagatatggctttcaagcagaaacaaaaagaggagccgaagaaactctaggagctaaaagcgaaggccgcggggaaggggcccttggccacgggtggaattacgaaatctggcacaaagtaagctgtaccttgtg

SEQ ID NO: 533827 - DNA, 1387 bp, Homo sapiens
ggctgcggccgcggcttattgctccagtgtcgagcgcaagaacccttcgcagcaccaagaacctgctgctggaggggaactcgaggtcgcgggtctcggggtcattcagtgcgtcgcggccctgcctggactcatgctcttgctgtgtgtgacgggagcggtggccctggcctgatttgttgtgcccgttgcacagttcacgcccattcgatctcggactctccaggttaccactggcttctatcagtgatttacctacacttattgatttcgcatgctcagtgggctaacagttcgcaagtagcgcgacgcgatcccacggggcttgcagagagcgggccaatggctttgtcaattcgaattagggaagaattctccgagttcaactcgatacgttccccatgaggaaggccgcacggaatacgcaccttccggaagacaagtccacatcgctcggtgggtgccgattgacctcgcgctgacctagcacgtgtaaccgatccgagtagcgaaggactctgcaacttggggacgggtacgttcccaacccaaggcgcaactgggaaggcacacgggtccttgcgagtgacactcgagtagttataaccaagatgtgcagtgagcaatgccccgaaacacgaaggggtcagttcccaagtacaaaattcctctacaattgtggaccgcacccccgttcctttgccattagaaaccgcgacagcacactcctaggtggtgtcatactagactacccacgttgaagaagacttggtttagaaaaaccaccaagattgaacagaacaccgctaagtttgtatccacaagcgcaatggacgcacggttagcacagacgcaagttcccaagataccatataagcactctatgggtgggcgtacgttaccccgtctggtcgataggactaatcttctaagaaccaattgtatcattcaaatggttccacatatgccgcccacgtttaatgagccccaacgaggggaggcctctagaggttcacaccaaagttttgcgacagcaaagaaccaggttgtttcatcggaggaatttaacattacagggaatcggcggccatgacagagtgtaatcactttctcccatatttgcaaactcgccaaagcaaaaggcgatacacctaacgttgaaaccctccaaaattcctacccatattggacgtcgaaacctctggcaaggtgtacgaaatgtgaacccgtttggtgttgggggacatctttgagggcgcatcttccttttccaacacggaatcgtgacaaaaccaggcatttggctctgcagcgccacagagccttcggcagtagttggtcgacccacaaggatcagagcggcacggaatatttaacattaccacag

SEQ ID NO: 533828 - DNA, 269 bp, Homo sapiens
ctctagcaggatcccctcaaactgtatttcatcacataacttagtataccgatgacacatcaaatgtttcacttccttcactattacatcaacatatctgccgatgatgaaaataagctatgtgataaacattttaccgtcatcctgctgattcttgctcgcgttgatctttgtgatccctctgcgaattcctctattgttgctactgtatcggggtctcgcggttccgacgctcgatcttcgtgactcgtggttcatagcctggtttc

SEQ ID NO: 533829 - DNA, 1013 bp, Homo sapiens
ggcgctccgggtggtgacggtggctctcggtggcggttccggtcttgtatctccaggcggggcggtcatggcggcgacggagctgagaggagtggtggggccaggcccggcaggcattgcatgcacttggtggcgggtggccggttccccatgtggtgggatggaaggcggcggcgtggagatgcggggtcatggctccggggccggtcatgggacggtgttcgcggcggtggctgtgaggccctggtgccctggggtgccgtggtgtgagtggctggtgcttgttgtgcccggcccctgcgccggctggaactggtggctcgggcggctctgggcgctgggggtccgggctcggtcgagagggttggctcttcatactggaccacgttatatcaaaggctaccatccggcgatggttcgttgctgagcaacgtgactcctgatgctacctacagatcaaaggcggaaattgagacataacctgcgctgtggtaccatcgaaggctcgccacacggcaagcatcaccgtgtgaggactcctgacagagtttcatcatttccaatgggggtgctcagacctaccatctgaaaggctagtttcagaagttgagcggcagacgctgggtgacggcctgtgaacttggccaaggcaaagctgtgaaaatgctggcagagtcagatgactccaggagatgaacgagtctgtcttcaccaagctgacggaactgagctgacgaatacccttcggacctctctagcacagtagaggacttgagcacgtgcgatggcttgatagctaagcttggcacagtctggagcgtcctccagggaggtggatcctgaacttgctgtggcagcatgaagattccacggtcacggagggccacccttaggatacctggggttcacagctcggcgaaatctcttgttcgacacgaaatggaagcgcagatcagagccggctcggaaaccacccggggagaccaacgaggggccgagcgcggcgacatgtt

SEQ ID NO: 533830 - DNA, 683 bp, Homo sapiens
  misc_feature (71)..(71): n is a, c, g, or t
aaaaataaaaaattaactggggtgtgggggcgggcgcttgtgttcccagttcctccgaagcttcagccaanagatatgccgtaaaccaagaacccggagcttccagtgacccaaaatcatgcccctgcactcaagcctgggggccagagcgagcctcggtctccaaaaaaaaaaaaaaaaaaaaaaaaatgccatccactccatccgttagtagcaagagcgaatagccatcagaaagagcttttcacgtcagaaagcactacagaagtagtggcatatccccgaaggctgaggtggagcaattgctgagaggtggcacgtgaccacatccatgtcattcatcaacagacaaccaagtcatcgagggtgtgaggggccggtgagaaacccagtatggaagaaaacacaactgggctgagcgtggtggctcacgcctgtaatcccagcactttgggaggccaaggcaggaggatcacctgaggtcaggagttcgagaccagcctggtcaacatagtgaaacctcatctctactgaaaatacaaaaaaattaactgggtgtggtggcgcgtgcctgtagtcccagctactccggaggctgaggcggaagaattgcatgaacccaggagccgagaccacaccactgcactccagcctgggggcggcacagtgagactcgtctcaaa

SEQ ID NO: 533831 - DNA, 194 bp, Homo sapiens
  misc_feature (63)..(63): n is a, c, g, or t
  misc_feature (90)..(90): n is a, c, g, or t
  misc_feature (92)..(92): n is a, c, g, or t
  misc_feature (112)..(112): n is a, c, g, or t
  misc_feature (118)..(118): n is a, c, g, or t
  misc_feature (175)..(175): n is a, c, g, or t
  misc_feature (187)..(187): n is a, c, g, or t
cacggctgagtgtagagtggccgtatatatgggatattagtcccctatcagatgagtaagggnaaatatttttctcccattcaaaaggtngnctctttaggctgtgattgtntatttngctgtgcagaagcttttaaacttaatatagtcccgttggtctgttttttattttctngcctgtgctatngagatct

SEQ ID NO: 533832 - DNA, 959 bp, Homo sapiens
  misc_feature (22)..(22): n is a, c, g, or t
  misc_feature (38)..(38): n is a, c, g, or t
  misc_feature (46)..(46): n is a, c, g, or t
  misc_feature (59)..(59): n is a, c, g, or t
  misc_feature (83)..(83): n is a, c, g, or t
  misc_feature (86)..(86): n is a, c, g, or t
  misc_feature (88)..(88): n is a, c, g, or t
  misc_feature (98)..(99): n is a, c, g, or t
  misc_feature (101)..(102): n is a, c, g, or t
  misc_feature (114)..(114): n is a, c, g, or t
  misc_feature (121)..(123): n is a, c, g, or t
  misc_feature (126)..(127): n is a, c, g, or t
  misc_feature (129)..(129): n is a, c, g, or t
  misc_feature (146)..(146): n is a, c, g, or t
  misc_feature (158)..(159): n is a, c, g, or t
  misc_feature (164)..(164): n is a, c, g, or t
  misc_feature (170)..(171): n is a, c, g, or t
  misc_feature (173)..(176): n is a, c, g, or t
  misc_feature (182)..(182): n is a, c, g, or t
  misc_feature (188)..(188): n is a, c, g, or t
  misc_feature (190)..(191): n is a, c, g, or t
  misc_feature (198)..(199): n is a, c, g, or t
  misc_feature (205)..(205): n is a, c, g, or t
  misc_feature (225)..(225): n is a, c, g, or t
  misc_feature (279)..(279): n is a, c, g, or t
  misc_feature (292)..(292): n is a, c, g, or t
  misc_feature (367)..(367): n is a, c, g, or t
  misc_feature (479)..(479): n is a, c, g, or t
  misc_feature (599)..(599): n is a, c, g, or t
  misc_feature (709)..(709): n is a, c, g, or t
  misc_feature (712)..(712): n is a, c, g, or t
  misc_feature (788)..(788): n is a, c, g, or t
  misc_feature (924)..(924): n is a, c, g, or t
gaggtggcggcggcggcggtanggtggccttggttgtnttccagtntcctcggctcgcnctttagccggcaccgctccccttnccncncccttcctcnnanncttacttccctncccttcnnnttnnancttccccgtcggtgagnggcgggggtggnnccagnaacggnnannnncaagcngtgtanannaattaannaacganaacggcggcgacggcgaaanctcggagctcgcagggcgggggcaaggcccgggccttggagatggagaattctnagttgtgtaagcngttcatcggcggcctcaatgtgcagacgagtaaatagggcctgcgcggccactttgaggcctttgggactctganggactgcgtggtggtggtgaatccccagaccaagcgctcccgttgctttggcttcgtgacctactccaatgtggaggaggcggacgccgccatggccgcctcgccccatgcngtggacggcaacactgtggagctgaagcgagcggtgtcccgggaggattcggcgcggcccggtgcccacgccaaggttaagaagctctttgtcggaggccttaaaggagacgtggctganggcgacctgatcgagcacttctcgcagtttggcaccgtggaaaaggccgagattattgccgacaagcagtccggcaagaagcgtggattcggcttcgtgtatttccagantcncgacgcggcagacaaggccgcggtggtcaagttccatccgattcagggccatcgcgtggaggtgaagaaagcagtncccaaggaggatatctactccggtgggggtggaggcggctcccgatcctcccggggcggccgaggcggcggggggcgcggcggtggtcgagaccagaacggcctttccaagggcggcggcggcggttacaacagcnacggtggttacggcggcggcggaggcggcggctac

SEQ ID NO: 533833 - DNA, 342 bp, Homo sapiens
gagatcgcaacattgcacgccagcttgaacaacaggagcaaaatctgtctccaaagaaaaaaaaaaaagagtaaagtgaaagaacttaaacaaggatggattaaaaaaatgtggtgctcgtacacaatggagtaccgttcagccatgaaaaagaatgagatcctgtcatttgcaacaacatggatggaactggagatcattatgtcaagtgaaataagccaggcatagaaagacaaacatcacatgttctcacttatgtgtgtgatctaaaaatcaaagcaattgaacccatggacatagacactagaaggatggttaccacaggggctgagaagggtagta

SEQ ID NO: 533834 - DNA, 415 bp, Homo sapiens
  misc_feature (73)..(73): n is a, c, g, or t
  misc_feature (210)..(210): n is a, c, g, or t
  misc_feature (242)..(242): n is a, c, g, or t
aggttgggacgggacggacagtatgtcgtctgactcggtggtttcgtcggtgaggcgctttcagaagcggtgncaggactgctgagatggtgagtccgcatgcggtgtggtgtgcacttgagcccggtatgacagtccccagctgacagatccaggtgtccagagcgagtcttcagcggactccatgtggttctgatcctctggcgcttntggcatgactcagaagaggtgctggtcacttnccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcatcgataaaca

SEQ ID NO: 533835 - DNA, 205 bp, Homo sapiens
gttatacgctcagccactcatagaatgggacgtccactatcaggaagcctgcagccactatgttcgccgggccagaacaaagcgacccagcaagtccttgcttccggctgttgaagttggggaactcccaccgcaaggaacgctagcctctatagacccgtggaggtggtgacgtggctcccatgttggctggagctgtgacagt

SEQ ID NO: 533836 - DNA, 498 bp, Homo sapiens
tggcataaaaaagtttttttcccattgggcccacgggtttggtaggatattaaaaaaagcggcctttgggggggggggaaaggtttaggcaaaacccctataatttggagggggcccttcaaaacgtcgcggggcccaaaagggccctaaagccgggctaggaagatgtagagctcttccagaaagaagatactcgcccagcccagcctcggggcacccccagccgggggggggtggggccgggggtggcccccatcttctctgggataagctaccatctccctacattctagagaaggtggatgtcctccaggaggtcacaagaagaggggggcccgggcgggcaagaacccggggtagtgaaatacccaaaggggcgcgggtgcacgacgttatcatctcccgggggccagggaagtttataccaggggcgtgggggtgtataacaccatctacattactaccagggggactccatggatggtcccggggaaaaga

SEQ ID NO: 533837 - DNA, 353 bp, Homo sapiens
  misc_feature (40)..(40): n is a, c, g, or t
  misc_feature (336)..(336): n is a, c, g, or t
cggtcgttatagaggatccccccttaagctgctgacgtanggttgagatgtctatcgtgggtggcccaatcatagctcactgtttgaaattaattgagaaaatcccttctcagtaatccagttttacatttaggctacccaaaccatggcttttaaaaactttacctgatgctggtataagaaacttattacaaccaatagggtgggttccatttggaaatttaatattcctaatagtattaggaaacatagttaatgccttttttttaattgaaaccaaccaggttatttggtaaaaggtcagaaaacaccagtatccttctgatctcatccggnatttttctgtcagcacc

SEQ ID NO: 533838 - DNA, 98 bp, Homo sapiens
  misc_feature (78)..(78): n is a, c, g, or t
aaagccggaaggggcaagacgggttcagttcgtcatggggctgtttggaaagacccaggagaagccgcccaaagaacntactcaatgggagtggtcat

SEQ ID NO: 533839 - DNA, 155 bp, Homo sapiens
  misc_feature (1)..(1): n is a, c, g, or t
nctgccacatgctccaccactgttaatgccagcatcactctctgtagttccagctactctggaggctgagccagtaggattgcttgaacctgggaggtggaggctgcagtgagccaagatcctgccactgcactccagactggtggacatgtgag

SEQ ID NO: 533840 - DNA, 309 bp, Homo sapiens
  misc_feature (243)..(243): n is a, c, g, or t
ttaggggactgagctggggagggaggtaggtgggtggtaagagggaaactttggagagcttgtatttaggtactgagtggggagtgtatagactcttgctttgggggttctgggaatgatgtaactggttttactagtgtgcaagtgtgtttatccccaagttttcttttgtcctcacatgcagagttgtgcatgcccttgagtgtgaacaggtttgcttatgttggtgcaagtgtgcatggntggggacttctcacttccccttgcaccccttcctccccaacctgcaataaatccgcttctcctgca

SEQ ID NO: 533841 - DNA, 211 bp, Homo sapiens
gtaattctggttgaagggggcaagaaaaggtgatagatgctttgattttggctaataggtctcagcctataatgggggtgggtctaatgaggcatgataatgaacagagtgtgatgataatgggatcaaatatgggaacaagtatgaggtgtggtggcaatctgtgacaggaggatgagtccgtcaaaccccacacgtctacggcctgagt

SEQ ID NO: 533842 - DNA, 443 bp, Homo sapiens
ctagaggatcccgaacggctatctgtgttgctgcaggcttcagctcaacgggaacctgcagctggagctggcgcaggtgctggccaggagaggccaagctgccagaggaccctctgctcagcggctcctggactccccggcactcaaggcctgcctggacactgccgtggagaacatgcccagcctgaagatgaaggtggtggaggtgggtgcctcctgggcatgcaaggcctctgccccggacatgttaggaaccagcctgacatcagttgcaggagacagcacagacacggggcgggccctgggcgggtgggtggggccggccagttccctgtgtggttctgtgcacgtgtcctgtgcggtccacaaagccagcgtggagggtccggccgtgggctccaagaggcgcagcctaggcaggaccccagggacaagagcagtgg

SEQ ID NO: 533843 - DNA, 213 bp, Homo sapiens
catataattttaattcaaaataggtaatttacctaaatgaaaccccctttattataaaacttagagaagaaaacataaagtaaaattggtcgggcgcgatggctcacacctgtatcccagcactttgggaggccgaggcaggtggatcacaaggtcaggagattgagaccatcctggctaacagagtgaaagctcatctctactaaagatcca

SEQ ID NO: 533844 - DNA, 161 bp, Homo sapiens
tagataggacaagggaaggccctcagagaaagcctgactgaggctagttgtggtggctcacacctataatcccagcactttgggaggctgaagctgagaggatcacttgaggccaggactttgaaaccaccctgggcaacatagtgagaccctgtctccat

SEQ ID NO: 533845 - DNA, 540 bp, Homo sapiens
ctacactgatcaggagtggggatctggtctgtctctacctatgtctaggcatgacgggtgacatcgcgggaatgcagtaagtcctgtaggttggagtcagtaagtcctgttggttgaatgaaggcataagcgtccccttaactttacttagagaatcttttcttagttggaacttatttcatccccttctcagatttcagatgtgacaggtcagtgtactttggtcatctgtctgccaagtaaagccaagaataccaaatatactcaaagggagaaaagtatgttcttatctctttgattttaaaggagatatttgaagtatcagtactcaggatcagtgggtgagaaaattactgtgaccagagatgggaattttgggggtatggtgacccttagaatctagaatacagtgtagtacaacttaggtgcagcccatgttacatgacatgtagctgtcgcagatgatttggatgtctgtaaacttacgcatattaatctaagaatctctctccacattcgtaggatgtaatccctgttcat

SEQ ID NO: 533846 - DNA, 301 bp, Homo sapiens
ctagctcctcttccttctctcttactccaaatacattctagaccctgtcccaggctctcttctctctctggtccatccttgttccctttgtgaatcttgccactcttgttttgaacaccatagacccatgactggcaactctcaccctccagctcagcccatttctgggtgctggcctttttttctcttgacttctgaacacatccacttgcggatgcccctcgtgaggcaccttgaggcaaatatgtccccagctgtattaatcgtcttctcagattttccagctcccctatttctggca

SEQ ID NO: 533847 - DNA, 127 bp, Homo sapiens
tagctaaagggttaaggagaacatagtaaccccaaatagaaattgaaacctgggagccaatagactctagtaccgcaagggaaagttaaaaattataatccaagcataatattagcaaggactaaac

SEQ ID NO: 533848 - DNA, 327 bp, Homo sapiens
tgttcatgcagagagcatgtgggctgctcgcccagcccggcctaggtgaaggaagaggcagtgctcctcagagcatgcggagggaggggggaggtcggaggtcgtggaggtggttgtgtatcttactggtctgaagggaccaagtgtgttggtggtaggttaggtatcttgtctttctgatcggagcatcactactgacctgtagtaggcagctatcttacagacgcatgaatgtaagagtaggacggggtgggtgtcaggcatcacttgggatctttgacagttgaaaaattacacctggcagctgcgtttaaggggtaccgagct

SEQ ID NO: 533849 - DNA, 412 bp, Homo sapiens
agcccttgtccccgaagaagtatgtgccagggccccaatgcttagccccaggccccaggccggttttttgcccaagcatccttgccgtgtcccaaaaagaatggaaaccgggggagccctacccctgggtggtggcccataaggcccttcccaacagggttcccaagagggccgtggacaagtcccccggttaaccccccctgtacaaggtgtccctggttatgttcgacacaaatggcccctgttatttacccttttggcctgcccccaggcttggggggggtggcccctttgtgtgggcaaccaaactaaccgggtccacggggggaaatgttgccttttttaaaattaaaaataaaaaaatcccttccaaaaaaactggtcctggggggccgatgttttggccctctta

SEQ ID NO: 533850 - DNA, 502 bp, Homo sapiens
tacttttccacagggaaaaaatttataatcaatcataaatttccactaaaataagtatatgcttctattaaagggaaagtatcaatcaaaaataacaataaaacatattctttttttttttagctggtggtatggattggaacacacattcataattcaagaacttttacactaataaaacttagaaatcccaaaaccaacaacttatcagtgatgttctatttttccagctcagtatcacttcagttcaaatgctacaggaagaaaacccggtaacttaaaatctgaattactggttaaagacatcagaaaaaagaacaaagaataaatctaagaataaaaagagatggggaaacaggtaacaagagaaatgcagggagagaaggaggagccagaatgaaagaagcagagatgggttaaggaatgggaagcactgggacaaggcaaagttgcaggaggccgggataggagaccaggaaatttttaaaaagtaataataaaa

SEQ ID NO: 533851 - DNA, 516 bp, Homo sapiens
tgcgttttgtttgataatcattctagggcatgggggtaaatcatcatacctccctttctaatttatcatctgcccgacagcgaagcagctcccagctatctgtgctgtggtagtgtgattaactggcacgctgattgcccttatattaacattaacattgtcttccctgccatacagatggtgtgcgtgatgatgagagacagaagaaaagatgacacaaattacaggaatttgcttaaaataaaaagcattattaactaagagaggaggccaataataaaaactatttgtttgcattaaaaaagaaaattactatggaaatacagtttcaccagggagaaaaaaacatagcttgaatgtagttttagatgaattcatacctcaagagttatacataattacagtatacccttctctttatacatggtactcaacttgatataattaaaattaaatttcaacccaggaatttttcaaagtatattgcattctagcatatcctataagactcaggac

SEQ ID NO: 533852 - DNA, 911 bp, Homo sapiens
gacagaagttgccgttgagcgtgtcgactcggttgctgtggcgacggttgccagtaagtgcgttcgtgggggaaaactgaagggatggaatcgggcggccaggacgagatcatggggagtgccgctcgactcctggctgtcgtgaatcgtggcctagtggatgtcagaggggaaaaacgttcgcgggagttatgtcgtgcaacaccatacatgtgcatatgatctgcagtgtcgaccccaggtgggtaaccatagcatcgcgctagggaatgcattgttggtttggcagataactggtctcacacatggtgaacctgctggagggagactttctgagggcgggaagatacaaggcaccctaggtctgattaggaagatctgaggagccaggtggatgtgttgtgggtggaatccagtatgatgggtagtgccttgggggtgggtaaaggactgagaatgttggtcgaaaagagtgaacctatgcaatgagaggagggtgccaaatggagtgggcagtgaatcgggtgagaatgtcatatcgtctggggatgttgcactttgtgtccaaaggtattggcccgagcaatgtagggtcattgaatatcagtggaagttatggaagctagggaagaccgtggatttttgtggctgtatgaggcattggtagtgagctcgagtggtttaccaatggggacgatagaacgcagaaaaaggtcgggatggtgaacaaatagttctaaggagtggtagacgccggtgattgagggggggaaggaatgttagaataaagattttttgcaaagatggaagaaaacttggattcgaaactggggagacgggattttaagttaagtagcaaagttactcttttgaaagatttaaaaaagggaggtgcaaaaagtggattaggc

SEQ ID NO: 533853 - DNA, 129 bp, Homo sapiens
cccgagccgacagatctctcaaacccagaacttctacaaaacaacaactcctttccttcctaggcatggttagtgcggtcagaattcttacacaagagccaggactgcaccctgtcgggctagtcgggg

SEQ ID NO: 533854 - DNA, 625 bp, Homo sapiens
agctaagaccggatggtgcatgtacagacagaaagcgtgtagtcactgagacagtcttactgactctgatcattctgtgcactacacagctcctctctgagtgtaagggcatctgagaagaggatgtggatactccccagtctgtatgagtgggacacgggatttctcagtcctttcactcaagaacaagtagctgatattgatggacagtatgcaatgactcgagctcagaggggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgctatccctgaactgacaaaactgctaaatgacgaggaccaggtggtggttaataaggctgcagttatggtccatcagctttctaataaggaagcttcagacacgctatcatgcgttctcctcagatggtgtctgctattgtacgtaccatgcagaatacaaatgatgtagaaacagctcgttgtaccgctgggaccttgcatacctttcccatca

SEQ ID NO: 533855 - DNA, 490 bp, Homo sapiens
cataaggaatagcagacatgtgcctttcttggaaaatcatcccctgcttagcctgcatttattcgaacattgaacagagaggcggaagacagcttatcctcccaaattcagagactggagctagagttcatagctacaactgatacttaaagagagactggtagtttacaaagtcttattcatgaccagggaaaacataactgcactcatgcccgaaggaaggagtttcatagggcgaataagagaacggaggctgtttatataaggatgaattgggatggtatggagccacattcccggggctcttattggccaagaagtagcttacgcaaggcccatctggctgcgtgagatcatttttgagttagctctccccactttagcggagatatatggtcggatgctggctatgatatgcctccctctcctctggcacgcagcaggaggaggatcttcacacccagactgtactcctgagggcccggctcac

SEQ ID NO: 533856 - DNA, 1004 bp, Homo sapiens
gcggcggccacagcagacatgtcgggggtccggggcctgtcgctggctgcgtgagcagctcggctgcctggacgctggccaaggcgtggccaacagtgttgcaaagcatggaacccgaggttttcacttcactgttgatgggaacaagagggcatctgctaaagtttcagattccatttctgctcagtatccagtagtggatcatgaatttgatgcagtgcgtggtaggcgctggaggggcaggcttgctgagctgctatttggaccgttatcgtgaggcagagggtttaatcacagcagtgtgttaccaagctgtcttcctaccagtgtcacacactgttgcaggcacacgggaggaatcaatgctgctctggggaacatggaggaggacaacctggcaggtggcatttcgtacgacactcgtgaagggctccgtactgtgcctggtgggaccagtgatgccatccactacactgacggacgcaggtgccccgcgcgacgatggctcgagctacgaacaattatggcatgccgtttagagagaacgtgaaagatgggaagatcttatcagcgtgcatttggtggacagagcctcaagtttggaagagggcgggcaggcccgatcggtgctgctgtgctgggtgatcggactggccactcgcgtattgcacaccattatatggaagggtctctgcgatatgataccagcttatgtgtggagtattctgccttggatctcctgatggagaatgggggagtgccggtggtagtcatacgtcactgtgcataagacgaagggggtcacagtccaatcgacatatagaagcaagagcaccacgggggaagtggccgacagggaagggcaacgggggcggcaccctacgttaacagggatgcaacgctctggcccacaaccgcaggcactgggcgacagggcccggccagtgagtcaccaggggcaaggcagttacatggccaggaacagaagatggaccggtccagcc

SEQ ID NO: 533857 - DNA, 347 bp, Homo sapiens
acgaccagcttactgaccctactcctaatcacataacctattaccccgagcaatctgaatcacaacatatacacgagcaaacaatgagcaaccagcagctactactaatcaacgcccataatcatacaaagcccacgaaccaataggatgctcccgaatcaaccctgaccgctctacttgataaatgattcagttacctacactattgaaagataccacaaccaccagccgatgatactgtttcagccacaggaccagtgctacctacatcggtaaccgcactataacactcaccgagacctcaacccctgagccccatgcctcaagaagctggtcgagcaggtacc

SEQ ID NO: 533858 - DNA, 360 bp, Homo sapiens
  misc_feature (177)..(177): n is a, c, g, or t
  misc_feature (251)..(251): n is a, c, g, or t
cgtctctcgcctgaacttcacgctgctggtccaagctcgccagagctaagacagcggaaatgagcccaaggcagatgcagctggagggaaggagacgaagtcacactcatctgctcttgcccgcggtccatcctagaccccaaactcatgctggagccaattgggtgggcagccccngcagagctaatccctcggacggcagggttgcggtgagcagctctctggaccctgagaagtgtaccagcgccctngagccgcgatggcatctcactgtgaagcctccagcccccacgggaacaagcgccatgtcttccacttcggcaccgtgagcccccagacctcccaggctggagtggccgt

SEQ ID NO: 533859 - DNA, 446 bp, Homo sapiens
  misc_feature (130)..(130): n is a, c, g, or t
  misc_feature (152)..(153): n is a, c, g, or t
  misc_feature (174)..(174): n is a, c, g, or t
ggtagtagccatggcggccatgagtttgttgcggcgggtttcaggttacctgcggtggccagctcttgtctgggcctggccccctttggccacttctgcctcggcattctgcggggctttcctaactcgntggctttcctgaaggctgctgnntgctccttgtttccgggaaancaaaccaaaagggtttggggcgcgccacaagggggaaaaaaccccccccaaaaaagtctttgcgggggagcagggaggggcacacacacacacccccaccaaaaacaacaccagggcgggacgaaaaaacccgtttttttacaaaacacgttttttcaacaacagagagaggggggggacactctttccaacgcaccacaactctcgtttttttctcacccgcaaaacaaaaggagagggggagagaaaaaaaagacataccacaccatgtt

SEQ ID NO: 533860 - DNA, 847 bp, Homo sapiens
acagatttttcgtgcctattcctcgggggcttggtcggcgcacacccagtatccgttgacgtctcttttgtcgtgagcgtggggcccacgggccgtggtgttaacaccactctgacggccactttgtgtgcgcacacacccgacgtggcggggggcccccgaggggcacaccgcacagatagcgtttgcccttctgctggttctcctctacgcaggagcggggtcttgcgggcaaaaaagacacgtgttttggaacacgaagttcgggcgccaactaccactggcgccaggcaggaagacgctgggttaggccacccccggtggcttggcacctctgggccacgcgaacgctgggagtcacttgcgaacgctggctcagaccacacggctccacagcctggggtgagaccgccgcccgcccgctgtttttccacacgacgaaagggagactatgagcaacgccctcggggcacaaccacccgcttttttgagccgctctcatctctcctggagttttgctatgctgccgctcgtcccgggccccgccacgttcgaagggttgctgtggcccacccccgcttccactggtttctataagcgggcccgggtcccaccgccggccacgcagccgctgctcaactcggagcgacgccctgggcctgcagcctttccacgcttcttcccccggggtccgccgtaaccccggcccccccccagacccccgagtttccccacggcccttcccaggtgcccggcctccctcccccccaaccattccacagggtcctgacctacctggcccctgagtttggggcaaaacctgaacccattaagggtttggaaccca

SEQ ID NO: 533861 - DNA, 155 bp, Homo sapiens
cccgcgaattaaccctcactaaagctgttcacaaatggtcgtggttcgattccatggactactccggtccttagtgagagttaattccgtggttcgattccatggactactccggtccttagtagggttaattcctttagtagggttaattgggg

SEQ ID NO: 533862 - DNA, 125 bp, Homo sapiens
acctctgaccgagttcctttctccgtcccacccaggactggaagaattcttgtgggctgcattccccgtgggtaaatgcgagctctggagatcgcatacgagaaacttgtagtgtcctgtggtcc

SEQ ID NO: 533863 - DNA, 1026 bp, Homo sapiens
  misc_feature (1)..(1): n is a, c, g, or t
ncgagtcttgggcttgttgtcgtttctgctctgaggtgtttggcgagggcgagtgttatgggaggtgtcctgcatatgggtggttctcgtgtctgtgggacttaggtttagcgtagttatatgctgatggtggggttagtagggtcctcgcaggacctcctaaggtgatgggtctgcccgtttagggcgtccgattatgcaggggcctgcgggttcgcttaactacgtaagctatctgctagcctagctaattttcgggtccgtggcttgcatttgtgtctcttgggggcgtgcccctgtgtgaaggctcggtgcggggctcccaaggctggtttagcgttggcttggtggttttgcgttgctgggttgggtggtgggtccgcgctagtcgtggggggtttggagggtgatggggttggcctctgggcgtctggtgtgggttctgcgtgccagtgcgtgggtttggcgtcgggtggttaagaggcttgatggcaggaggcatctaggagtcgttgttttgcggtggcaagtttgggtaggtagcgcctcgacgctctaaggctgtcgtcgatgcgcgtaggcttctgtggtatgccgtgtgtggctcccgggcgtgcggccagggagtccgcgtgccccgggccctgacgcagcgcgccgcgtgggcttgagcccgcggacccgcacaccaggccggcctccacgggccctgcccggtggaaacgcggccctgcctgagggccctctctgccctgtcttgggtcccagtctgggtctcgtgcgcacgcctactctgttcatgtgtcccgggcccgttgatggatgaggccgctatgaggcctgaggatgagctggaatggatgtgatgaggggtacaaaacccaccttgttggagcctgcatgggtggtgctgggactgagccagtcctcaggggcatgtattggcctggaggtgtggttgggattgtggggctggtgccagccttcctctgcagctgacctctgtaaacctccgcggtgggcgga

SEQ ID NO: 533864 - DNA, 120 bp, Homo sapiens
aaggtagcctttagtctgggccctgatgggtaggtggaaatctattaggaggtagacaagagtgtgaggaaatgaaacaggtcaaaggcctttggggtagtagaataaaacaaaggctag

SEQ ID NO: 533865 - DNA, 653 bp, Homo sapiens
ggctggtacggtccgaaatcctcttggatctgggtgacaagagcaactccacctcaaaaaaaaaaaaaaaaaaagggaatgagggcttgtgcctgtactcctggctactcagtagactgaggcagaaggattgcctgagcccaggggtttcgaggttatagtgagctatgattgtgccacttgaattccaggccgtgggttgacagacccagggacccttattctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccactcgaactatctcgtctctctctctctctacgagttgcgcgcgcgagctgtctcgcgctcgcgccgcccctcgtcttatctttttatcgacagagcggcgcgcgcctcctacgtaaggaggagcggtagtttatatatatatatagctagagggagggagcgggtgctcggtttatataacaaagcaggggcgagacgagagggaagaacacaacagcgtgagagcggagcggttcttcttgtgtagagagcggcaccctttactatctgtcggggtgaggcagagaaacagtagggggaagcaacatcctctccgttg

SEQ ID NO: 533866 - DNA, 156 bp, Homo sapiens
atagtttgtttcacatccctaacaagcagggtttacctgagcacacacacttcggctggaggctgattttactgcctcccctgggcgccacgttcggcccgtcctgcggggaggcacgggcgcggggggcgcgcggacgcccggtgaccccgcagg

SEQ ID NO: 533867 - DNA, 450 bp, Homo sapiens
gatccttacgatcggacatgttggcttgctgggccctttatacgattgggtggctctgcctcggcttcctactccctgcgcccaggtgggcgcacgacttggggcctgcggtctgactgttccctccccttagttttagacctgagctgccgaacgctcagtgggccgggagctaggctgggggaagcagtggccgttttctgatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggttcgcggagagccgcttatgggtgtggtccgagcgga

SEQ ID NO: 533868 - DNA, 109 bp, Homo sapiens
acttctttcttacttattctttctctctttccttccttccttccctccttccttccttcctttctttctgttggtaatagtatatgctgtaataatttatgaaggagag

SEQ ID NO: 533869 - DNA, 726 bp, Homo sapiens
  misc_feature (15)..(15): n is a, c, g, or t
  misc_feature (89)..(89): n is a, c, g, or t
  misc_feature (95)..(95): n is a, c, g, or t
  misc_feature (101)..(102): n is a, c, g, or t
  misc_feature (114)..(114): n is a, c, g, or t
  misc_feature (137)..(137): n is a, c, g, or t
  misc_feature (141)..(141): n is a, c, g, or t
  misc_feature (144)..(144): n is a, c, g, or t
  misc_feature (157)..(157): n is a, c, g, or t
  misc_feature (174)..(174): n is a, c, g, or t
  misc_feature (187)..(187): n is a, c, g, or t
  misc_feature (201)..(201): n is a, c, g, or t
  misc_feature (270)..(270): n is a, c, g, or t
  misc_feature (284)..(284): n is a, c, g, or t
  misc_feature (306)..(306): n is a, c, g, or t
  misc_feature (359)..(359): n is a, c, g, or t
  misc_feature (368)..(368): n is a, c, g, or t
  misc_feature (397)..(397): n is a, c, g, or t
  misc_feature (403)..(403): n is a, c, g, or t
  misc_feature (481)..(481): n is a, c, g, or t
  misc_feature (504)..(504): n is a, c, g, or t
  misc_feature (586)..(586): n is a, c, g, or t
  misc_feature (658)..(658): n is a, c, g, or t
  misc_feature (708)..(708): n is a, c, g, or t
accaatgccaccttnataataatggtcctccacggtaaggatcctgcccattggtggaacaatcgctgtcgagaatgagttttctgtcnaggggntttatnnttaatggggtcnaacacgcggattttgattttttntttnttnaacaattcggcancggccaaggcctcttgnagggtcaccccanccccgataacggtnacctggtcatccttgctcttcaagaccaccttggcttttccgacctggaagtcctcattttttttatanataatggcattttntttgcggctggtccggattaancaaataccctttgtattggcggctagttccactgccttctctttagcaacgcnatcacttgngtaaaagacaattaatatagggaatatancaaaanatagccagatcttctagggccatctgggagggcccgtcttccccgatggaaacgccgcagtgggagccgcagaggttnatgttgctctcggagatggcggncatgcgaatctggtcaaaggcccgcgtgaagaaggctgcaaaagtgctgcagaagggcacgtacctgttgcgggtggcacancccaccgcgatgctcaccatgttctgctcagcaatgtagcactcgatgaagcggtccgggtgctcttttttnaagatttcgagaaggtggaatttttggtgtcccatccagggcgatgatgngtcactggcatggccaac

SEQ ID NO: 533870 - DNA, 1256 bp, Homo sapiens
tgttgagtcccgtgttcctgtatatctcatcctatggggaaaccaagttggcagtgtcctaacggggtggtggtgtaatctctatccttctgcgtgtaagaacttggcgaatatcgaagatggggttcctcggcaaatatatcgcgctgcgacattatggggcacacgcacaggaggaggtgaacgagtttcatcgatgcacagagcatccacccaaggaaattgcccctgcacacatgacctccacctatcagaatggacgcaggcccgaatcaggcaatacacccacagagcgcacgacttggggagcgaattccaaaggaccacatggggagtgccttcatcgatacggcaactgtgccgatctcctggccaggaggaagctggccacctcccaaagtcatccagaccggagctctcggagtggacatgggacgaccgcctggatgcaagcgatccgcaagacagcacggggcagacaagtggaccctaagaagtcagagggaaattcgggtgaccctcactctgaccatcacagccattttctcgtcaagctaactagctgggctcggctgcaagttggagcgcgacaattgggtctactctcgataagcagccatggaagagaagaggtcggggtctgtacgcgagacacgagggggattgaagaaagcgaaaggatcatgatatttggaccctccttagaagagacagacccaggaggcagttcctcaatgcctacgtgtccctggaatcgggatgatgtgactcattaggcaaggaattcccatcatacctacgtggtggttctgtgccttcccctacgtgcatcgttcatcatgctctcaggtatactgacgaatgctgcatgaaaactcatcatcacggcgacgccctggcggaagggtggagaaggaaacctaatacaagccccgcacgtccggcacgccgtaggagcgatgcaggcgcgacaacaactgctgcatccagacaacccacgcccgctcggtatggtagtacgttcaagtccttcggagtctataggaatcgtctacacatgtgtacggaaagacatctcgcagcagtgtggaggaagacaagacagtccatggaatgaagcatgtagcatctatggggggaggggggagggcgtgcctgaaaaccatgccatcctgtggaaatgacagaacggggaaggtttttatgtgcctttcttgtcttttgtaaaaaaggaacacccggaagactggaaaaga

SEQ ID NO: 533871 - DNA, 375 bp, Homo sapiens
attcctctcctttcccttggcctcccctggtgcctttttttccccggatttttcctcgggtcatctcctctccctttggggggtaagccatgggaaagggatgagggaggacaggttttggttaaacccaggtcccttttccccatcaaatgaacattgggttcctgggacagaaggccttcaaaggggggattgcaaagcaaggcaaagcgttctgttttcattttccccctccccatgagacaagactgatggaaagggggggggggcaaccctgcttaatggaggccctttcccatcatttcggtttttagccctcatggcgggattttttaatcagagccaataaccttttaaataaaaccacgccaaaga

SEQ ID NO: 533872 - DNA, 557 bp, Homo sapiens
  misc_feature (23)..(23): n is a, c, g, or t
  misc_feature (36)..(36): n is a, c, g, or t
  misc_feature (350)..(350): n is a, c, g, or t
  misc_feature (402)..(402): n is a, c, g, or t
tccaaggctctgtgggaggatgnaggagtgcgtgcntgctacggaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcntgcaggaggctctgaacctcttcaagagcatctggaacaacagatggctgcncaccatctctgtgatcctgttcctcaacacgcaagatctgctcgctgagaaagtccttgctgggaaaattcaaaaattgaggactactttccagaatttgctcggtaaactactcctgaggatgctactcccgagcccggagaggacccacgcgt

SEQ ID NO: 533873 - DNA, 117 bp, Homo sapiens
tccataatgtgtgccagtattgttctgtgtgattttgatcctgtcatcatgatgctagctggttattttatagacttgtatatgtggttgctcctgtattgggcacacattatggag

SEQ ID NO: 533874 - DNA, 340 bp, Homo sapiens
tttttttttcggtttttttaagacggagtcttgctctttcaccaggctggagtgcaatggcacgatcttggctcattgcaacttctgcctcccaggttcaagcaattctcctgcctcagcctcccaagtagctgggactataggcgcctgcaccatgcccagataatttttgcattttcagtagagagggggtttcaccatgttggccaggatggtcttgatctcttgacctcatgatccgcccacctcggcctcccaaagtgctgggattacaggtgtgaccaccgcacccagccaagcaccactgatttttaaaaagcagaaaactttgaagttaaac

SEQ ID NO: 533875 - DNA, 383 bp, Homo sapiens
  misc_feature (176)..(176): n is a, c, g, or t
  misc_feature (228)..(228): n is a, c, g, or t
tccttgtaatccaagcagtcgggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcntgcaggaggctctgaacctcttcaagagcatctggaacaacagatggctgcncaccatctctgtgatcctgttcctcaacacgcaagatctgctcgctgagaaagtccttgctgggaaaattcaaaaattgaggactactttccagaatttgctcggtaaactactcctgaggatgctactcccgagcccggagaggacccacgcgt

SEQ ID NO: 533876 - DNA, 807 bp, Homo sapiens
aaggcaaggagatctaggacatctagcccctgaactgtcaggcgaatacatcttatgcaaaggagtgaattcgaggagcccttgtatcactggcagaaggacgtgaccatggagaagctgttgtgtttataggtctagaacagggcgttctctcatgcttttggccagactagacgattgtcgaggaaggcttcggtgtatcccaagagagtcggatacttccgtatgtatcccgtccaaatgtaccgtgaacgaagccggcgtcaaagcctttcacgtgtgtgcctccacattctaacctcgggaatttgtcctcgacccgtgggtacagatttactcgtaggccagcaagagacaagacaatgacgattcatcaatatggggtctacatggatctatggatacaagagatagcagtggggtgggtctgaaatataattcgaaggtttcctgaaggtcacatgtagctccagtacacattttgtacgaagctggagagtcctgcctcaggggaatcgtggaaggtgctgggtagatggtgaaagcccaagtgggtgatggcatgagtctgacagaagggatacggctgtgggggcagaagcattgcatcactcttggggtaagatgcaggattcattcgggtgggaactttggaagggaaagccgattccctagtgggacgacattggcaaactgtgaacgtgtgggactttgtgctgtcaccaagatgaaattaccaccatctatctgggggggcccttcatcctaatgtctggaggctggggaccctgacagttttcacggcca

SEQ ID NO: 533877 - DNA, 320 bp, Homo sapiens
  misc_feature (300)..(300): n is a, c, g, or t
cgtgcttgtgcattctacatattttgttattgttgcccggattgtgagcatattttaatagctacttgtgctcccaggttatggtgtaataatgtataccgaatttggcattatacaggctctatctttgcatcagtattatgtgctattctaatgacagaattatggcaggtttcttgtgtcaggctcatttttgtatgacctatttccagcaaacacaattacttaccaagcagctccttcatgattgggatcctctatagtctatctagcaggtctttcagcttggtgtatatcttntgtcggttgctgtttcctgt

SEQ ID NO: 533878 - DNA, 398 bp, Homo sapiens
  misc_feature (25)..(25): n is a, c, g, or t
  misc_feature (170)..(170): n is a, c, g, or t
  misc_feature (190)..(190): n is a, c, g, or t
  misc_feature (199)..(199): n is a, c, g, or t
cccccaaaaaccccaggggggttcnaaggggccctcagggcacggggccccaacccgcattgtgtgggagcacacacgcggccgctatttgtgaatgcagtggcctttttccagggccttggggccccccatgaccctgcacttgaaggacccccgccccggggcccccngggcccccggggcggggccnccgggcccnaacgcccccggggatccggccccgcttgcacccaaggtttccccgctgttgtcaaagggggagcttccagtgttttcgcagttttaaatcccccccctttgggggtgggccatggaatgtgggtagttttttcatttggagggggctgcagggaaggggggttggggtggccaataaaaaaggccccatgacccaccca

SEQ ID NO: 533879 - DNA, 902 bp, Homo sapiens
  misc_feature (552)..(552): n is a, c, g, or t
aagaaaaaaacaatggcatggatgaggccggtggggtttttggcacggagggagagagagagagagagagagagagagagagagagagagagagagagagagagacggtagagagggggccggggggagagacgcgcgcttgtgtgtgtgttttctgcggagagtgagagagagtgtctagagacgtcctcttctctcgtcgagatgcgaaaggggcccatcatcattgaaggagaaaccatcatcatgtcgcgcccagggttgaggaaaaaagaggacgagcacgcccaccaacacaaataagtcatcagctggtcgggtggtgtggtggagacaatggtggtggtggtggcgatgtcgtggtgcatcaccagcattgtcgtggaggatcgatcgtcgttcgtggtgcgtgagagtagacagctgcagctgcttatgggtaggtagtggtgtgtgaggagagaatgaataagtagcatgaagagagaggaagaagagatagagtgagtgagtacgtagggacaaggcaagatggaggacagctcaatattnattgcatatcgaagaaagcaagtacgtaagaagattgtgtgatggaaggaagaaatcacagatagatatctagtctgatcggtcgatgaaggcaggacgatatatgatcgatagaaaggatctgatggtgagaggtgggagataaggaaacggctaagcagagaatagaatagagttcgcttcggttcgaaaggccaggattgacgagagggagtgaaggatggttctgggggcaatcaattcattcgttgggaggtaagcaagaaaggagataggttgttggtaggtcggttgctatctaaataatatctatctttacatacactcgaccgaaagaatccgacaatagc

SEQ ID NO: 533880 - DNA, 274 bp, Homo sapiens
tatcctgctggagatactggacgaggcgtggtgtgtagaggcgcaagaaaaaagcgcgctgttaaacgagtttgtgtcgacgtggactgaggggagctggactaccttagtggtggacacgcccccggggacctccgatgagcacattggcaccatagaagccctgcgtacctaccagaccctgtggggcctcgtggtcaacacgccccaggcggtgtcccgtgaggggacgtaagggcgcagagattgaaccttcgatactcagacggtgctg

SEQ ID NO: 533881 - DNA, 711 bp, Homo sapiens
gtgtctaaggcaccctgcttccttgcttgcatcccacagactatttccctcatcctatttactgcagcaaatctctccttagttgatgagactgtgtttatctccctttaaaaccctacctatcctgaatggtctgtcattgtctgccttttaagaatcctttcctctttcttcctcctctattctccgtacataatgatggggctaagttatacccagagctcactttacaaaatatttcgcctcagatacatttgcggagaaacaccaaacaaaaatgccgctttttttaaagggggtgtattgtttgcttgtacaggaatgtaagctcctcaagagcagggacagaggtgtgctgtgatatggtgcctagtacactgtaaatgctcaataaatatggatgatagagaacgaaaatccagtacaagatgataagaaagattgtggggccgcgcgtgggcgcctttggagaacatgttcgagacacaacctggtgcggcggcgcgcgtgccagagtggattacaggaccactggttcccgacgcgggcctcgaaaagagagaccggggtcgcgacccacggggtgggggtacccaaccccagaaaaaagccgccgcgggggaccacggacggcctccgaaccacccagagagacgctggggcctacagggtccttgccagggaggccagcgaggcgggaaaaatgagcgg

SEQ ID NO: 533882 - DNA, 129 bp, Homo sapiens
gggggaaaccgcttttaccgtgaatacggtttccctggccggcggtttacggggagaaaccccttttaccggggatccggtttccccggccgtccccttagcacgggaagcccccctttccgtggagcc

SEQ ID NO: 533883 - DNA, 520 bp, Homo sapiens
  misc_feature (240)..(240): n is a, c, g, or t
tccacgcgagttagagtgtctcatatcacactctgtgacaccacagtgtgtgttaaacacagcgcactgcgcatataaaatataatacacaaaaatatataaaagccgcgttataggggagcactacacaacatgtgcacatattcttctctcttgtgatattgttgtgtcactataggtgcgtcgtggagagttatatatatattatcgccaacgagtatagagacgcacatctgtgtntctcgtgacacgaacacgttgtagagacgacagagatagagaggatatggcacagtgtttgtgtgtagagacgccccacgagtttgtgtgtgacacagcgatatctctggggcgatattggtgcgcgcatatgtgttggagagaacacactttcttggagaggcatatgagatctttgggttgtgtatatttcctctttcacagagagagagtatgcgttacactattttcactatatatactctacatgtgatgtgacacgtgatatacatcgtgtttt

SEQ ID NO: 533884 - DNA, 258 bp, Homo sapiens
ccagccgagggacacctgacgtgcggtaccgttcctggtttacagctgaacttgatcagacctgaggattgtaggttagggttggcacctggccccccggagctggtgctggtggtccaggtgcataccggcccgaatactagatttctgctggacttacttcgaaaggcccagggaattgacaacggccctcgtcaatttttagccaatgacttcttggtcggcccaggataatcagctgatcgcggggtgatttct

SEQ ID NO: 533885 - DNA, 359 bp, Homo sapiens
  misc_feature (359)..(359): n is a, c, g, or t
ccgagaaccggtctagctgatggcatggacactgtattgcttatctgcaagatgtacataaccaaattgcgcttgaaggaccgccagcagctctccaagctgatcattactcagctgctatatgaccgctacatgagcatcgccaagggactcatcactgaactcaagcctcagtctgagtgtgcacactcggagcagttcctgcatctcatcagactagggagagtgtgaacacacatccatacgtcccatggcgaggaatgcctggcacaggtaacgacctgctatgctgcagatcgtcacactatgcactcagaggctattgagtacgcatgctatgtcacatcacatgtaggccn

SEQ ID NO: 533886 - DNA, 297 bp, Homo sapiens
ttttaggaagagagcgaggcagtgcattcagggaattctggaggcagccttcagtgagggggacacgttccacccactgtccctcaacaatgtcatttcagagagagatagtacactgtgtgaaatgtggagcgccaacaagcggggctcttaggcgatcactagtgagagtttataagaggatgagtgatatggtgagcagcggacttcaaaactgtcaagatcaatccagcggttctcaacggtacacagacttttgacatcagcctcacctagaacttgttgaaatgccaattc

SEQ ID NO: 533887 - DNA, 229 bp, Homo sapiens
cacttggtgcagctggatgatgttgccaggaggcgaccgtctcgtcctgggcaaaggtgatgtaggcatagtcatgcaggcaaagatctcaggcatatcatggagtgggaggctcttgatgtaggagaggtcgccgtgccggtcgtaggtaggcgggatctggtggtagatgcccgaggagctgtagcatgtgctcaggggcgagcacgtcagggtagtcgaagtcctc

SEQ ID NO: 533888 - DNA, 607 bp, Homo sapiens
tcgggagtggtgtgaggccccggttgcggggcgcgctgacgaccactgtgtgggaggggtggtccccttttgtccgccgcatgggtgcggggagtggtagccgtttgttgctggcccgaccacctcgtggtggaggtgcgagcagttttgtgaagccacctatattgatgtcacgacagagttagcgtgactatgtacgccccgtgactttcttcgtggggcatgacacacttgtggtcgcgcgcgccgccctctgtgcggctccacattacgcttctgaaacacagtgcgccgacgggcgtcgtagtgctgctctctcccatgatatatttcggctgcacccttacagaggggcattaagtttgtcgcacttgcttagttctcctaccacagcgcctattgtggcgagtcagcaggccggcatgttctgcaccagggcctgctgagttctacgcgggcctcgcctacccgcccccgccttggggatgatgtcgcaggatccggtcgggttgtcattagtcgagtccgcgagtcgaccccgtccctcgtcccggtggtggtctgcgcgccaccccccgtttaccctcacaagggccccaacaaaaca

SEQ ID NO: 533889 - DNA, 425 bp, Homo sapiens
  misc_feature (15)..(15): n is a, c, g, or t
  misc_feature (31)..(31): n is a, c, g, or t
  misc_feature (68)..(68): n is a, c, g, or t
gacaacatgtctganatcaagttacatgctnacactagcataatggccagaagaggaggtataatgcnactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctctccatgcactccagcctgggcgacagtgaaaccctgtctcaaaaaaaaagcccaccccttagggctgggcatggtggctcgcgcctgtagtcctaccacttggggaggccaaggcgggttgatcacctgaggtcaggagttcagggaccagcctggccaacatggtgaagc

SEQ ID NO: 533890 - DNA, 1961 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533891 - DNA, 2081 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533892 - DNA, 131 bp, Homo sapiens
tgtcttgtaccagcattggcacataggagccttctaatgaggagcctatccctgacacacgtgcaacgatatatcattttctaatccttcgcactaggataacctacagtttatgatctctcatgagttat

SEQ ID NO: 533893 - DNA, 1924 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533894 - DNA, 219 bp, Homo sapiens
agtgcttcccagaggatgtctaagctggcccaaaatcagcagcccaccctagcctctgggggctgagtgcaagggctcctcttttctccacacagactgggcaccctctgtgggcctaaggtaagaggtggtctatttctaaaagtgctggtgtctagttaacgctctgaggtactcatacttacgctttgctatataatggggggtctcattcagacg

SEQ ID NO: 533895 - DNA, 129 bp, Homo sapiens
gaggatgttttattacggctctgtgctggctctccttcctcttggctgagatagcagaggggctccccgggtctctcactgttgcagtgggctggccgttcagcctgtcttccccaacaccccgccctt

SEQ ID NO: 533896 - DNA, 1849 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533897 - DNA, 2429 bp, Homo sapiens
  misc_feature (9)..(9): n is a, c, g, or t
  misc_feature (11)..(11): n is a, c, g, or t
  misc_feature (223)..(223): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacccgcgacctgcngcccgagctggctgccaggcctatcgccgccgccgagaccctccggccaacagggacccgcggtggccccggccccccggtagtgtctccctgacccgagtcccgtccccgggcctcttgccttcaaccctggtctttcctcctccccgggaccttgagtccccgaggagagcgagggagaggagcgccttctgcagggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533898 - DNA, 177 bp, Homo sapiens
tcggtttcacaatgtatctctctggtctgacccttctgcctcctccttcttcatttaagaacccttgtgattacactagggcccacagccaatacatccaggggtagtctactctactttgcaagtcgagctgggttagcaacctataattccatctggcagttttaatatcctctt

SEQ ID NO: 533899 - DNA, 1705 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533900 - DNA, 1630 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533901 - DNA, 1479 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 533902 - DNA, 130 bp, Homo sapiens
tctcatcttcatcccgtcatctccataatgctgaggatgtatgtcgcctcaagaccctgtgatgagttgcgttaactgtataaattgtttgtaaaacatgtgtgttcaaacaagtatcaaactctgattg

SEQ ID NO: 533903 - DNA, 470 bp, Homo sapiens
  misc_feature (9)..(9): n is a, c, g, or t
  misc_feature (30)..(30): n is a, c, g, or t
  misc_feature (51)..(51): n is a, c, g, or t
  misc_feature (69)..(69): n is a, c, g, or t
  misc_feature (463)..(463): n is a, c, g, or t
  misc_feature (466)..(466): n is a, c, g, or t
agctttcancttaatttttaaaatggaaangcatgcaagcataatccaggnactgtccttcctgaagtncccaggcatcatgctgtgcactttggtaaacgaagtagacatggttgctcccctcagagaacgttagtgccccgggttgttgtatgtaaggattagataacactgtgtatgtaaagcacctaatacaatgtttagctcagagtcattgcttgttaaatgctggggtttcctcaggggactttgtcatacccccaatttcctccccactctacatgccatccacctggggttacagtgcagtggcgtccaattcgtcatcaggaatcaccactttctggggtgtacacatctagaccccttcaggacaaattgtaaacatagctaatagcataatactgctagacagttcatatgatgcgctgtctccagtttataaactcattgactcaggccnatntatg

SEQ ID NO: 533904 - DNA, 167 bp, Homo sapiens
actacgaccttcgcgctcggtaccctttttttttttcttttcacccggttcaggccacctttggggggttttctgggtctccaggcaggcttggccacctatctgcacccaaatatccaaggtcggggcggggtgcagcacagcttcgggccaggggacatcctctc

SEQ ID NO: 533905 - DNA, 179 bp, Homo sapiens
cacctcgttggtcacggcacgaacctcattggcatcatcagcccggtagtagcggcaccatcgtgagccttctcttgaggtggctggggcaggaagctgaagtcgaaaccagcgctgggaggaccagtgtggaccacggaggtccacggagggccgggggaacccgacaggaccattag

SEQ ID NO: 533906 - DNA, 1706 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533907 - DNA, 104 bp, Homo sapiens
acctagaggatccccagtgtctgagaaggtgatctaagtggccggctcctccacacacacacacacaccagtggaaccaatgagaaccacgttagacatcctca

SEQ ID NO: 533908 - DNA, 385 bp, Homo sapiens
tgagatggagtctcactctgttgccctggctggagtgcagtggcactatctcggctcactgcatcctctgcctcccaggttcaaagattcttgtgcttcagccttctaaatacctgggattacaggcacctgccatcacacctggctaacttttttttgtagttttagtagaaactggtttcacaatgtaggccaggctggtttcgaactcctgacctcaagtgatccacctgccttggccttccaaagtgctgggattacaggtgtgagccacagcgcccggctcaatgactggtatttttataagtagaagacaatttggagaccgacacaggcccaggggggagaacaccaagtggacgccgaagcaaagtgaaaccttcgc

SEQ ID NO: 533909 - DNA, 1320 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 533910 - DNA, 90 bp, Homo sapiens
gtggacacagccacatattactgtgcacggaactggaactacctcgggggactctattactcttacggtatggacgtctgggggcaaggg

SEQ ID NO: 533911 - DNA, 133 bp, Homo sapiens
aaaggctctcgcgacaccctgtacgaggcggggcgggaagtccgcacgggaaccaacaaaggccaaaaatttcctgggaacggttggatttaacagataaactttaagacccttttcgttcccccagagggga

SEQ ID NO: 533912 - DNA, 383 bp, Homo sapiens
ggagaccccatctctacaaaaaagtaaacaattagccgggcatggtgcacacgcctatagtcccagctactcaggagggtgaagatcacctgagaccaggcggtcaaggcttcagtgagccatgattgtggcactgcactccagcctaggcaatagagtgagactgtctcaaaaaataaaattttaaaataactgaagagtataactggattgtttgtaacacaaaggataagtgcttaagatgatggaaaccctatttatcctgatgtgattattacacattgcatgcctgtaccaaaatatttcatgtaacccataaatatatacatctactatgtacccacaaaaattaaaaaatgtttacaggagtgaaaaaaaaaaaa

SEQ ID NO: 533913 - DNA, 408 bp, Homo sapiens
cgctagtgaagtcatagccatgtagcatcatagcacaagttacttatgtgttgtgatgctgctataaacaaacctactgtgctgccagatgtataaaagcatagcacatacaatcatgtacagttatgtcatacttgatgacaataaaaaacaatgatgttaatggcttagtatttacaatactgtacttttaatcattattttagaatgtactccttctacttgtagaaaacgttaactgtaaaacagcctcaggcaggtccttcaggagatattccagaaggcattgttgtcgtaagagatgacagctccatgcatgttcttgtccctgaagaccttccagtgggacaagatatagaggaggaagacagtgatattgataatcctgaccccatgtagggctaggct

SEQ ID NO: 533914 - DNA, 466 bp, Homo sapiens
taaacaatagttacaatagcactatcctatcttaccctactagcagcaagcctagcatacgaatgaccccaaaaaggcctagaatgaacagaatatgatcattagtttaaaacaaaacacctgatttcgactcattagactcatgatttacttcataattatcaagtgccattagtatacataaacatcataatagcattcacgatagcccttgcagggttacttatatatcgatctcacttaatatcttcactcacgtatgcctagaaggaatgatattatcactattcatcatatcgactctaatggtcctaaacacacactatcaccctagctaacataatacccattatataactagtgtttgcagccttgcgaggctgcacggggcctatcactactagtaatagtatccaacccctccggtaccgattacgtccaaaacttaaacctcttacaatgctaa

SEQ ID NO: 533915 - DNA, 341 bp, Homo sapiens
gtggacctgagagagatgagattctcagaggcaaaacgagatctgggagcaactaggctagtggaagggagagtcctcttagaaaattctgagcaaagatgctcccattcacgagggatggggtgagcgggcagtgattctgtctgtgagctatagctcccttctgaactccctcagtgttctagggaggacacaagcctcgtagctcattaagcaaaggccctccaagtctcctttttacttcagcacttaggaaactctccaagacttaacttccgatctggggaggtactacgtggagcagacctatcccttcttattcctgttgcagtgtgcttccg

SEQ ID NO: 533916 - DNA, 184 bp, Homo sapiens
gcttactgcttctgcctggggcatggtgggtttgatcttcttccccttcttttcttccccttcttctttccttctttgatcttcttgcttcctgcttctgcctcagggcttggatttccttttctctctgcctgggtccccttcgccggatgttcacgtggctctctcctgcttcctgcttctg

SEQ ID NO: 533917 - DNA, 235 bp, Homo sapiens
  misc_feature (187)..(187): n is a, c, g, or t
caacttcgagagaagcaaacatagctcacatatgtgaataccttatgaaagtcactggctcataagaggaacgggatgcagactgcagacttctgactctcagctagcgtccctgctcatttccaaggaaatggaaagacacaatgctactgttatttgaatgtttaggagaagggtgggtggcggnctctgaacgaaagtatcccaaatcgtttgtccttgggcgaattgtttg

SEQ ID NO: 533918 - DNA, 257 bp, Homo sapiens
caaggatttacttgccttcgccttctggctccatacagtagtctctcttcttgcggtcttggccattccccccaccaggcccccagctgtggctgtgtctgggtcttggcatttgtaatgtacatgggtctaggccctttctctccacctgtccttcccctctttggacacaaaccaaaacatctgagcatctccttacagagggaggtctccctggggttgctgtgccaagtttccattgcttttgcccagaatga

SEQ ID NO: 533919 - DNA, 346 bp, Homo sapiens
  misc_feature (286)..(286): n is a, c, g, or t
gcggccgcctactactactaaattcgcggccgcgtcgacggtggccaggaaattaaaaaccaaagatgaggccgggctcagtggctcacgcctgtaatcccagcactttgggaggccaaggcagtggatcacaagatcaagggatcgagaccatcctggccaacatggtgaaaccccgtcttgactgaaaatacaaagattagctgggtgtggtggcgtgcacctgtagtcccagctgcttgaaggctgaggcaggagaatcgcttgaacctgggagatggaggtngcagtgagctgagatcacactactgcactccagcctggcaacagagtgagactctgtctc

SEQ ID NO: 533920 - DNA, 263 bp, Homo sapiens
gcatggtgggatatttcttttcatttttccctgcgcttacaacttggaacatgtgggggggtttaattcatgagcattggatactgaaaagaaaaccgaatacaataccagacccagccctacactttggtttgtcatggtgtcagcgcagcagcctacagctaagttcctaaacgccactttggactaatttaaaaaagaatcccgatatttacttttactggatggtgaaattggttgctcttgtattttatgaaaaaaag

SEQ ID NO: 533921 - DNA, 534 bp, Homo sapiens
gacattattgtattctcattaagcagaggaggaacccaaagaacaaagaaattatataatgtgctcaaggtcacaaagttaatacaagatggagctggaatttaaacacagatacatctggtaccaaatgaatgcgtttttccacatccacctgtatgcttgtgagttctagtgctacttagtgaatctcaccagaatagaatacatgacaagtcccttactaaaactggagaaagtcaaagtatattaaagcttggcctgcatatttataaacaagttttctctgacatagataaatatcaagcattagggacagaagacgaataattgacaaagtattgctaagttgctcttattgtgtagaactttcccattttaatggtgactcatactaccataaaaactttgtttggtatttgtttgtgtcttattatatagagtttgatgtaatgcttacatatggcataatgtgtctttaatatgatgttaataaacctttatttaatgcttttgttttttagcatataaaaaaaa

SEQ ID NO: 533922 - DNA, 419 bp, Homo sapiens
  misc_feature (15)..(15): n is a, c, g, or t
  misc_feature (137)..(137): n is a, c, g, or t
  misc_feature (147)..(147): n is a, c, g, or t
  misc_feature (199)..(199): n is a, c, g, or t
  misc_feature (267)..(267): n is a, c, g, or t
  misc_feature (273)..(273): n is a, c, g, or t
  misc_feature (275)..(275): n is a, c, g, or t
  misc_feature (277)..(277): n is a, c, g, or t
  misc_feature (292)..(292): n is a, c, g, or t
  misc_feature (295)..(295): n is a, c, g, or t
  misc_feature (323)..(323): n is a, c, g, or t
  misc_feature (339)..(339): n is a, c, g, or t
  misc_feature (343)..(343): n is a, c, g, or t
  misc_feature (347)..(347): n is a, c, g, or t
  misc_feature (392)..(392): n is a, c, g, or t
aagaagagattgagnaaaagaaatggaaattagaattccatatcagcgttttatttgaacgtttgtcgcacaaacattgttatcctgggctagacaggcctactttcaattccagttctgctactagttggctatgntttatttatnctccataaatcctgattttgctcattgatacagatagggatatctactttanattaaaaagtagttagtatgtctgacaactgggaataagtccttaacaaataacaattatgataattnaggccncntntactgtgataacacngtntcattcaaataactcttgacaggctcgncttctaagatcaagcnaganagtntgtgtcagttaaaatgtgaatgaaaatgtaatgaaaggaagtacnaagaaatacatactttctactctcaag

SEQ ID NO: 533923 - DNA, 305 bp, Homo sapiens
tgggagtaatatgggctagagatagctacttttcatgcagcttctgactttcaaacccataagcgaatggctattttgataaaaattaaaggccaggcacagtggctcacacctgcaatccaaactctttaggaggccgcggggagtggatcaccttaagtcaggatttcaagaccagcttggccaacatggtgaaaccctgtctctactaaaaatacaaaaaaattagctgggcgtggtggtgggcgcccgtaatcccagctactcagaaggctgaggcaggagaatcacttgaacccaggagg

SEQ ID NO: 533924 - DNA, 812 bp, Homo sapiens
attaatcccctggcccaagccgtcatctactctaccatctttgcaggcacactcatcacagcgctaagctcgtgctgattttgtacctgagtaggcctagaaataaacagtgctgagctttttatgctcagattctataccaagagaaaagtgaacaccgcatcgattgcgcagcgagaagctggccagtcaagtagtttgcctcctagcgcaagcaaccgcgaagtccatatatccttctaatagctatcctcgtgtcagacacatatacttgctccggacgaatgaagccatgaacgcaaagtactaccaagtcaatactcatcattaataatcataatggcgtatagcaataagaactaggaatagccccctttcatcttctggagtcccagaggttacccaaggcacccctctgacatccggcctgcttcttctcacatgacaaaaactagcccccatctcaatcatataccagagatctctccctcactaaacgtaagccttctcctgcactctctcaatcttatccatcatagcaggcagttgaggtggattaaaccaaacccagctacgcaaaatcttagcatactcctcaattacccagcataggatgaataagtagcagttctaccgtacaaccctaagcataaccagttcttaatttaagtatttatattatcctaactactaccgcattcctactactcaacttaaatctccagcaccacaacctactactatctcgcacctgaaacaagctaacattgatagcacccttaattccatccaacctcctctccctaggaggc

SEQ ID NO: 533925 - DNA, 289 bp, Homo sapiens
cccggtcccctgtgctttacccccttgcccttgtgtttcaggtgtggtccccgcctgcttaaagaagttgctctgttcaaccctttggtgggatcatgtgtttggaggcttttaggggacccaactgccctggggccctgcccgtggcctgggtaggacatttcccaccaaaggctggaggagtttccgtgccttcagcctgaatcaaatgtcaaaaccacccaccggtgcttcccccccttggggaaaacctgcttagttttttaaaaaatgttcccggttggtttta

SEQ ID NO: 533926 - DNA, 444 bp, Homo sapiens
cagccgtgcgaggttgccctttacagccatgaattcggttgctggcaaagactgggggatggaaccgaacagagccggggcccctttgcagttgcgattttggccctacgttttaaacgggggtcctatactggcaatggctgaagaagattttgcaatggtggcttcggatactcgattgagtgaagggttttaaattcatacgcggaatagccccaaaggttacaaattaccagccaaaccagccattggatgcagcggttttaatggagactgtcttacgctgccaaagattattgaagcaggactaaggatgtataagcattccaatattagggccatgactacgggggcaattgctgcaaggctgcctacaatcctgaattcaaggggcttctttccatactaggttaacaccataatcgtgggactggatgaagatga

SEQ ID NO: 533927 - DNA, 487 bp, Homo sapiens
ggagacaagaggcggtgatggcggtcgggggtgctggtgggagccgcgtgtcagcgggagggacctgaattgcgtcccgaaatagctgacacactatgggctgtggccaagcaggggtttgatttcctctgcatgcctgtcttccatccgtcgtttcaagaggtgagttcattcaggaacctgacattaatgaatcggacaagtttgccctggagacatttctactgttaacccttaccgaatgacggtatccagtatctccgttgattacctattcatcttgacaccacggaagattgttgctctgcacttagccctaacgaccagtagaccgatcctatgagacttggcacagagccctcaggcctaaaggatctggagaggtgacgcgaaccttgtcaagaactcacaaagcaggggaatcctgacacgagaataccctacagcaccgtgagttgttgtgccaccctggatgcacgacaaagac

SEQ ID NO: 533928 - DNA, 112 bp, Homo sapiens
ctaaacactggtaaacctctatcttagcagatcaatgcaggatctaatactttagataagttctagctctaaaagtgatagtgggactgtatgtgttctgatacggtttgga

SEQ ID NO: 533929 - DNA, 132 bp, Homo sapiens
ggccaggaatgccttcttcctgctcatgagaaacatcatcagagtggctgtcctggataaagggactgacttcctcttcctgacagtgaagtacagttttatattgtgggaaactagaaggattaaactgag

SEQ ID NO: 533930 - DNA, 217 bp, Homo sapiens
  misc_feature (24)..(24): n is a, c, g, or t
  misc_feature (28)..(28): n is a, c, g, or t
  misc_feature (30)..(30): n is a, c, g, or t
  misc_feature (44)..(44): n is a, c, g, or t
  misc_feature (47)..(47): n is a, c, g, or t
  misc_feature (57)..(57): n is a, c, g, or t
  misc_feature (68)..(68): n is a, c, g, or t
  misc_feature (90)..(91): n is a, c, g, or t
ccaacgcactagcctaatggccanctgntnatttgattatcttnacnggaaatcctnttaaaaatatntgttaccctggctggagtgcanngacgtgatcacggctcactgcagccgcagccttccagcttgggtgatcctcccacctcagtgctccccaccctgagtggctgggactataggcatgtgccaccacaccaccatgctaggctaatgg

SEQ ID NO: 533931 - DNA, 486 bp, Homo sapiens
cttgggctgtcagtgctgtgccgcattgcagcatgtcctcaacaccaagggtgaagggtccatttgtcacctggtcaggtggttacgggacattttgctatgccacgctttgaatgagtctttggataataacactctcattccgttggacgaagagctcgctacatagtcaaaaacccacagggcctatctcaactataaagtgtgcctggaccgaggtgttccagtgataaagcacttgttgtaccatttcatgaatcgaagaggtgactatgatgacccaaaggtttgtgccaacgagtttaaagaatttgtggagaatgcttgaagaaaagttcagttcagccctaaggaattctaaccttgaaatcccagacacactccaggagctgttcgccaggtaccgagttttggcaattggggatgaaaaagatcaaaccaggaaagagtatgaacttaacagcgtggatgacatccactttctgg

SEQ ID NO: 533932 - DNA, 251 bp, Homo sapiens
taacaggctcagatgggagactttcacaaaggcacagatgggacgcttcaagcatggatttgctgcaaggtcaggttgatggcggcctcgacccatgtcgacgttggccagagcgctcatggtggttttattcgccagggaaacgctgtcgttttcagtggactgcacagtgagggcgttctgccgcgcaccgatagagccacgcaccttgtccaggtaggaggccaggcggtcgttgagatcaggcatgt

SEQ ID NO: 533933 - DNA, 941 bp, Homo sapiens
tcttgaagggctataataccaactacgcaaaggcacccaacgttgtaagcacctacgggctactacgacccttcggagacgccataaaattcttcaccaaagagcccctaaaacccgcacatctaccatcagcctctacatcaccgcccgagcttagctctcaccatcgctcttctactatgaacccccctcccccatacccagcccctgggcaactgaaccgaggctcctattgatctagccagctctagaccctaggcaggtccactcaaattccgtctcgatccggtggcagcatgaaaagctgcgaagagtgacgcccctgaatcaggagaactggcgagcagtagcccataactattcttcatatagaagtgcacctcgtactcgcatgcataactcaggtatcaagcatgaactaataagtggattcctttaagccgtctccgaccttatcacagacaacctgaacgactctgatatactcctgccatcaatgaacgcttggcataatacgactacgaccgtccagcaacgtcaggaagagaacgaaagcgcagcccacattagaacattgaccagacgcgggagtccgaaccagaatgaggctacagacatcagaccacgccgagaggcgccatgagccaatcctgcaaaaacgaatacggaaacatgatacaagaacagaccctagcagagagtagtgcctggaagagatatgacgcagcaccagaggtaaaaaccgatggcacgagacctagcgacacacgaggtagaacgaaagcagcccaacgagaaacaaagccagaaagtgacagccgcaaagaaaagtagccaaaacgccccagaatccacaacaacacaagcaaaaaacgcacccgagcacacaccagaacgacccaccacacgccaaacacaacagagacaagccccactccaaa

SEQ ID NO: 533934 - DNA, 1477 bp, Homo sapiens
aacgtcaataagcggagggcggtggtcctcgaccgggaccctcctgtggtccctgggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533935 - DNA, 1412 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 533936 - DNA, 1335 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 533937 - DNA, 374 bp, Homo sapiens
gtactattatctatatcatctgccctggaggcaggtcttaatcttggttgttttctgaatgggatagaccaatacccacaggtataaaatcattatctgctgttaatgatgatatagctactgctgttcctccctccatcccccctgtaattgaaggcaaagtagatagagcaggtacaggcttatatcgcaatgggtacaggctgagtaacagcttgagctttgtcgatttgagtctccatacttggaacattctggtcccaataaaagggctctacgggcccttccgagaattcacttttaggtggctcttgttgagaatcgcttagattctcatatgactgagccgccttgacatcctttacatctgcagc

SEQ ID NO: 533938 - DNA, 393 bp, Homo sapiens
agtttccatggtcctatgggatagccttcagcctctggagacccagagcttgcctgccagggcttggttctccatttccactgctgacatttgatttccagtgtatttaaattactccgtggtaaatttcattgtcttttcctgtgtaaatgttaaatgacaataccatcggtgaaggccctccacagtggacagagcaacttcctttccagcctctgctggtagcatgctgcagcttctgtgttaaaggtcctctggagctcgtgtaagacaggaagaacactttctctgtagtttctttctttccatttataatttacaaaagtaaagcatttcttagtgtctgatttaagaatgtaaagtgattctgtctcaacgtacaatacgatgatc

SEQ ID NO: 533939 - DNA, 1260 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 533940 - DNA, 859 bp, Homo sapiens
agcgaggaagccctggagaaggaccaggagaggttagaatatgaaatccagcagctgaaacagaagatttatgaggtcgatggtgttcaaacaagatcatcatgggaccctggaagggaaggtggcttcttccagcttgccagtcagtgctgaaaaattacacctggttcccctcatggatgccaggatcaatgcttacattgaagaagaagtccaaagacgccttcaggatttgcatcgtgtgattagtgaaggctgcagtacactctgcagacacgatgcaaggataatgagaaacttcacaatggcaccattcaacgtaaactaaacatatgagcggatggctttcctcgctcctttgggcgcaaatccagatgacctgaaggacccaattaacaattagtatcccacgctacgtcctctgcgggcaaggaaacggatgcacacttcgagtccgaggtcaagcttgctgcccttgcaatttcctccaaagaaactatctcggacacatacaggactgaaccgtgtgacttgctgagcagacgaagctcacttacagcaaactacctcagggcacttcttcacgcgtgcatgctccagtccgcaacatctcccctccacatcaaccaaagtgggactgactctctcgaaaccataccatccgtgagtttcacccattcttcaagacaggagtcctcgactacagcagccacgggacgggggcagagccagcggtgatggcggaaccaccaacagcagtgccctcctcgtcgaagcgggctccgatgcagggccagctccccccatgcgaggatccgggtctgcttcctcctgcctgaagacacgacatgcagcagcg

SEQ ID NO: 533941 - DNA, 339 bp, Homo sapiens
cacaccacctgagtcatttttttctcttataggaggagattcctctctagccatgtttctgttaaagcttcatgtgattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatgaccctatcaactgcatctcttcatcatttatgctctcactttagatatccaaatattaaaaggcaggctgacctgtatcacacagaattaaggcagtaattttc

SEQ ID NO: 533942 - DNA, 200 bp, Homo sapiens
aaagttgacacaagttgttgatcgataattacaagacttgtacaacagattcacagcgcctgtaaggagcctttggttggaactggtgacacctgtgacctctccggcacatgaggaaggaagtcccaccccgacatccagcagcagagagcctgtctctggcattccctgttccggtgctcccaccctcattgtggaat

SEQ ID NO: 533943 - DNA, 1028 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 533944 - DNA, 264 bp, Homo sapiens
  misc_feature (76)..(76): n is a, c, g, or t
ctaaggatcctcgttttgatagggctcactaaacattctacactcactctcactgccaagaactatcaactcctgnagcaacaacttaatatgactagcttacacaatagcttttatagtaagatgactctttacggactccacttattgactccctaaatgcccatgtcgaagccccccatcgctgggtcaatagtacttgcgcagtactcttaaaacctaggcggctattgggtataatacgcctcacactcattctcaggc

SEQ ID NO: 533945 - DNA, 284 bp, Homo sapiens
atggcagtgtctctcacccagtctggaatgcaacagcgtggtctcggctcactgcagcttccacctcacaggttcaaggattcttgtgcctcggcctcctgagtagctgggactacgggcatgtgacactatgcctggctaatttttttgttatttttaagtagaggcggggttttgccatgttggcccaggcaggcggatcacttgaggccagaatttgagaccagcctggccaacatggcgaaaccctgtatcactcttttagacccttctgtcgtcttctc

SEQ ID NO: 533946 - DNA, 812 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtcagtgaaattttattcagttgagctggtattataggtttgagagacaatggctttaaagcttactgccataggctaaccatgctcttttacatttttatcagctttgtattggcggcaacattctttctactgcattaaaaaaaaaaaacgacttgttaatatgatatttaaatacagattaataggtgtaaaactttcagtccctccaaaaagtgaatacaaacatgaggatttattattacaaagttctaaactggggtattcatggcatctacagtcattaggagaagttaagttgtatgatgtgat

SEQ ID NO: 533947 - DNA, 907 bp, Homo sapiens
  misc_feature (26)..(26): n is a, c, g, or t
  misc_feature (442)..(442): n is a, c, g, or t
tgataacataacttggttcccgatanggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttcccctcttgtgctcagtcgcccggtgttcttgaggtctcttttctctactccagggttctcaatttattgggggggaaataccttgagcagaatacaatggggaaaagagtctctaccccttttctgtccgaaggttcatttttatcccttcctgtctgaacaaaanctgtttggaatcaacaccaccgagctcgttgtgggaaaaaagaaaaaccgtgttcccttcgctctgcgtggaacgctggagggtgctaggccccgtgtgtagtagtgcatagaaattctagctttttcacctccttctctcgtgtaatatggggcctcagagagtacacgtggtgtctctagtgtgaatatggacagttagctatttaccaacattgtatctgtctacttcctcttgtttaaaaaaaagaaaaaaaaccttaaaaaatgggggttatagaaggtcagcagggggtgggttcgacaatgttggggggggtaacaggggcttttggacaacagggcttccccttgggcatgttaatggctgatattggacagacatccttgcagcttaagatgacctctttaaataaattctctcctaatgatgacttgagcccctgccactcaaggggagaaatca

SEQ ID NO: 533948 - DNA, 270 bp, Homo sapiens
  misc_feature (26)..(26): n is a, c, g, or t
tgataacataacttggttcccgatanggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctccccttcatcatcatcttcatcttcttcaccttcatcctcatctcacttcttcgg

SEQ ID NO: 533949 - DNA, 398 bp, Homo sapiens
  misc_feature (259)..(259): n is a, c, g, or t
ggtctaagaggagacaagtatggcaaatggtcggcgtggtccctgtgtccagtcggagagccagcggactctgtacaagcgtcatgtccagatgactttcgccactggtggaaggcgggccaaagcccagcgaggtgtttctgggaccttcgtccacttggggcacccgtggaggccggtggctggcaacagtcggagttgcgtgctggcgatcgtctaggtatggtagtatgggaatgtccatacggggtagtatccnacttcagagtgcggatatgattacagcgttcttctcgacaatcaatagatgacacgaaatttgcgactagtagctgcaagtcggtttcatcacagtcgccgtagcagtatggggcaagattcatctgttcctcgcgatt

SEQ ID NO: 533950 - DNA, 122 bp, Homo sapiens
tagtcggtccgacttatcaatgccggctgacatgcatcagcgccgctgatcatccaacgccgccgactgcatccaacgccgctaagagggacggcgggggcattcgtattgcgccgctagag

SEQ ID NO: 533951 - DNA, 197 bp, Homo sapiens
taatgataataaaatccttttccctgtacaataaactgtgtatcacttccagatcagtctgacactcaccaacaaaaccaaatacatatcggtatgaggcaacacaactatttttttttttttgagatgtattctcgctacttttgtccagtttgaagtgcagtgttgtagatcttggcttactgcaacctccacct

SEQ ID NO: 533952 - DNA, 318 bp, Homo sapiens
gcacgaaccatggtcagaagcactgcactggccacttgtacacaacaggtaggcaaaacaacatgcatatggaggcaagcaattaacactcagatatactaatgacagtcacatgggtataacaattatgaacagatgaaccatattcataaagaaatacatcagaaagggaagtgtagaaatacacattactatggctggtattgtgtgcatccagctttgtaactgaaatattgtcatgaacagcagtatttttcaaacagtcatttgatgagatggatcgaaaaccgccatgggtcaccattgcatatacagtcg

SEQ ID NO: 533953 - DNA, 120 bp, Homo sapiens
tccagctataatatgcaatatgcacccacactctcctcactgcctccaatccttctctagcaaagaattgttggctatgtgtttccctttacttcctgcatcttacacagcatgtcccca

SEQ ID NO: 533954 - DNA, 184 bp, Homo sapiens
cacgagggctgtttaagtgcgatgagtgtgcaaaattgttcagccgcatagagaggctaaagcagcacgtttcctacatgcacagcaggaacgaggtggacggcgagtacaggtaccgctgcggcacttgtgagaataccttccgcatcgagagcgctctggtgttccacatctgcaggacatg

SEQ ID NO: 533955 - DNA, 316 bp, Homo sapiens
  misc_feature (60)..(60): n is a, c, g, or t
  misc_feature (114)..(114): n is a, c, g, or t
  misc_feature (119)..(119): n is a, c, g, or t
  misc_feature (158)..(159): n is a, c, g, or t
  misc_feature (171)..(171): n is a, c, g, or t
  misc_feature (216)..(216): n is a, c, g, or t
  misc_feature (240)..(240): n is a, c, g, or t
  misc_feature (245)..(246): n is a, c, g, or t
  misc_feature (272)..(272): n is a, c, g, or t
ccaccatggcctctcaaagtactgggattatgggcatgagtcagtgcacccagccacaanttgtatctttaaaaagatagcaagatggccaggtgcggtggctcacgcctatantcccngcactttgggaggccgaggcgggtggatcatgaggtcannagtttgagaccngcctgaccaacatggtgaaacccgtctctactaaaaatacaaaanttagccgggcatggtggcactcgnctgtnntcccagctgctggggaggctgaggcnggagaactgcttgagcccaggaggcagaggctgcagtgagccga

SEQ ID NO: 533956 - DNA, 113 bp, Homo sapiens
tcttttgcggtgctttccactcagctctctactagcacacctggccatagcaacacagccgggtcaaatgccacagcttcctcaccaggctccttgctcctcgtcaaactgcc

SEQ ID NO: 533957 - DNA, 322 bp, Homo sapiens
agcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgt

SEQ ID NO: 533958 - DNA, 986 bp, Homo sapiens
cattatgacggtctggggggcgcggtgagtcgagcattttccgtccgcatgcccctccctgtgagctgaccgatctgctggaccgagtacgtgccgagtttccacagctcgtagttaaagggtagggcggcagtcgattgctctttagagtcagactatcaatgataatctacgcggtcacttcaatgagtcaatgggacaggaggtccagagcggtactcttgatcgactcgcacccatccggtggtgatgcctccgttgaaggccccgagggcgagggtgccgaaagcaacagtaatcactgtgtccgatattgtcatgaaaccatcaacctgcaggaaacaagtttcacaaaaagaagcctacaagaagtacatccaaacgcattaccttggaacatcaactcaacaagggacaccttgaaggaacagagaccagaacacagagtaaaaccctttttatgacaggggcctgcaggaacaaatcaagcacatcctttgctaattttcaaaaaactaccagttctttatggctgaaaaccattgatccagatggcattggttgctctatggaacctaaccgtgacggatggtgtgacccatatatgattcttaaaggatggttaccaactggcacacttgtcacaacttgtgcattatttgtgtctatcacgtgtcatcattaacttggttctggtggtcatccaaacaaaccaggacttaaggacaatgggcactgtgtcatcttgaccctcaatattggcggagtactggcggcgggcatgtctacaaaacacttgctctcgctggtcacactacaggttttaccctgggagaagcttagtagcctttaacacaacgctcgggcctgaagaagccggtgggccaccccaaaccaacgcgcccttggggcaacaccctgtttgtcaagcacacccacgtgcgtccccgggccgaaaacacaacaggcgcgttccctttccgcgt

SEQ ID NO: 533959 - DNA, 304 bp, Homo sapiens
atcagctaccagctctggttaagtcccacaactctgacttataacctcatgttcaaactttttaattttatttattttttgagacggagtctgctctgctgcccaggctgcagtgcagtggcacaatctctgctcaccgcaacaagagcgaaactccgtctcaaaaacataaaataaaataaaataaaaataaagaagaaaggcaaaatagcacagctacaggctgttctgcctataaagtagccaatatttatttctttactttcctaataaacttgctttcactaaaacaaaaacaaaaaca

SEQ ID NO: 533960 - DNA, 458 bp, Homo sapiens
ggcagactcgcctagcatcaaatgcaggaagacttgagttcctttctcaccacaatgttcttctcgcagattctgccggggccacccacagtgtgtggctaaccctgatagctgtcctgtgtcccatcgggagtgtgtattattcctgactcaagggcagggcagagacctactgcctagacctgagcccaggtctgggctgctatctagtacaagcagattgtgagaggcagagagagcacagggcagctagagagagtgctagaggaaaggagggtgagggcatgcttcttctttgataggttttctgaagactggggaaacagcattttggctgtgatctgaccccacagtggtaaatgttttgactccttctgctacatttagaacactgactacttctgtatgtgcacaacggtgttccaggtcctttagacgcactaatttacccctcacag

SEQ ID NO: 533961 - DNA, 649 bp, Homo sapiens
cttgatgtcctgcatataagggagccacataagagaactggtctagcctattagaaggtgagaggccatatggaagagaacagaggttccctgacagccacaccagctggcaggcatgtgagtgaggcatctgggatcttccagcctagtgcatgctccagacaaatacggccacatgagtgagcccaggcaaaacagtaaagagctgcccagccaaccctcagaataatgagaaataatatgttgcagtgttctaagccactagattgtgaggtagcttgttgtacataagcattaacttccactcacatccaaaaattcattgagaggccaagtgcaagaaagaaagtttcaaaaacttcattttttaaggccttagtttgaaggccgtagttgaagataaatgaaattgcttactttttggactgcgtttccctttttcatgagacccagaaacttgcagaggaagaagttccttactctcttgtgcggctgagaattaggaagcaagggagctacaattcattaatgaagcattattcttagtgtttcctggaactgcctttgagttcttgggagtaaataggctttattcatccaaagaattatacaggaaagttgctgaaaatatcactggctttgtttcttg

SEQ ID NO: 533962 - DNA, 234 bp, Homo sapiens
atctcagtgtgacttagagtgatcccccccgactagccctgacaggtggctggagctacacagtaatgctctgacagtgtggctgtgagctcacacagtaatgctctggcagtgtgtgtggagctcacagtaatgctctggcaggtggcggagcgcacacagtaatgctctgacagggggcggagctcacacagtaatgctctgtcgggctagtcgggggggtcctacgctcga

SEQ ID NO: 533963 - DNA, 152 bp, Homo sapiens
ggaggtaccaaggccgtcaccaagtacaccagctccaagtaaacattccaaggggagacaacagctatttagacataatcttttccaacagtcgtcactgctaggacactagtatcatctatgcaaaatataaccaattgaaaatgcagtag

SEQ ID NO: 533964 - DNA, 102 bp, Homo sapiens
atctgcccgcctcagcctcccagagtcctgggattacaggcatgagctatcgcgcccggcctgaacatttttgtcttaagttctaacctgttgtgttctacc

SEQ ID NO: 533965 - DNA, 249 bp, Homo sapiens
aagggtacatgagacacagcgggtagggtggggtgaagggagaaagggaaggagggtaagaaggagaacatcctttatccaacccctgaaaaagccgcaggcaggtagctgattgtccctgagtgggaacctgggtcagatgaagaaaagaaaaaagtagtggcactctcctttttacaatgaaacatgaaattcaaaccttaaagaacaacaataggttctcacaagaaaaaattgtcccaaatttgg

SEQ ID NO: 533966 - DNA, 910 bp, Homo sapiens
  misc_feature (193)..(193): n is a, c, g, or t
atggcaaggccaccgccaattatgcagtgaaccgttatcacgaaaaatactattaccgtctctataccataattgctcacctacataatgctctctgtaacttactaaacattcacatgccaagaagacacataatcgttagttattagtatcttcgttcggaagaccgacagcttctactcgctcctactcnttggcttatatcatctactccgattggatggcaatcctatacaaatgatacagcctttgaatacctacaaggagacaccaataactttccctaatttcataccaccaactaggctaaggcctcccctatggccctttaatcaattcgcaacatgataatatttatcatcatacaacaaaacaacccccgaggtacatactagcttagatactattctcttacctcatgttcaccttacttactatcatgtctcactaagcataacttagtccatatcttccgtgaggctacatcaattcatgtaagtatggactagaacttataggaattagcttggtactaggtaaagaattaccctctttaagcgaggacctccacttatggtctcccgtagaaggcccaatggtacagtatagatccccccacttagccttagtgagttctaggttaagttaaacatctgacacggcaatcttaacatcttattgataacctgaggccggcctgactcgtggtactaatttaccgtcacttcagcaacatctaatttgctttcgaaaacaccctgaatttatataacacaacaataggtccctgaagctcctttcccgttgtaattattggcctatagaggtcgttaattgtaacaaggcgtccattctggctaaagaaaaaacaggacctaaaatcgcccagtggtaaactcatttcgatcag

SEQ ID NO: 533967 - DNA, 773 bp, Homo sapiens
  misc_feature (52)..(52): n is a, c, g, or t
  misc_feature (74)..(74): n is a, c, g, or t
  misc_feature (174)..(174): n is a, c, g, or t
  misc_feature (221)..(221): n is a, c, g, or t
  misc_feature (260)..(260): n is a, c, g, or t
  misc_feature (263)..(263): n is a, c, g, or t
  misc_feature (286)..(288): n is a, c, g, or t
  misc_feature (304)..(304): n is a, c, g, or t
  misc_feature (331)..(331): n is a, c, g, or t
  misc_feature (362)..(362): n is a, c, g, or t
  misc_feature (365)..(365): n is a, c, g, or t
  misc_feature (386)..(386): n is a, c, g, or t
  misc_feature (399)..(399): n is a, c, g, or t
  misc_feature (401)..(401): n is a, c, g, or t
  misc_feature (429)..(429): n is a, c, g, or t
  misc_feature (442)..(442): n is a, c, g, or t
  misc_feature (444)..(444): n is a, c, g, or t
  misc_feature (480)..(480): n is a, c, g, or t
  misc_feature (488)..(488): n is a, c, g, or t
  misc_feature (493)..(493): n is a, c, g, or t
  misc_feature (503)..(503): n is a, c, g, or t
  misc_feature (509)..(509): n is a, c, g, or t
  misc_feature (550)..(550): n is a, c, g, or t
  misc_feature (554)..(554): n is a, c, g, or t
  misc_feature (568)..(568): n is a, c, g, or t
  misc_feature (578)..(578): n is a, c, g, or t
  misc_feature (581)..(581): n is a, c, g, or t
  misc_feature (596)..(596): n is a, c, g, or t
  misc_feature (657)..(657): n is a, c, g, or t
  misc_feature (722)..(722): n is a, c, g, or t
cacgagagaacaaggggggacaaaaaagcaggcgcgggaccgggccggaatncccgggagtccaggcaccatgngccccgcgggcccccccagccacagccgccgccggcgcccccggcggcaggggcggcgacggggggggcaggccggggggagggggcggggccgcgccanccggccgggggcccccgggaagaggggggcagcgagagggaccacanccccagggccggtccccgggaagggcagaggggggagtntgngcgcgaccacgacaacggcacgnnngaagagggcaagaagnttgattcaagcgatgagcgcaacaccntgggggccagcgggggggggggggggcgccncancactggcatggaccgaggccncatgggcaggggngncaacgagcggcgacgcctcattgtgccnccccaccggggcnangggagcagcggcctggcggggcgcattccaccggangccacccnctacntcgagggggngctgcnggagggggggaacaaggaagacaccgggcaggggagcacantgcngcgcccgccccacngcccccgcanggnccaggacggcgacgntgtccgcgaccactacaatggcaccctgctggacggcacctccttcgacaccagcgacagnaagggcggcacttatgacacctacgtcggctctggttggctgatcaagggcatggaccaggggcngctgggcatgtgtcctggagagagaaggaagattatcatccctccattcct

SEQ ID NO: 533968 - DNA, 112 bp, Homo sapiens
cccccccccccccgttttatggggccctgggggcgggggttttttcccttcccccggggggttttggggggggggggggggggtttccaaaaaggttggcccctttttttta

SEQ ID NO: 533969 - DNA, 465 bp, Homo sapiens
  misc_feature (22)..(22): n is a, c, g, or t
  misc_feature (29)..(29): n is a, c, g, or t
  misc_feature (75)..(75): n is a, c, g, or t
tctcttgaggtgggaaattatntcttaangtctaaaaccaataccaaacttccagtccaggaattccatgccaanggggggatttagcccgtttgtccaaaggattgggcacatggaatgtgcagtcacatgtttttaaattaaaataaaatgcttatattttatcactttgtgattccccattttccttggtcttttaatcatttaagagggtgttttctttatacatatatacatgcatacattacctatacatatatactgcatataacatcaaatctgacttcatggtgtttcccgaactcttttttatctctttaataatatatcttcaccccatatttaatgttattttaaattaaaacaaaattaaatattattgcttaaaaagtggtagaatgaagttctgtatctttttctccatctttcttttagaatctaataaatttagtttccatcctggtt

SEQ ID NO: 533970 - DNA, 147 bp, Homo sapiens
gcccagcacaggaaaaaggcagagaacctcttccttttgcaccatagaccatgtcctcagaaccaaagaaattatcttttgagaaaccattgtgcaaaatgaagaaaaaagccagaggtggttaaaaagaacaaaaattttgccccc

SEQ ID NO: 533971 - DNA, 171 bp, Homo sapiens
gggcgatggtcccaaccagtgatccattctcagtgtgttaccaggctcagtgaagatccttgggctttactgtgtctcttgaaatttacacagcgttctcagtctgccgggacacacaaccattgtttggctgctgacgttcaggaactgggaggcaggaaagggtgattg

SEQ ID NO: 533972 - DNA, 816 bp, Homo sapiens
gttctagatcgcgagcgtccgcccttttattttttttttccaagggtaactaactccaaaatcctttatttagtaaaattgtcacatttgatgtcaatggaatacccaaactcaagtgtgctacaaacaagaatgtacagagcatcacagcttctgggcagtgcagctcagtgcaccttgcctctcatctccccgctgaagtggcaagttcaagctttggtttacgcccagggctgcctggaacactagtgcccagcaccatttctgccaccttctgtgcccccagaagcccgcacagggctggtgaagccgtgggttgggtgaacctgggaaagcgcgtggcagctctacaaaattcttcctccgtgcccgtagcatccctccctccacccacttccaaagctgcagggttcccttaaaagttttcttaagaaaacggggcttggggcctgacttgggctggttcaccaggggctgccctgcaacgccatccatcagaggagggagggaaacaccgtgggaaaccttccaagggccctaccccaccacatctgaaccccgtgggcacgcagggaggagcactccaggaaggcgccgggcccacccccgcaggactctggctggcattgggctcaccaaggcctccagacctccgggcaattggggctgtggctcaggttgcccaggtcttggggccccaggtcgggcccctcagcaggagcctgcactcagtcagcctcaggggcctcctcacaggtcgcgagcacaggtcgtcccgagacccgggagctggatattggggatcccggagtcgcc

SEQ ID NO: 533973 - DNA, 643 bp, Homo sapiens
cggcctatgagcccttagtgtgttctgttttttttcttttgaagttgttaaattgtcgtaaatagctcataagacatactgtcttcagccactttgttaagggcaccacgttcagtaacgttaagctggtaaaacacttcataatgctgtgtggccgtcaccccccgtccattctccataggcttcctcagcttgtaaaatggaaactgtagcccacttaaaccacgtaattcccaactcctcccacgcccccgcagccacccactttctgctttctgtctctctggttttgactatttctcagtattctcatataagtggaatcatacacgtgagcttgtctttttgtgactggcttatttcaccttagcataatgtcctcaaggttcatccactgttgtgtcaggtgacacggatttccttcctgtattatacatataatggaatgttccgttacatgtgcgtaccaccacctctgttcctccatcagtgaacaccttggcttgcttcctcttgactattgggagtagtgctaatacagacacgggggtgcaaatatctctttgagactctgcctttaattcctttaccacccagagttttatctttagccaaataacccttaaagttgtttgccctttta

SEQ ID NO: 533974 - DNA, 210 bp, Homo sapiens
gccaccggaagcatttctttctaggaaaggtggagtcggtagtgagaagccggagtgcccctacagacatacaaggagattgttcactgctgtgaggagcaggtcttaactcttgccactgaacagacctatgctgtggagggtgagacaccatcaaccgcctgtcctgctgctctttggccgggtcgtgtgaccagatggcagtttctg

SEQ ID NO: 533975 - DNA, 1126 bp, Homo sapiens
gacgctgaacacggagctcaaggacaacctgaagtgacaccatgtaccaagcgctaccaccagccgggccatgagtgcttgtgaccagcgctgtgcgaccagctgcagcaggagttccacatgctgtggcagcaacaacatcacagagactggctgagacacgtgagctggatccgctcacaggaggccggtggccgtgtgttcccagacagctgctgctcttccggtggtggctctttgtaggacagcgcagaccatgcctaccaacatctacaaggtggagaggcggcttgcatcaccaacgttggagaccttcatccaggagcacctgagggtacattggggcttgtaggcggatcggcaatatgcctgtagtagcaggtctcaagagccatgatctctcacgatgcctgacctagatacaggagatctacaaggctggaggcacatactgaaccctgaccattggcgcccactgcctgcctgcttgccaacaccaaagcttacactgagccttgagacgcaacatgaatgataccaatgaggggaccatggacgcatacacacatgaaatgaaacagcaccaatccccatgatggaccaactacacacgatcaaccctccatgtggggaacacccaaaccctcaggagcgacacgcgctttaacacgcttagacctatattcctgccatcgccgacaaccaaattatggcccccagagcaacagcgtggaatggagttagagacgagcggtgacctttgacacgtagagccagaacaccacatactagagggcacataggcatctggtaggagcagcaaccacatcgtgagacactacagcatcaccgacctcgcgacgaacaccgcactagaacaacaaagaacacagaaacaccattaaaattattctgatacctcacagaccccagaatcattcccatcaacacaatctcgagaaacacaccaactaccagacccccaacaaccttcaacaacaacaatatcatgaatctcccacagcacacaatcaaacatgaccacataacacacgaaacaagacacagaaccaaaataagaacatcccacacctcatactccactcataacatcataatcacattc

SEQ ID NO: 533976 - DNA, 881 bp, Homo sapiens
gactccatctctacaaaaatatttaaaattagctcagcatggtgctgcatgcctgtagtaccagctactcgggaggccgaggcgggaggatgcttgggcccaggaggttgaggctgcagtgagccgtgtgcctaccactacaattccaagcctgggcaacagagcaaagactctgtctccaaaaaaaaaaaaaaaaaattcaagaatagcattattcattagagggtaaaggggcaaaaaaagaggggcaaagggggctcttaaaggggtatttgggatagggccaataaaaaccaggggttcccagggctcaaaatttagttattaacctatttaattttttggccatttatgggaggacctctagggaaggtctctcctccttcctcgagtggttttcccatttttggaagatggacggacaacactatcctctttaagggtttaaacaatagctcctcactctcccttctaaagaataccaaggagactggatttcatggattccacgcacgtgggtctaccaaataatttggagcatcttgtctgtccaaatataagctggtctgcgggtcaggtgttggcacccagaaacggatgtgacccggggcctgagcaatagtggtaaccgttttgcaaagaaaggaagaccgacagggacagacggcggcgggcagacgcggggcaggcacgacgggaggcggcacgacaggcgggagagacacgagcagatggagagcccagaaaagcagagacgccagggcttccaacacaacaaaagtggggcgcgaaataaactgggcccaatagagcgtgcgaccaaggtcaaacggccgtcagtgtgtcgcacagcgcaacaaagactgatcaaaacgggcaca

SEQ ID NO: 533977 - DNA, 155 bp, Homo sapiens
aggaaacatttcagcctggccaacatgctgaaaccccatctctactaaaactactcaggaggctgagacagcagaattgcttgaacctggaaggtggagggttacagtgagcagagatggcagctaggtgacagagcaagctccatcccctaaac

SEQ ID NO: 533978 - DNA, 527 bp, Homo sapiens
gcggcacgaggtgacttcctgggctcaagcaatcctctatctcagcctcccgggtagctgggaccacaggcgcccgccactacgcccggccaattttctgcattttttagtagagacggggtttcaccgttttagccgggatggtctcgatctcctgaccccgtgatccgcccgcctcggcctcccaaagtgctgggattacaggcgtgagtaaatttttgtatttttagtacagatagggtttcaccatgttggccaggctggtctcgaactcctgacctcaagtggtctgcccacctcggcctcccaaagtgctgggattacagatgtgagccaccgttgcccggctcagttgcccatctttattggctaaggagagaagggtgtcctaaggggcgtatgtgttgcaggggatctcccgtgatttggcgctagagtcatctgaattatcctccagaagaagatcttatgtttcgccatcagaggctgggaacagaacgtgatgctctggacagcctattgaccag

SEQ ID NO: 533979 - DNA, 152 bp, Homo sapiens
tttactaacaacaaagtatgcttactttatttacatagtgccacgggtttctctttttactggttttgtccttttaaaaagcttgggcaacagagggagactctgtctcaaaaaaaaatttttttcataaagcttattttaaatctaataag

SEQ ID NO: 533980 - DNA, 281 bp, Homo sapiens
ttttcctggggggtttcgaaaaccctgtttttcagtggccatttgttgtgtcccccagggggttaatgactcaaaatttggggtccttcccctttcagaccccccttttttagtttagaatttgggggacctataaaaaagtcccagaatcccctgaaagggaatggggcaggagacaggggtgttttttcccagtgcagggttgtgtttttgtgtttctgtttttgtgactgtaaatcctgccctgcccccctcccaataaaagctttggtgtataggca

SEQ ID NO: 533981 - DNA, 247 bp, Homo sapiens
atggggggggttaacccccggggcccaccccagggcccctgctttaaaaaaatgggggaaaggggcccccttttccccccccccccccgggtttggggtttggggggggggtttttccccccccacccgggccccccggggacccaaggtttttttttaaaaaaccccctggggcccccccttggcccccatttttttttggggggtttttttttttgtttccccaaaaggttccccctggggggga

SEQ ID NO: 533982 - DNA, 197 bp, Homo sapiens
ataaatatcccacatgtaaataccccatatatattgtattcctttaaaattgtacatagctttgtggcacgcgcctgtgatcctagctacttgggaggctgaggcaggagaatggcttgagcctggggggcagaggttgcagtgagctgagattgcgccattgcactccagcctgggcaacaagagcaaaactccat

SEQ ID NO: 533983 - DNA, 908 bp, Homo sapiens
  misc_feature (4)..(4): n is a, c, g, or t
  misc_feature (63)..(63): n is a, c, g, or t
  misc_feature (70)..(70): n is a, c, g, or t
  misc_feature (93)..(93): n is a, c, g, or t
  misc_feature (107)..(107): n is a, c, g, or t
  misc_feature (125)..(125): n is a, c, g, or t
  misc_feature (161)..(161): n is a, c, g, or t
  misc_feature (179)..(179): n is a, c, g, or t
  misc_feature (198)..(198): n is a, c, g, or t
  misc_feature (215)..(215): n is a, c, g, or t
  misc_feature (227)..(227): n is a, c, g, or t
  misc_feature (234)..(234): n is a, c, g, or t
  misc_feature (259)..(259): n is a, c, g, or t
  misc_feature (295)..(295): n is a, c, g, or t
  misc_feature (304)..(304): n is a, c, g, or t
  misc_feature (308)..(308): n is a, c, g, or t
  misc_feature (324)..(324): n is a, c, g, or t
  misc_feature (330)..(330): n is a, c, g, or t
  misc_feature (423)..(423): n is a, c, g, or t
  misc_feature (519)..(519): n is a, c, g, or t
  misc_feature (537)..(537): n is a, c, g, or t
  misc_feature (553)..(553): n is a, c, g, or t
  misc_feature (648)..(648): n is a, c, g, or t
  misc_feature (731)..(731): n is a, c, g, or t
  misc_feature (733)..(733): n is a, c, g, or t
tttnggaatggccaccctggtgtttgcatattggccccactgttacttttgggggcttcccgntctagcnacaccctcggatggaaagacttnactgcataaagatntcagttctccctaagttnatttataggcttaatggtcaccctaaaaacacccanatatgcttttcgatgganccagataagttcacgctcnagttcttatggaaaaanacacacgctatngctaggnaaaaacagggagagaagagttctgngcagggcctagtcttagccaatatttacacatactntgaagcctntganacttaaacagcatggngctggnacgtaaatagacaaatgaagttaggtggctctttccgaaactctggggaaaaaagtagtaaaaagctaaatgaaatcaatcagaaaaaaaaanaaaaataaaagagccaaagggcctccttggtggtaaaagagggttgcatatcttgcagccagaaggcagagaaagtgaagaccaagtccagaactnaatcctaagaaatgcagnactgcaaagaaattgntgtggtgtggtgtgtgtgtgtttaatttttaaaaagtttttattgagatacaagtcaataccataaagctctcacccttctaaagtgtacaattnagtggtgtgagtatattcataagatttatacttggtgtctattcataagacttatatccagcatattcataactagagccatntnacagatgcattcatcataataattccagacattttcatcaccctaaaaggaaaccctgaaacccattagcagtcattccccattcctccaacccattctctccctaatccctagaaaccaccaatctactgtgtatttcatctattgccaacatttcatataaatggaatcatac

SEQ ID NO: 533984 - DNA, 460 bp, Homo sapiens
gagacgggggtctcaccggtcgccagggagggtctcgatctcctggacctcataatccggccggcctcggcctaccaggagggctggggataacagggcgtgagccaccgcgcccagccgaactttctggtttaaacaactggacaaatggtttactcccataaaaaaagccacaagaatccccatatatgctattcccttaggaggtaagggatacctgaattcccaaggaatatgtccttggtcacttctggctaaggctacaataagtagaacatctgagctggtataatggaatacatttctattgggcatttaaaaaactacgggggagtcttctgtctggtataagcatttactttggaattaaaactgggtatcaagtttattccctaaaacttttacacaaattactatggtcactcgagtcataagattttcttttttaacttatagtgca

SEQ ID NO: 533985 - DNA, 948 bp, Homo sapiens
  misc_feature (4)..(4): n is a, c, g, or t
  misc_feature (63)..(63): n is a, c, g, or t
  misc_feature (70)..(70): n is a, c, g, or t
  misc_feature (93)..(93): n is a, c, g, or t
  misc_feature (107)..(107): n is a, c, g, or t
  misc_feature (125)..(125): n is a, c, g, or t
  misc_feature (161)..(161): n is a, c, g, or t
  misc_feature (179)..(179): n is a, c, g, or t
  misc_feature (198)..(198): n is a, c, g, or t
  misc_feature (215)..(215): n is a, c, g, or t
  misc_feature (227)..(227): n is a, c, g, or t
  misc_feature (234)..(234): n is a, c, g, or t
  misc_feature (259)..(259): n is a, c, g, or t
  misc_feature (295)..(295): n is a, c, g, or t
  misc_feature (304)..(304): n is a, c, g, or t
  misc_feature (308)..(308): n is a, c, g, or t
  misc_feature (324)..(324): n is a, c, g, or t
  misc_feature (330)..(330): n is a, c, g, or t
  misc_feature (423)..(423): n is a, c, g, or t
  misc_feature (519)..(519): n is a, c, g, or t
  misc_feature (537)..(537): n is a, c, g, or t
  misc_feature (553)..(553): n is a, c, g, or t
  misc_feature (573)..(573): n is a, c, g, or t
  misc_feature (575)..(575): n is a, c, g, or t
  misc_feature (590)..(590): n is a, c, g, or t
  misc_feature (688)..(688): n is a, c, g, or t
  misc_feature (771)..(771): n is a, c, g, or t
  misc_feature (773)..(773): n is a, c, g, or t
tttnggaatggccaccctggtgtttgcatattggccccactgttacttttgggggcttcccgntctagcnacaccctcggatggaaagacttnactgcataaagatntcagttctccctaagttnatttataggcttaatggtcaccctaaaaacacccanatatgcttttcgatgganccagataagttcacgctcnagttcttatggaaaaanacacacgctatngctaggnaaaaacagggagagaagagttctgngcagggcctagtcttagccaatatttacacatactntgaagcctntganacttaaacagcatggngctggnacgtaaatagacaaatgaagttaggtggctctttccgaaactctggggaaaaaagtagtaaaaagctaaatgaaatcaatcagaaaaaaaaanaaaaataaaagagccaaagggcctccttggtggtaaaagagggttgcatatcttgcagccagaaggcagagaaagtgaagaccaagtccagaactnaatcctaagaaatgcagnactgcaaagaaattgntgtggtttggggtttggggntntggtttggggtttgngggttgggtgtggtgtgtgtgtgtttaatttttaaaaagtttttattgagatacaagtcaataccataaagctctcacccttctaaagtgtacaattnagtggtgtgagtatattcataagatttatacttggtgtctattcataagacttatatccagcatattcataactagagccatntnacagatgcattcatcataataattccagacattttcatcaccctaaaaggaaaccctgaaacccattagcagtcattccccattcctccaacccattctctccctaatccctagaaaccaccaatctactgtgtatttcatctattgccaacatttcatataaatggaatcatac

SEQ ID NO: 533986 - DNA, 211 bp, Homo sapiens
tagcagtgacagttttagtagtagcacgtgctgttgggacattcgcagtagcctggattgcagacagttctgtgaggcagcctagtttgcatatgaatgctgctgcagcttcccgagacatcacctatgtttcacgctatggatacatagtatagacacagctatgatgtgagcagtgccattagtgtcttagtaccagtcgaaggagctg

SEQ ID NO: 533987 - DNA, 140 bp, Homo sapiens
ccattcccatcgggctgtctgcctgtcgcaattgggaaagcgccgggagcaactgaactcggcaggcgcgtgttcgtgaagcctattgaggcatgggctcgcttttgcttttggtgccgcacgcccgcagttctttgccc

SEQ ID NO: 533988 - DNA, 110 bp, Homo sapiens
ttatgatgagtaggtgatggtttcgataataatagtatgtgggataggtgtgtaggtgtgcgttgtggtaatgaagtgtgctaggtgatttttaatctatagagcgaaag

SEQ ID NO: 533989 - DNA, 287 bp, Homo sapiens
cacgtcgcaaagctcattcacgtcgcaaagctcattcacgtcgcaaagctcattcacgtcccaaagctcattcacgtcgcaaagctcattcacgtcgcaaagctcattcacgtcgcaaagctcattcacgtcgcaaagctcattcacgtcgcaaagctcatttaactttttttttatattttatttttttttttttttttttttcccccccccccaaaggcctctgggcagggggccccccgctgcaaatccaaaaactgggtaaatcttgttcccggggaaaaatg

SEQ ID NO: 533990 - DNA, 217 bp, Homo sapiens
  misc_feature (24)..(24): n is a, c, g, or t
tcggtacctgatagactggcatanttccactcaatccaaaaacaagcatcccagagctgaatatttaggtgaaaatatatcaggaatgggaggcattcaggtttaattttcatgttttggtagagttaggatgtgagttttcatttaaaaatattctttattttttttgctactattgtggtttctgtattgttactatacaatctgtcaatcataa

SEQ ID NO: 533991 - DNA, 350 bp, Homo sapiens
aagcgcagaaggcgcgtccttgtgttctcatcattctgcccccacttatacgtgagaacatgcgttatttggttttctgttcctgcattagttagctgaggataatggcttacagccccattcatgtccctgcaaaggacatgatctcattccttttaattgctgcatattattccatggtgtatatgtaccacattttccttatccagtctaccattgatgggcatttaggttgattccatgcctttgccattgtgaatagtgctttgctactgtgaatagtgctacatacacatatctttataatagaatgatttatattccttggggggacgcgccatcgtgcgctt

SEQ ID NO: 533992 - DNA, 1230 bp, Homo sapiens
tggggttgggaatctcgttcttctctttgggtataaaggggggaaaggacagtgtggagtggcgggttacccccagggtgcaggggaggcatgtgcaggacagccccagacaggcaggcgcgtggaacggccggtggggaaagagtccgtggagttttcccaacaatcctttatctctctgtgcaagggacacaggacaaccgcgtggctagtgcacgagggggtgtgggagaagagaggcaagggccccgtgggagacgggggcgggggaggccacggggcgcgtgggggcactcaccacataccagtggcaacagtcacagttggcgccacagagaacctccaggtgggctcttctgagaaaacgcggaccacaagtgtacaaacaataaccaaagagacaacgggccaaggcgcgcacaccatggcgggaagagggccccggaatcccccataagaggtggggggggctacagaaggcctgtgcgcggggccccccaaaagagaaggtccccccaaaggcagagggaaatacaaagcaaagtgaccacacggcaccggggtggggtcccttccaaaggggaaaccccactgggggcactggggcgagagggagacacgagagtgcgggtcaatccgaaaaggggaacagggcaagcgggaagaagcctcagagaaccagaagaggggcccggcacaagagcaccccaagagccaagcctagaaaaccaaacacccagtggtcgccggagggccccgaggcggacccaaagaaccatatgcggatggtggggccaaatatggagatgatacgggaacaccaagaaggtgatccccagggacatggaaaaaactccggagacaaaccacacactcgaagaggacacccggaagaaccaacggggggtgcacaacagcacaaagggggtcaaaagtggcgcccggaacaaacagtagcttcacacccgggccccaggagagacacgaggcacctgcaaagagagggcagagggcacccgcatataacacacggcacacacgggaacggcatggacccgagtatacgaggcggagtaaaaggcgaacaagaggtgacaagcaccgaaaaagggagtacgacaacaagcgaaaaaagataagatagagatgacccaggagaaagccgagagaaaagacacaaagtagagaagacaaagagaagaaaacgacacatagaacacaggaagagaa

SEQ ID NO: 533993 - DNA, 302 bp, Homo sapiens
ccctacgtaagcccgcagagcacagcacctcaccatggactgaacctgtaggatcctcctcttgatgacataagctacaggctctgactccgaggtccaactgctacagtcatgagctgagttgaacaggcctgggctacatggtctcctgctgggtttctgtatacaccttcaccgactactacatgcgctgaatgcaacgaccccctggcgcatagacgttgcagcgcagagtcactatccgcgctcacgactacagacacagactacatggagctgaccagtctgagatctgaggaccg

SEQ ID NO: 533994 - DNA, 431 bp, Homo sapiens
ataacaaagttattctttttgttaactgcatcatactgcattttgtgaatgtcccccagttgttttcagctggtcccctgttcaaggctacatgtttattagtgaagacttggaactgtactatatttttcttggtatattttggtgtacaatttgtacaatttagttgttgaatatcatcttttttttcccctctgaaatgatagtttagctgggtatacgatttttgggttgtagtccttttgttttgttggtcaatagatattgtgcccacttttatctagctactggtattgcagttgagaattccaaagccaatagtatatttttccctttgataggagaaatcattcgatacaatgagagcatgtaaacatgaggtttagagaaaaaagtaaaactataaaattacttaatcacgtcaagaagaa

SEQ ID NO: 533995 - DNA, 122 bp, Homo sapiens
cattagacacggtactgtgtgaaccttggatttttctcctctgccccgagtcgtcgtctgctttcttttttgggtttcttctagaagattgagatgtgcatatgacaggctgagagcacctc

SEQ ID NO: 533996 - DNA, 205 bp, Homo sapiens
aggggggggggggggtttgccccttttttaaaacccccctttttttccctttggtgccccgcggacttttttttagggggtggcccccggaattgggggtttttgggggggtttttttggggggtgggcctttaatttacccgggggattttttttgttgggtttttaaaggttttttaaaaataaactttttttggccccccga

SEQ ID NO: 533997 - DNA, 509 bp, Homo sapiens
cagagcgctattgtgggacaataaccccccataatcccagcagccacagagccatgtctgtgcatcctcactggtcctgggaggccacagccaccgtttgcagctccagcctcttctggatgtctgtcagcctccgactcctcatcctcagtttctctggcatagtgctctcccagtgacgggcaaggccctgtgtctgcccctgtgcttccgtccagctcctggttctctgagacagatgcctctccctcctcagttccacatcccgcgtcctggtttgtcagcccctccccgcctgcctctgggacttctgatagttcagactctcggtctctttcagcctcagccgccagggtctggcctcccgcagtctcctcctcctcccgttgctcgccatcggctgaatcctcctgagtatttcctctctccatgtccatactcgttgcgtttacccaggctccttgaaagcctcggaggcctcagtttacagaccccgtgtgctgggactg

SEQ ID NO: 533998 - DNA, 462 bp, Homo sapiens
  misc_feature (78)..(78): n is a, c, g, or t
  misc_feature (459)..(459): n is a, c, g, or t
gatgctggcgctttgggccctgccaatgagctaaagcagtgtataattaagggattgcgcaggcttccttccccaggncaaagcagcgcgcataataattgaataaatgtcatcttacagcaataattacctgtggataatagattatattattggaagggcacacacgcttgctgccagccacgttattcttggtgggctgcccacttctgctcagaattgatgagcatcatgccagcgaagaagagcttgagcctaggaacgcaatgatgggcttggtgtcatttggagagaatgatgggctcatctttaccagcactgggcctagtgtctggaacaactaaaagaaaaatgccaatctcttcccagctcacgtaatttaaatggtgcctgtttaaatttcaggccaagtaatctagctgaacatattcctctagcaccagaaagctgaataaaagnaag

SEQ ID NO: 533999 - DNA, 110 bp, Homo sapiens
taatacagcaaataactttgccacaggcagcagcccaaagctcaagcaccccgcaacaccagcagcagctcactcaagcaaccagctcaaacagcagcaccaccacgtct

SEQ ID NO: 534000 - DNA, 915 bp, Homo sapiens
ggccaggcatggtggctcatgcctgtaatcccagtacttagggaggccgaggtgggcggatcacttgaggttaggagttcgagaccagcctggccaacatggtgaaaccctgtctctactaaaaatacaaaaaaaaaaaaaaaaaaaaaaaaaaaaaatgggggggggcccgggccccggaaaagttttcaaaaccatcggtatggggcgccgcgggggccccgagtagggcacgagagacagtggcccaaagcgtggtcttcccatagaaaaccgcggccaagaacaagggcggggattccacaccataaaaaaaggcccggggggcaaccggagcgttctggaaacaactccgaaagggagatcgggaaggccataacgggggactctaaacaaaagggggaggcccaaagggagacgccagagaaaataaaattaacgccccgccgtgtggagacacacacagcgagcggacaacatacacgacgacatccaagcagacaagacaacagccaagagcgaagtcacaccacaatgaccagcaaaaaacgagcaagagcgacaaagagagcaagagggaggaagacgaggagaagaggagggaggcgagagcacggcaggcgaacaccggagacaggcaggaggacggaagaggaacgaggagacgaggagaggagagacaaaagagagaggcgaacagacaggagtccagcaggcgagccagccaaggagaacgggcgacagacagcacagcacgacgcgccacgaccagaacagagcggcagccacagacagggacggagacgacaagcggctaccagcagaggacgagcacaacaacacaggaaagcaaagagccagaggcaagacacaagaaacaagagacacaacgcccaaagcgaaggacacaccgac

SEQ ID NO: 534001 - DNA, 193 bp, Homo sapiens
gacgttgtggtgtcttggccgggcacgatgatctcacacatgtaatcccagcactttgggaggccaaggcaggtggatcaccaggtcaagagttcaagaccagcctggccaaaatggtgaaacctgtctctacaaaaaatacaaaaaaaattggccggcctggtggcagcgacctgtaatcccagctgcgtgg

SEQ ID NO: 534002 - DNA, 174 bp, Homo sapiens
cccgcgtacagttgcggctccagctccggacgtccctgctcctggcttttgcctgttctgcttgcctggtttcaagaggctggtgcggtccaaacctgttcctgctatccaggctttttgaccacgcctatgttccaatgcccaatcgcgcgcacctagttggcctattgacac

SEQ ID NO: 534003 - DNA, 488 bp, Homo sapiens
  misc_feature (18)..(18): n is a, c, g, or t
  misc_feature (46)..(46): n is a, c, g, or t
  misc_feature (64)..(64): n is a, c, g, or t
cctgaaataaattggccntcttgtaaacttaagtgtgtgtaccttncccttttcccaacccccnagatatagtggaagagaatgacccttccttagatggtcaccttcctatgcttttaaaagggtatgcatgaaagctggaaagtctcccaacctgaactgttttaaaaaacaaagatgcccagctgggcacctattgctcctcaccctgtaaatccccaacactttgggaggccgaggaagaaggatcacttgaggccccaggagttcgaaacccagccctggtcaacagagcaagacccctatttgtacaccccaaacaaaaattagcccaggtgtagttgtgtgcacctgtagtcctagctactggggaggcagcggtgggaggatctcttggcaggagttcaaggtttcaatgaaccatgattgcaccaccgccctccagcctgggtaacagcaagactttgtctctaaaaaaatgaaatgaa

SEQ ID NO: 534004 - DNA, 299 bp, Homo sapiens
tccatcccccacgcgtgtgcatccttttttgtgttcatcccttccggtggccatccccattagtacagatggcttgctgacggagaggagggagattgtttgacatagtatgaggaggactccgtaccctactgcttaagggactaatggggatggaccatggttgtaagggtggctaagtacaaccataccagctaaggggacctgggagatgatggcttatttccacccgaccctaggatttccagagcgcacttccacaggcctggacctgggatgattataaacgaagggggatg

SEQ ID NO: 534005 - DNA, 182 bp, Homo sapiens
tttcaaattcctagctcagcaacctcctgccttggcctcccaaagtgtagatattacaggtgtgaaccactgcacctggcctgatagggtgtttctggtgtcaataatgtattaattttctgttgatgccaaaacagattctcacaaacgtttagcagcttgaaacaacacataatggggta

SEQ ID NO: 534006 - DNA, 148 bp, Homo sapiens
ctaggtggaagcgacgtctaggtggatgatgtgtgtgtgtctactaattacaaatggatcactctgcagaagtactgtgaaggcaaacaaaggaattactacaaaaccaaacagacacaacggaggctcagaccctgctgcaaccccc

SEQ ID NO: 534007 - DNA, 530 bp, Homo sapiens
gaattcactagtgattgtgagctgagatcgcacccggcctttttcttttttgagacggagtcttgctcctgttgcctaggctggagtgcagtggcgtggtctcagctcattgcaacttctgcctcctgggtccaagcgattctcctgcttcagcctcctgaatagctgggattacaggagcatgtcacccatgcctggcttatttttgtttttagtagagaaggggtttcaccttgttagccagggtggtctggaactcctgacgtcaggtgatctgcccgtctcagcctcccaaagtgctgggattacaggtgtgagccaacacgcctgaccagataatcaattttcattgacctaatgacttttcctcttttaaaaaaaaaggaaatagggtctaaccctaatgcccaggctgaagtgtagtgtgcaaagccccaaaaagctgggcttaagaatccgcccatctcagactacaggcatttgcacccaatccaggtacatcagcatattcgtaaacgcaaaatgttgct

SEQ ID NO: 534008 - DNA, 525 bp, Homo sapiens
gattggagaagtctcttcctcatctgttcgatatggagatattaaggggcgtattccttcacgcaagcaaatgagctttcaaaggtagtgaaccagcaggttcttggtggcccacttggtccccctcaggtaactataaaagggttttccatgccagattcaattagcagagcctccccgacaatggcccaatgtgtcaaagctgtcccaaagggggccccggcagtaaaggaaccctccatatggtgaaggtttttctagggtcccagttttgccccagataattaatgggcacctgtagggcggggatcctttccaggtttttttttttgtaaaaaaaaataataataatttgaatcaggtaatatttaggggtatactatgcctttttgaaaatgaaattggttatcccctttgcagtttgaaaaacatgtattgggggtaaaggttaaataacaaaactatgcagaggtttttaaaagcattgataacctttgtggggaacataaagggatcctttattta

SEQ ID NO: 534009 - DNA, 157 bp, Homo sapiens
tgtctcagtccggggtgaggatgctgggacacgatgaggacaagactcgcatctccatcaggggggtgcctaggggaacggtgtgccttttttgactgaagaggagcttagtgccgttctacagcagtgctggcgggcggacgtgtccggcatggac

SEQ ID NO: 534010 - DNA, 636 bp, Homo sapiens
gacaatcgaccggaacaatggcaggacaaggctggtgggaatcggacgagggcggaagggcgggagcttgcgtgctgctgggcctgagctgtctgtctcgtttctgtcgcgcgcctgcatccggcccgggcgccgctgaggtcgcgaggagccacagggctgactggtctgctgcccgggccaggagtgctggtgtagcagtcgcggagccatcccgggtctgtgcatgacgatctcccctcagaggagatcttcctcagcggtggctgcagagacagatgagcggggctcctggccgcgggacgtgagacgggtcgtggccggccatttagggggacgctgcgacaccgctgcgcccctccggactggttccttgggccccggaagctcgcgggggccctgcgggaggcggcattgctcccggcggagggcctggcttggccccgccccttgggctttgggccggggggaaccgccggggggcggggggggcccttgctggcgctttctggccaatcagtgccgcttcgtcacgggcctgcgcgtgcggcgcgcgcagcagatcgcgcagtctacggccgctctactccgagagctcacgccgcgtctcctcggcgctctgcgccggtgcacggc

SEQ ID NO: 534011 - DNA, 479 bp, Homo sapiens
  misc_feature (34)..(34): n is a, c, g, or t
  misc_feature (111)..(111): n is a, c, g, or t
  misc_feature (134)..(134): n is a, c, g, or t
  misc_feature (161)..(161): n is a, c, g, or t
  misc_feature (181)..(182): n is a, c, g, or t
  misc_feature (319)..(319): n is a, c, g, or t
  misc_feature (351)..(351): n is a, c, g, or t
  misc_feature (358)..(359): n is a, c, g, or t
gacgctctctctgtggggcgccccaggcaccagngcgtgatggtgggcatgggtcagaaggattcctatgtgggcgacgaggcccagagcaagagaggcatcctcaccctngaagtacccccatcgacgcacgntgcatcgtcacccaactggtgacgaancatggagacaaatcctggcnnaccacaccttctacaagtgagccgtgcgtgtggctccctgagtgagcacccctgtgcgtgctgacctgaggcccctcctgaaccccaagggccaacgcgcgacgaagatgacccagaatcatgtttgagaccttcanacaccccaagcccatgtacgttggctatccanggctgtnngctatccctgtaccgcctctgtgccgtacccactggcatctgtgatggactccgtgtgacggggtcacccacactgtgcccatctacgaggggtatggccccccccaaagagagagcgtt

SEQ ID NO: 534012 - DNA, 258 bp, Homo sapiens
ctgcacacgaagctggcgtgcgctcgatgatgtggtgattttagcggttggtggcacctccacgtcagatgggacgctcaatacctaagggggccacgaagggctcttcattttcctctaaattttcgggctcatttttttctctctgtttggaaggctcctcctcctccgtctggtctgacgggtcgtaatagtcgctaccgtaagtgaaccccacgggatttgtagctcccatcctctgcgtagtggtttactcga

SEQ ID NO: 534013 - DNA, 220 bp, Homo sapiens
ggttctcgaataccgaacgtacacactattttttcatcatcagataccctcttttcttgtgggaaagtcctccctttgtagccttatgggcttctccgtgtgcacagtgtagcttcaatgagtgaagagtcgctacctgttgtccctgtagaggactagtagtcagtccattaatcttatcttcttgccctggtgccaggggaggtagacggctgcagta

SEQ ID NO: 534014 - DNA, 125 bp, Homo sapiens
tctagaggatggttggtgcatgcatgtgaaggacatattttgtatttttaacatctttaatgccacacaaaaataatcatatggaacagccccatcccaagaaactgagtcggtctcagacctag

SEQ ID NO: 534015 - DNA, 201 bp, Homo sapiens
taaggatagtacaaggaaagggtaggctatgtgttttgtcaaggggttgaaaatgaatgtgaagcgtattataccataaccggctaattttaaaaatactggggcaagtactattgacccaacgatgggggcttcgacatgggctttaaggaatcataaatggaatccctaaagaaggatctttactattaaaactattgg

SEQ ID NO: 534016 - DNA, 450 bp, Homo sapiens
  misc_feature (177)..(177): n is a, c, g, or t
  misc_feature (251)..(251): n is a, c, g, or t
  misc_feature (358)..(358): n is a, c, g, or t
  misc_feature (365)..(365): n is a, c, g, or t
  misc_feature (399)..(399): n is a, c, g, or t
  misc_feature (420)..(420): n is a, c, g, or t
  misc_feature (439)..(439): n is a, c, g, or t
ttttgtagacctgggatctcaccatgttgcccaagctagttctgaactcctggcctcaagcagtcctcctgcctcggcctcccaaagtgctgggattacaggcatgaaccaccatgcctgggttgttcttttggtttttttttttttttgagatggagtctcgccccgtcaccaggntagggtgcaatggtgtgatcttggctcactgcaatctctgcctcccaggttcaagccattctcctgcctcagtntcccgagtagctgggattgcaggtgcgcaccaccacatccagctaattttttttatttttagtagagatggggttttggccagggatgggctcaatttcctgacctnatggatnccgccttgccttggccttcccaaagtgctggggntttacaggtttgagccaccgnaacccaggccgtctggggnaacagagcgat

SEQ ID NO: 534017 - DNA, 315 bp, Homo sapiens
ctggggatgactacatgaccatgcagatgagttgtccccgtctgagctacgtggacacctcgccagctgcccctgtaagctatgcttgacatgctgaacaggcatatgctgcagcaggaggtgagcctgcccagggacaccatggcttgcttgctcctcatcctcagcagcctctgcttccccgacttgggcctcaatggtggcagcatgagctgtgctttccactcgtccctgctgcgtggcccacaaggacctgggggccatgagcgccttacaccgggtgaacctacagtcctaaccgcaaccagagtgcca

SEQ ID NO: 534018 - DNA, 781 bp, Homo sapiens
  misc_feature (725)..(725): n is a, c, g, or t
ctggccgatcaaggtttattttgtcaagggtgaggacgcatgcccatgacacagcctcaggaagtcctgatgacctgtgcccaaggtggtcagggcacaacttggttttatacactttagggagacacaagacattaatcaatacagtaagaagtacactggttttgtccaaaaaggtggggagaacttgaagcagggaggggtcttccaggtcacaagtaggtgagagacaaatagttgcattcttttgagtttctaattagcttttacaaaggagccaatcagaatatgcatttacctcagtgagcagagggatgactttgaatagaatgggaagcaggtttgctctgagcagtttccagcttgaattttacttttaacttaaagattttgggggcccaagatattttcctttcacttaacctatacatacctctgatacctacgtgttaataactagacacatgctgaaatgtatcaagcctgatattccccatcttttgtagggtggcgtgatccactgtttattatttatttttggtctcgtttggtttcgttatatccctatatctccactactcccccctctcataccttcttctccttctccattcctctcacgctcaatttctcctttattatttttatccgctttgtttgtctttatctatcatagcaccgatatttttttattctctcctccccccgtctctcgatctctctcntcctctctctctcactgtaatacttttcttttttaaattacaccacttttcacatg

SEQ ID NO: 534019 - DNA, 972 bp, Homo sapiens
ataatcacttgttccttaattagggaccttgtatgaatggctccacgagggttcagctgtctcttacttttaagcagtgaaattgacctggtcccgcgaagaggcgggcagtgacacagtcaagacgagaagaccctatgggagctttgattaatataagtgcacacaggtacctaacaaacccacaggtcctaaacattaccaaacctgcattgcaaatttcggttggggcgactcgagagcagtaacccgaaacctccgagcagatacatgctaagaccttcaccagtcaaagcgaactactatatttcaggttgatccgaataacttgaccaacggaacgaagtttaccctagggatagcagctcaatcctattctagagtccatatcaacaatagggtttaagactcgatgtaggatcaggacatcccgatggtgcaggcgctattagaggttcgtgtgtcaacgattaaagtcctacgtgatctgagttcagaccggagtaatcgaggtcgggatgctatctacttcaaattcctccctgtacgaaaggacaggagaaataaggcctacttcacaaagcgcctgcccccgtaaatgatatcatgctcaagttagtataataccgcacacccacccacgaacaggtttgtaacgatggcagaggccggtaattcgccgtaacttagaacttacggcagaagtcaagtctctattaacagatacccatgggcagctcgtaatcctgatggtccgttgtaattcgcatggaattctaagctacgaagaaacatgggtaataagtgacgcaagcccagttgggcccgtgggtcaagccttggggggaaattttcagagcgtaaaggaattgaaacttaaggcgccattgacatttcttaagcgccgccaaggatctggtgatacagtatatagaaggtgacagggaagaaaggaacggagtcttaagagga

SEQ ID NO: 534020 - DNA, 350 bp, Homo sapiens
taacgcatttcctagcttaggatcaaagtagattgctttagattttgaaagttgaataattttcaaaataattttagtaaggtaagatttccctctacctgttttacccgtaatcataatattagggctagttgtgctggtggatccgtctaaaatttcgttggtaatcaacggattaaaaaagaccaagcgctttgaactatctaatgcgtcctggggtactattggcaactgtttttggtgcaccacgtccaatataaaagccaatgttactaccaacttgctgattgacgcaaacaacaactcacgatacctcactggtcaataattgcaccaatagcggtttcggg

SEQ ID NO: 534021 - DNA, 311 bp, Homo sapiens
catgcagtagctcctctccatcactgcctccctacccgctgattattcttcataacctttacaccatctgacttaaaaaaaaaaaaaaaaggaaaaaaaaatatttaggcatggcttaaaataaagacaaggataaggggcagagagcccaatttgggggaaagagaaagagaggacaaaaaggcaaagcgggcctctccccctctctgcttcacccatgcaacagattaaatataaacaaaaggctacctcttaacagcacaaacaacacggggaaattcttccctgggaggtaatggggcttggggtac

SEQ ID NO: 534022 - DNA, 185 bp, Homo sapiens
agccccctccctgggtttgagcctggggtggtttatgtaaatggggatttttttgggggatttatctttgaagggcccccacttcagaattgcctgggtggggccagtttttcccaccccgaaaaatttttaaacattctccaggtggcccctctcaattaaaggattcttgctgcccccccata

SEQ ID NO: 534023 - DNA, 395 bp, Homo sapiens
aaaaaaaaaaatgaattttaaccccccccccttttagggaaaggggggggggggcttataatggggggttttttttccgggaacccgtttatatgccttcccaaaaaatttggaaatcaggggggggccctttgccccttagccccaaattttttcctttgggggggggttaattaggggggcggtccttaaggaggggggggaaagggagggggttcccccccccccttttgttttcccctcttgggggaaaagcgggccggggttttcccctcccccccccggggggggggggtttgggggggggggcccgcccctgggcaaaaatgggccggggggtttgcccgggggggggggaaaaaaccggggcggggaacctttgccctttcggggca

SEQ ID NO: 534024 - DNA, 712 bp, Homo sapiens
gatcgacgtgggtgagcgcagccactcaggctgatcgtgggtgtggggctgtaggggaaagttgcttaaagctcgtgtgatgatgctggtggatcaggcctgataatcccagctacttttggtgatgtgcctaaaggccaaagtgcagttcaccatgaaggggaccggggaggtacaaagacctggcgctgaaactaatcatgtgagtaacactcctcgagtctgctactaagaagaatacgagaaactatggactaggtcattgagtgatgcagtgccaatgatagatcccaagcgtaattcgcgtgggcggtgaaggcaattgagagagttctgcgttatattccggggaggtcccaggttgcttgttacgcctggagaatcgacgaccgttcctcagcctgggataaccaagagagggaaagctccggtctcgaacatataaataagactaaaatctccaagacagaaaagcgtactacatgaggtttatcaactctgggcactggtgcattcattagaattcacatcgaacaagaaaggatgatcctgggtggagcttcataaatgttttcccccatccctttgaggtggagtcctcgatgacaaccttagtgttccagcgtcatggaggtgacctgggcgagtacaatacgttggccgcagcccggaatgtccattttaagccttgccctagagggtcctgtgccct

SEQ ID NO: 534025 - DNA, 938 bp, Homo sapiens
gggcagcgaacaacacgccgatggggattattcggtctcttctcggggtcgttcgaagttttctgacaatattggcgcctctctcatcaatttgtgtttggaatgtatgtccctgcacatgctataactacggcgacgcttcccataatggcgagccgtgtcctcgaactccgaggccctttcgggggccccccacggcgttggatccagcgcacgtacctcttggctggccaagggataccggctcttggccgtgtggacttcatttccgggccccgtcactgccattctgagggttttgaatcgtcgccggctgtcttattattgcgcggccacctttttgctcctggagggcaaccaacccacgtgctagaaactggggggagacaacccgcgggggcgcacagcagtttcccccaccccgccggggggtagagaaggcccatgttgccacgctactcatgcgccgggagagccaacaaactcttctgggcctaagaattggggccttacccccccccggttctatggttaaaggagtttcctgtttcccccctgggtgacgccccgcgttgtgtcaccggattgtgccgcagatctgaattggggaatcctctctttgatcaccacatttcttttcgtcttccgtcctttattcaagaaatatgtgttcacccctctctcttaagaaatgaaatcttgtactaaaaagtgaagaaggacccaaccttcttttccgccccccctagagaagttttcactctcctcagagatttgctgcgccctcatgtgtttcccggcagtcaatttctcaaacacgccacagcactcgtctattatccaaaaacgtccacgctcccattcaattaaagcgtaccctgggatactataaaaatagaagtcaccacttcgcaaaaaggcaccacgaccacaaaacg

SEQ ID NO: 534026 - DNA, 112 bp, Homo sapiens
cgcacgtgtctggacgtgcagcagaagaccgaccggctggctagaggtgaagctgcgattcaaggactgcctgggcgagaaggcacaggaggagaagcggctcagtctggcg

SEQ ID NO: 534027 - DNA, 124 bp, Homo sapiens
tatatagctggtacccgtagttttttggagcagtgtctctctcactctgtgcaggctggagtgcagtgatgcaaacacagctcaccacatcctagacatccccagctcaagcgatcctcccacg

SEQ ID NO: 534028 - DNA, 806 bp, Homo sapiens
  misc_feature (467)..(467): n is a, c, g, or t
  misc_feature (781)..(781): n is a, c, g, or t
gaggttcatcccgtggtcaatcacccgaggtcctactcgtctgtgcaggctacaccgagtattcagctcgtcgctatcgcgaacttgtgcagatgccggggtgcccaaagtgggcctggactccggttccgctgctgcgtgtgtgcactctgcgctcgttctggctttgttgcttcctaccgcgttgaacgagttggcctccggcgtgttcgcgggcagttgggtcggtgtgtctacgtggcctcatagagtggggacccgcgttgcggtcgccgggacaatcccggggcatggtcgcctgtgtacttccctcaggctccttgcattgtgggcccgttcgtagaccaggtgggtagttggtgtcgtgcacctcgcttctcccttccccagtcaggctcgtgccgttcaggggggtgatgcagtgagacgccagcttgccaggtagaacctacatagtatactacacntttgctcgggcgtgctcgtgtccacttcgggagctatatcgcgtgttgacctgcgttgaatactcgtcgatgtcgacgggggagcaacaccccacagtccttgttcgtgcgcttgttcaccctgaggaggcttggggaacacggcctgtgggccttgtacaccagacagcgcgaagggaaagtgttagggagtcctacaaataaggcaagggacgatcctcgggcatatccacccgaatgaatccagttcctttgggggaagcgcggtcgccacggtaaatgtggcatggagtgcacctaccgagaggcgagtncatggcgttagttgagggttaccct

SEQ ID NO: 534029 - DNA, 157 bp, Homo sapiens
  misc_feature (101)..(101): n is a, c, g, or t
gcatcccccctgtcagctcacctaggctcctatttattctagccacctctagcctagctgtttactcaactcctctgatcagtgatgagcatcaaactcanaactacgccctgcatcagcagggatgcacaacacccggtaaggttaccgagtctcg

SEQ ID NO: 534030 - DNA, 768 bp, Homo sapiens
aagaagcccttagcctaatgaagcgataagatttatcagcaagactgttgaacgcataactgcccaagatgctgtctccctccagacccgcgcccgacgttgcctggcatacgaaactacctgaatagacagagcagctggaaaatgtctccttctgatatcacagtgcgaactagaaacggcacaatgacgaagtgccatatggacaactaaggactggtgctgagcggggtggtggtggtggagggggatggggaggaggtggggcggcgcggggacagtcggagggggcggactccagtctgggaggattgtccaggctgaatgacgaaactgagatacacggcaacagggcatactgatctggaggaagccgacaccattgtgacaccggaggaagatacacatctggagacctatacacccccaagtggaccagcgaggtgaccaggacttctacagcgcacagaagtggccacacagagcctcaagaggaaccgaatgccgcccccaaggccgagagggctcaaagcctgaaagcatgcatcctacagtactagtcaccaagacccagtcagtcaggttgcagagccggggtcacaccatgcacgagccatgaagccagagccgctgcaaacctacccttcatagaaaccgagaaggaagagacgaagaacacaaagaaacaagacacaagaaatacaccacgaaacagcagagaccaaagactgacaaagaccacacacgcgacagacacgaagcagtgag

SEQ ID NO: 534031 - DNA, 228 bp, Homo sapiens
aaaataaaagccagggctgttgttttggggcccttcaaggcaaaaaaccaggctgattggaaaatggaaacccccaggaaggaagcggcccctgatggtgattttggccctttccatgttttctacaaaaagctgtggtgattggccctgtggtttatcaggcgaaaaccccaaattccccttttagttagtaaaggggacttaataaaaaaggaaaaaactcttcca

SEQ ID NO: 534032 - DNA, 176 bp, Homo sapiens
acagccacagttgcagtagtgagtagcatcttcttgggtcagggggatgggggaggcagaataatcttaaaaaatcccctctgcttttctcccttttagaagttatctctctctctctctctctctctctctctctctctctctctctctctatatatatatatatatatatatat

SEQ ID NO: 534033 - DNA, 198 bp, Homo sapiens
atattctcatcgtttcagtctaaaaacagtcagctattttattagtgtttttgtagaccattaaaatttttcttgcaggctgggcatgatggctcacacctgtaactgcagcacttggggaggccaaggagggaagacggcttgaggccaggagttcaagaccagcctgggcaacacagtgaaaccctgtctctacgg

SEQ ID NO: 534034 - DNA, 173 bp, Homo sapiens
gacaaataacccaagtagcattcaaatacctaattatttgcttgaacagcacatgaaggccaactatggaactcagtggctccaccagagagaagtctggactagcgtgctcacggtgcgcgtgtcctagagccattcagtaggctgcagccctgtagaaaacagcgcattca

SEQ ID NO: 534035 - DNA, 361 bp, Homo sapiens
  misc_feature (1)..(1): n is a, c, g, or t
  misc_feature (32)..(32): n is a, c, g, or t
  misc_feature (53)..(54): n is a, c, g, or t
  misc_feature (56)..(56): n is a, c, g, or t
  misc_feature (204)..(204): n is a, c, g, or t
  misc_feature (238)..(238): n is a, c, g, or t
  misc_feature (319)..(319): n is a, c, g, or t
  misc_feature (348)..(349): n is a, c, g, or t
ngcacgagaagctgaggcacgcagagagcgtnggcgacaggcgagcgtgtganncnagccgcgagaagcacgccctgctggaggggggaccaaggagctgggctacacggtgaagaagcatctgcaggacctgtccggcagactctccagagctcggcacaacgaactctgaaggcattggggagcccagcccggcagaaaganggccagcgtgaaggacctgggctcttggcagtgnaatttccgtggacagcccgccgtcaggttggctggggctggcaccgggtgtcgaggcaaggaaggatttgtttcttgggtnactgcaagccgctgcccgtcgcgacacannggctttggtggt

SEQ ID NO: 534036 - DNA, 171 bp, Homo sapiens
gcaggtggcgtggtattcacttaaaccctttaaccagttgctacgctcctaccttcttcccgcagaagaaaaaccccattaaccccagaaagctcgggtttgcctggtgctggaactttttgtttatttgtatttatttgcattgtgtttggctgtcttggcagtgggggc

SEQ ID NO: 534037 - DNA, 306 bp, Homo sapiens
  misc_feature (149)..(149): n is a, c, g, or t
tgttttcaagattttttgtttgggctgagcgtggtggctcatgcctgttatctcagcaccttaagaggccaaggcaggtgcatcacttgaggtcaggagttcaagccaccgcgcctggtctatttttactttaaaaatctcaatttggntttcctttttcttttttttttttttttggagagggggcttccctttgtcccccgggcggggccaggaaaaccatttaaccctgtgggccaaagcctccagtggcccaagtttcccccattcccctttacccggggggaaaagggcgaacctcttttt

SEQ ID NO: 534038 - DNA, 615 bp, Homo sapiens
  misc_feature (226)..(226): n is a, c, g, or t
  misc_feature (355)..(355): n is a, c, g, or t
  misc_feature (386)..(386): n is a, c, g, or t
  misc_feature (470)..(470): n is a, c, g, or t
  misc_feature (547)..(547): n is a, c, g, or t
gcttcccacacaagaggcctcatttcttatatcccaagtcccgcttggtccgcagcctcatgtctccctcccactatgggcctccgagcttccacaacatgttccagcctttctttgagatgatccaccaggctcaacaggccatggatgtccagctccacagcccagccttccagttcccagacgtggatttcttaagagaaggtgaagatgaccgcactgtgtnaatggagatccgccgcaactccacaggatgcctgaagatgaagggccagtgtgaaaaagtgccaaggagatcttgtctgtggactgttcaaccaacaatcctgcccaggctaacctgcgccaggagctngaacgactcgctccaggtggccgagacgtgnaacaagagcagtacaaggagcttgctgcagtccttccagtcgaagatgctcaacacctcatccctgctggagcagctgaacgancagttcaactgggtgttccagctggctaacctcacacagggcgaagacaagtactaccttcgggtctccaccgtgancaccattcctctgactcagaggtccctcccgtgttactgaagtggtggtgaagtgtttgatctgaccc

SEQ ID NO: 534039 - DNA, 135 bp, Homo sapiens
cccacgactcgatcgccctcccatccctacgcatcttaacataacagacgagtcgtgggcaagaaacgtcgtgggcaagaaacgagtcgtgggcagaaacgagtcgtgggcaagaaacgagtcgtgggcaagaaa

SEQ ID NO: 534040 - DNA, 1052 bp, Homo sapiens
tgtccctcaggtgggacccgaccgacttgagatactcaccacaatgtcatgccacatagatctttgccaagttggagaaaatcacccagatgattttgatcctgacatggaggatgggaacgaccatacaagggttatatttgcctggagtactggcgtgccccagcccaagctgtggatgcggctgaagaatccgccgagcggctacagagcttgacgagcaacacacattccgggtcaccctctttacggatttcgacaaggtatatgacgatcagtgacgagtgggatattccagagaagcaggctttcaaagacctggggaacattacgttactggcttgaagaggcagaactgcagagatcagtcacagtcgtgaatttgcgagagtgggagaccgcaacttgccatactagctggaatgcactgtaccaacgacccctgtcctcaaaattgagtgaaaccagacacgagatggacatgacgacgataatgtgcagttggggcttcctatatgaggcgatcctaaccttgggccttagcctgttcatctatacatgcggggccatcgcgtctaactgcgcgcgtgccagaagacaccacaccccatcgcgacttcagcagatttccgcacaccaaacgggcgttccaaactcaccaggaccttcaacacccgttgctctaaacccgcgtccccttgccttgaaccgtcaagacacgccctgggaggggcagcgacgagatggaaacccacaggccccaatcaacgcacactgacgagcctcccttccccggcgcagcccaaccaggtcagggatcctcccacggagcccacgaccccaacccaccggcggctattgcgcacaagtcggacagcaacgcacggccaacaccttgcgcaacatgacccccggcaacccttcgccatctacagacacaccgccaaatgcgaacatgcggcccaccaacaactcggagcaccgtgggacaaagacaccctgcgcctccgcggcatcaccacgccctccgcgcgcgcgacaacaaccaccac

SEQ ID NO: 534041 - DNA, 738 bp, Homo sapiens
  misc_feature (23)..(23): n is a, c, g, or t
  misc_feature (210)..(210): n is a, c, g, or t
  misc_feature (216)..(216): n is a, c, g, or t
  misc_feature (339)..(339): n is a, c, g, or t
  misc_feature (471)..(471): n is a, c, g, or t
gtttttattaaaactatgctttngcttgcctaaatcttttgatcttatatttctctcatctcagagcctgtcctgagttgtaaggtatttcatactgtcttacttaaaagttttttaaactactagagtcatttgatacacacagaagttacctaataatccaaagatgtccatcaagggaggaagggtgggtcatcagactttgccttngatgtngtagactaggctcctgagttaagcagcagagggacagaagtgccatgtgccttcactgtgtcccaggaaatctgggttggttccagtgggaaataccagtgtttcttggttctggaaagtagnacaagagtaggagatgggggaaatagggatggggagagcaagccccgcatgtccatggggagtcaggtggggagcacgggtgggaagggcccgcttgttggcagacagactaagctgtgtggggttcttcgncgccctccctggggtacagaggttggagaaaactgcaggcccacccctcccctctgtttggtcaggggaaagccaaaggccaccccaggtcttctgattgggaagttgaaggaatcagcagagtcccgatggctgatcaaccccaaaattaatttaagcccgccctcccaccaaatgcctctaatctctctgcctaatagaaggggcagcggggttgctcccgccctttcaatcccagccggcccccctattcacccagagggcccc

SEQ ID NO: 534042 - DNA, 177 bp, Homo sapiens
  misc_feature (57)..(57): n is a, c, g, or t
gtgctgcggtgatctcgcaggctccccgcggggcaccatccattggtggctgttccnttggctgtccctccagcttttccacttccaggtccatcctcattggttccactttggctcaggtggcctcagccaacacagtgcatggttccccggcgtgggtcaccgcagctcgcacat

SEQ ID NO: 534043 - DNA, 92 bp, Homo sapiens
cttgtggagtcggatcacgtacctgtgcagaaaccgcctctgtggctgctgctgggtcgggttttatttcaaatgcagccacagaggcggcc

SEQ ID NO: 534044 - DNA, 203 bp, Homo sapiens
tggaacgggcagaactcatacttgtacgtggactccaccaggctgaagcacttgcccgagagtcggaaaagatgcacgggtccagacacgggtgaaggatccctctttggctgggggcgactggcctggggccagaacgggttgtccacccaaacgcgttgggctcctccaccaccttcatcttcgctggcctacagcacatg

SEQ ID NO: 534045 - DNA, 217 bp, Homo sapiens
  misc_feature (145)..(145): n is a, c, g, or t
gtatagaggatcctgagtatgctgacaggtgcgcgatctgttggggggggtccttcagagaccaaggcggtggatcgggcggagtgccaggttcaagtgcagttgtggtcgggtcattttggaggtggtttcctccaatcatgantgggtctcgaagaggacgggggtaggaaatcctccaggatcttatttctttcaaacaaacaggggggggggg

SEQ ID NO: 534046 - DNA, 855 bp, Homo sapiens
  misc_feature (632)..(632): n is a, c, g, or t
agcggagtcgtacttgcgccgagagtcgtcagggtttgctggttcaactgtgcttaggacggaacccggtgctcgttgcctgacccggtgggtcgacctagacagccctccgtctcaccacatttaccgcactcatcggactgccaactggggactcgcgggcttgatcgctccaacaggcagatggagcacactcggtcgtgcagactctcggtgtcgtcagtatatctccgccagacaatgaacagattgagcggtacactggtctgtcaaggtgcgtacataatgtgattggtaagtgactcaaaggcacgttcctctgaacctgtctgatcaatgatgggagctcaaagctgtccatacgatagaaccatgtgacagagatgattaatctagaataagacactgtcgcagtgatggttggactatatgagacgtagagcatatttgggcataatatatcatgttgttgacacaaatcttcagtgcagtgatgacgtgagaaacatgcttggagacaagaatgattgaacaggatgtgaagaaaccattgagatggatggtgacgtacagtggtatacttgcatgtatgattcgaggaaataggctgaatgtgaggattgaattagagngagtagtcggtgagcatagatagtagtcgattagggaagatagttggcaaatgaaccatttgtttggcaagcaaatagattggtttgaaattctatttctgcttaacctaggaatatcgttgttactaatagctgtgttcactttgtgctataagataatgcattcactcctagttaagtaggtgaatttcactctgagtagtccaatataacctggtaatgg

SEQ ID NO: 534047 - DNA, 761 bp, Homo sapiens
  misc_feature (419)..(419): n is a, c, g, or t
  misc_feature (526)..(526): n is a, c, g, or t
  misc_feature (533)..(533): n is a, c, g, or t
  misc_feature (538)..(538): n is a, c, g, or t
  misc_feature (586)..(586): n is a, c, g, or t
  misc_feature (589)..(589): n is a, c, g, or t
  misc_feature (635)..(635): n is a, c, g, or t
  misc_feature (637)..(637): n is a, c, g, or t
  misc_feature (671)..(671): n is a, c, g, or t
  misc_feature (736)..(736): n is a, c, g, or t
gcacgaggttccttcaccccgcgtgtcgccagcctctgagtacagccagagcccctggcttctccgccacccacacccttcccaccctgctgcggggccctgcctttgtggcgagcagccagccctctgcccctgcccagggctccccaactataggcctgtgacccccgcccagcttgtggggctgctcgtacgagtgtagacactgcgcccattgtacgtgctgataactactatctacatttcccactaccgctctctgactgtcggagtatatttacatctactattctttatattatcgaaggctgagttatggatgcttaggttaagatgctctcgagcgttgagcaggcacagctctgtcgaggtccctggtcaccacctgtaggtctggcctctgaggtcgtggactactngattccaccccagagtactgcagccaagtcatgagtgatgagcagctgggccatagctgcctatgcctgagagtccctgtctggataagtcactggacctggatggntctcagngtccnctgactcctgctgcatctgcacgtggatatcatgatcatgcacgagcncanactggtaccagtagtggcataccttaccagcacaggtgtcctgccnangacagtcagagcagtgcatctgcataggataggngacctgaccaatcttgtgaagagccagtgctgtccagacaggcagctacatgctgcagaactgantgacgcttgccaccgagctgactgc

SEQ ID NO: 534048 - DNA, 2072 bp, Homo sapiens
  misc_feature (148)..(148): n is a, c, g, or t
  misc_feature (362)..(362): n is a, c, g, or t
  misc_feature (365)..(365): n is a, c, g, or t
  misc_feature (411)..(411): n is a, c, g, or t
taaggggatccaacgacaatgccacatcggtgatgctatatgctcggagagaagaaggcacaaggacaacttgtggttccaccctgcagggaagatgacacgtgctccaatgcacacacatcacagagtagtggtctgttcaatcgcncgaggtggcgagaatggtgaaagccataaaccagcagacgggagccttcgtagagatctccccgcagctgccacccaacgggaccccaacttcaagttgttcatcatccggggttcaccccagcagattgaccacgccaagcagcttatcgaggaaaagatcgagggtcctctctgcccagttggaccaggcccagtgtgcctcagccctgctngcncaatgggcccttcaatcctgggcccttcaaccaggggccacccggnctcccccacatgccgggggccccctcctcaccagtacccaccccagggctggggcaatacctacccccagtggcagccgcctgctcctcatgacccaagcaaagcagctgcagcggccgcggaccccaacgccgacgtgggccgcctactactcacactactaccagcagcccccgggccccgtccccgggccaccacaccacggcgccctgccgccacccaccggactccaagcgccagccagtcccccacccggctcgcggtagatgccaccgcaccagccagagcactacgacccatcgcgccccgcgccaccgcacactagcctcagcccccgcaacgtccaacacgcggccaccccctgcagcacaaccccgcggacccccccgcagcatcctcagcagcaccccaccccagccccccgagcccatcgcccgagcacccaacacaccatcacccccccggcccacaggaccctgagcccccccgcgcaccgccaccaaacaccacacgcaccaagcccaacctcgcgcgaccgcaacacaaccacacccccgaagccgccccaccaccccccaccacgacaccacacgcagacaagagccgggcacccccactcagaacgccacgggcacacagcagacgacaaccagtcacaaagcaccaacaagcgcaaccgcgcgaccccacccccacccagaggacgccaacgcaaaggcacacgaaaacactaagggcccccaaacccaccccctctcccaccaccccggcacacacacattcacaacatacaccacaccacaccccacccttgacaacacaccatcatcacccacacacgaataccctcaactacaaccaaccaacaaccccaaataccaccataagatacccacactacaacttcacctgtgcccactctacacaacccctagacatcccataccacacacaaaacccacacaaaagcttaatcaacagcccagcgatgtaaacagcccttcgcgcaaacggcacctgaaccctacgtcacagacgagaaagaatggcacaccattagccccaatggcaacacgacacagcgcgccgcgccccacccgtctcgcgcatgggcggaacagtcagaccgcagaagagtgacagatcaggataacaccgacaggacgcgacgagcctacgtccccgcgaatacccgccccacagatcaacgagggacgaaccaagcagagagagaaacgcgacagcacggaaactcccggcacacatgtagagaacagccgtccccgcaccccgacagccacgcactatacatcacgccgacggctgatagaacgacagcagagggcgcacacagtgcccgaagcccggtggggcaagaacagacgcggcggcacattggagccgactagtgcaccagcagacaccgacgacagtggcgtggtgcaccccctcccccatgacattactggacatccacacaaccctgagcacttgacagagcggagcaccgtgcccgactgaccgacggccaccgctacatcgctaccccaatgacacacagtcacgcgcaggcaaacagcacacctcccgcgagacaacaacgggcacggcgcctgtcgacaagcgaaacagaagcacagaccgacaagcaagagagcaca

SEQ ID NO: 534049 - DNA, 179 bp, Homo sapiens
gttgaaatatgtcgagatgacaatatgcggttttgccccttttacgactgctgctgcatccatgatcaacttgttcctttggccactgctgtggctgaattaggcttgaaggatacacaagaatgcaaacactaatttttaataacggatgggtaccgatgctcgtaattctgtaatcg

SEQ ID NO: 534050 - DNA, 103 bp, Homo sapiens
ctttggatctactgtacagtatataatctatatttgatgtactttcatatttaatgtacctaatgtaatatatatttgatgtaatttcatattttatgtacag

SEQ ID NO: 534051 - DNA, 641 bp, Homo sapiens
  misc_feature (148)..(148): n is a, c, g, or t
  misc_feature (362)..(362): n is a, c, g, or t
  misc_feature (365)..(365): n is a, c, g, or t
  misc_feature (411)..(411): n is a, c, g, or t
taaggggatccaacgacaatgccacatcggtgatgctatatgctcggagagaagaaggcacaaggacaacttgtggttccaccctgcagggaagatgacacgtgctccaatgcacacacatcacagagtagtggtctgttcaatcgcncgaggtggcgagaatggtgaaagccataaaccagcagacgggagccttcgtagagatctccccgcagctgccacccaacgggaccccaacttcaagttgttcatcatccggggttcaccccagcagattgaccacgccaagcagcttatcgaggaaaagatcgagggtcctctctgcccagttggaccaggcccagtgtgcctcagccctgctngcncaatgggcccttcaatcctgggcccttcaaccaggggccacccggnctcccccacatgccgggggccccctcctcaccagtacccaccccagggctggggcaatacctacccccagtggcagccgcctgctcctcatgacccaagcaaagcagctgcagcggccgctctagatatcactcgaggctaagctaggctaccacagcctttctggctataaagctcgtggctcatagcgatctcaattccctcctgcttgttctcgtttgtgtgttgtc

SEQ ID NO: 534052 - DNA, 1501 bp, Homo sapiens
tacagacattagagaggagctcaccatgtgcactattggcaccagttacgcacatcgctaggaccagcttcatcagtctcttggtattggtgactccatgctgtgcgattctccattgcatggtccgtccatggctgtggtgaagactcgtgcatagggcgaagggcgtgtatgcacaaatgagctccggacctaaagttattactagtcctcggtcaaggcgcccctgcaacattgacgtacaaacgaatgctatggttgggtaggagagattgaaacctgctcgtcttcgatagccagcactatacgttatctatttcgaaaagcagcagggcgcagacgtagagctacaggccaaccgctcgtgctcgcgtggagtcattgttcgttttgggattaggaaacggtttggactagccctctatcaatggttccctttcggaatagacactctagcagcgcagatggagcaccgtggcgcccaacagagttcgtcccctgtcaccaatgtcgctgtggaaaagtccaagccttcacgatcttacaaggagaccaatgcggcacatgggctcgctggtgccacaggacatacaagacctaagttgccacgcggtatggtgtgtcactctatatggcccaaactctgagccttaaaaagcgaagaagcactcccaagtattgtaattcccaattttggtacgctcctgttgtgacccaccgtgttacacgcttgtcccggggctaccaccggtggtggtgcgccggttgcaatgggcgaagcgaagagcaaacccagcggttgtgccttttgtggaatggggggcgggctttgtcaactctcggggagcccccccctcctgagacaaaggaactttccgtgtacggcgttttggggcggccggaggtacacttcttagggggaaaattaccttgaagtttgcaattcttcacgagcagcagttgcagcgtgctgttggtgaccctccaaaatgaggccacaagccgcgattccgttgcgataacgtagtctcatgggaaacttggtctccataggaggtctcagatgggggaaaaagggttgtccacccaagtttttggtctctgttggggagttggtaataccccttttcctcacggttctttgtagtgtgccactagtggtccattaccttacagcaggggggttctcgtcccacgagaagttccttctaggtctatggggctttgtgtagggggcctaccctgacacgcaaacggttccctattcttctacttccatggcctggccccacaattgtaaaggcaaacgaagccggaatggagaattgggcgcccacattcgcaatgcctagcgtaccgagctaaacgcttgttgtcacaacatgtggtactgcagacatacacagtgggtttgtgaaaaagcgcgctccccaacacatggggttatacttgggatcccagttccataggggtccgagttttgtgtgcgaaaacgcaatag

SEQ ID NO: 534053 - DNA, 469 bp, Homo sapiens
tggaaacaaagttatgttctggtggcccagccgggagggcaaaagcgctatctcggctcacggcaacctcggcctccggggttcaagcgattctccattctccggcctcagcctcccaagtagcggggaatacgggcaccgggctaggggcttatggtatactcgttggccctttttctgaattaggaaaaatgatctaatctttaaactacggtatgatgcatgcttttctctatggccatggtttaatactattctccattcagttccttggcaacctttggctactttcaacattggttgggctctcattatgtcagtccgggagaaaatgacttgggttctttggaaacagggaagtatgtaatatgatacattcgggggggtttttcccccagaagaaatagatagccaaggggcttaatttggacattcaagctgatactcagaagacaagtttgtctgtggg

SEQ ID NO: 534054 - DNA, 100 bp, Homo sapiens
gtttataatctagtttgtagagataatatacgtacaatacccaaagagataacagattatctgaagcatgtactcattgttcagaatgttcccatctgta

SEQ ID NO: 534055 - DNA, 1050 bp, Homo sapiens
aactaaaggagtgattcatgctgtctgctatacagcaagagacatggtgtcagtgaggaatcggacggtgaaggatggatagcaaggaaagctgcattaataactggccgtcgtttacatgctcgaagaagagggacagtagaaatcattggagtagtataacccttaaggaacgatgtgatgtcagataggccttgaaagatcatctctgtatgaagaggatgacgaaggagtaatgactgattctagaaagcgatatcccacacgtgcacagaggttagaaaacaggcatctttgagttgaacactagattaattagggaaggttgaagttactgttggtaagatctgatgagagagcctagaatgtccttttaaattcacaagcagtttggggggcatggcttgggaagttatgtggttagtgttttaaagaagcttagttaacatggtggtgacatacaggtaaaattgtagaaaggtctgtcaataggatggaactagagtatactggttctcagctaagggtgactttatgcaatcttggggacacattaaagttgtcacaactgggaccagagagagatgagatacagcctattggcatctagtgccataagaaagctacgaatgctgctgaacatcttatacatacaaagggacagttcccacaacaagaataatgtggcaaaaatagtcataagtagtcaaggtaagaaacgcctaagctaaagtaatactataataagaaacaaccccaaggtcttaatagtataaaccaagtacaatgtctttatatgctcaaaatcgctagtacattacgatacctcatccaaattctgagtccaagtaatagaccaccattgctacaattaatctacatggatatgcagaaatgacaaaacctctaacaaaaaaagaaatcacctacctccacgaagaacttgaatcaacaaaaccaacagtttacacttacaaaattgatcttcattacccaaaacataaaaaacgccggaacacgacaaaaacaacaacaccaaacaacatacag

SEQ ID NO: 534056 - DNA, 80 bp, Homo sapiens
tgccctatcagaaatcgcggtcttagcagcaccaacttcctggccataaatatctcttctgttatttccaaaacaaactt

SEQ ID NO: 534057 - DNA, 737 bp, Homo sapiens
gaagatcagcgtgcaaagctaggtcggcaagacgtgcaaggtgcacccaatgcataacaatccctccccagaccccaagcgtgtcctcacggtggtgggcagtggccccccggactacagaagaacaagtgcgaggggagctcaagtgcggcgcatgaattgggtggtttccggatacaagctccccagttcaaagaaccccggaggagctctttgatttccatctctcagttagggggtcccttgaaaaggtccccaatgccgtgatcttggaacagggaccacacagggggtttctaccacccctctgcgttctggtgaccagggaacagaagggggaacttgaacaacacaaggccaaattgccttgcaaactccattttacaaacaccggccttaaaaaacgtggccggggcaatagtggaggggggattcacgtgcccctgggtaaggtccaccacacggacaagtttcgggcgcgttggcggacttcgaacgcggcggggagtatggattccccacccatgggacggggtctccggaggagaaacggttaacagaaggaataccaaaggcgctttggatccccaacaccaagcgggaaattaaaaacgccccccattatacatcactaagtttaaacaacaaaaaatttaagccagacaagctctacaggggccgggcggacaaacacacagcgttgggggcatccaaagggcccatgggtaaagaatccg

SEQ ID NO: 534058 - DNA, 1600 bp, Homo sapiens
tgtgccttttaaatattttctttttcccctctccccccctctgcagggggggttggaacaggggaaaacccccccccctctcttgccgggaaagcgggagaggtccaatttttactctcatctctctttttcgccacaaagtgccctctgtgtggccctgtgggggttgggaaatgaggtggtctctacagcccctcttttcttctcgtggccttgggcccccctctctcacacaaatatcacacgcggggggagagagagctgtggtggtgtgtggagagagagagccccacagagaaacacgaaagagtgaaaaaaaaagagtgttctctctctcccgagagagaagagagaatacagagtgtgtctctctctcccgcgctctctgcgcccccgcgcgcgccgcctctctctgcgtgagagagagagagagtgagagagagagagacactctctccacaagcgggagacacacagaaaaaagagtgtctctctctcgagagagtgtgtctctctctcatcacccgcagtgtgtgcgccagagagatgagagacaccacacacacatagagtgtctctctcacacgctgtgtgagaagcaggtagtatctccacacacacacatatatatctctcgcagagagagagagcggggagagacacagataatgtctcccacacaaaaaaacacgcgctgtgtgtctcaccacggtgtgtgtatcactctctcacacacacacacacacatagagaaagatagttctctctctctctctgagacacagagagagatcgcactgatgaacactctaaagaacacataccctgagacctctctgaggagaaaaccacaagaatcaaagaaagtggtgtgtgtgtgtacacaccctctctatgagataaaacactctctctctgtgcgaacaaaatataaagtgtgggaccacgctgtagaaaaaggcgagataccactctgtgtgtggtgtgcgctccaacaattatgttcccccacaagagagggagtgtgtgcacacacacatttgtgattataatacaccccacaaagaagatccaaataaagaagcaaaaaaaaaaaaaaaatccaccacaaaaaaataaaccccgtgagagaaccaatcatgtgtggttgatgtttaccccaacaatttattactttgacaccacataattaattaaggtgcttgtcaccaatttgacttccccccacagattttcgtatgaaaataatctaacactgtgtgggttagcacaaacaccaccaaaaaaaaaaacttgtttggttgtttactgtggtgagcacccccaaaaaaaaaaaacacaccctacacctattataacacaagaggaggtacgtcagtggtagtctaaccacccccccataaaaaatactacgcttgcagggggggggcaaccactaggtaagacaaccacccctgggaagaggatgagagttattgcaacaatgcgataactaacaaaactacggcgggcaccaaccaatgttgtgggagtactcacgcgagaaaacctcattttgtttgtgtatgtagttctaccttcataaaatgaacccactcaa

SEQ ID NO: 534059 - DNA, 208 bp, Homo sapiens
gtcaactgcggttcgataacactgcgagagatgagggggattctcagggcgactggtggagtccaagcctctatcgtttcccacttgtggtacttctcataactgtgtcctgtggcacgaacccggctatcaaactgagcctccaccacattcctcaggttgcttatcagtaccttgtatggtagttcaaccgcagttgaaagacgca

SEQ ID NO: 534060 - DNA, 692 bp, Homo sapiens
  misc_feature (692)..(692): n is a, c, g, or t
caattgttatgaaaggcagtgcctgaatctcagatacaaactccattctatctgctttctggaggcattccatatgctgcttgatattcaatcaccctgtccttgttattactctgttccacacaaattagtaaaccaactgcatctgtagtacctagagctgtcaactcggtccgaaatgctgctagtaaaacactacgctcttctaagaaaacttgttgaagggcaagcagtagttcacctcgccagtctgagaagctctcatgagattgagaactatcataaacctcggcttctctttgcagttgcatctttgtaattaaatcctttagagatgagattgtattgatgtaagcttttctctcttctagccaagattctgaaacctgctgaatagaatggtcctctccatcactatagggagactcagtgagagaaagcacctgcatgccttcattatggacagctctcagtaatccctttattttctttggaaaggaatctgttgcactttcactttcttctcctcggccttctgatgctatgtcaaatccctgactgtgtgtaagataaattccctgaccccagtctgatccagaatcactggagcatatttctctagtctggtaagcatcagaatgtgctaactcaggaattgaggatccctctttacttctcagacactgtatccn

SEQ ID NO: 534061 - DNA, 446 bp, Homo sapiens
  misc_feature (434)..(434): n is a, c, g, or t
aattagctgagtatgatgccacgtgtctgtagtcccatctattgggaaggctgaggcaggaagatcacttgagcctacgagtttgaggctgcagtgagctatgatggcaccactgcactccagcctgagcaacagaacaagaccctgtctcaaaaataagtaaataagtaaataataaaataaataattagccaaacatggtggtacacaccaataatcccagctatttgggaggctgaggcaagaggatctcttgagctcaggagttcaaggctgtagtaagctatggttgcaccacttacattccagcctgggcttacaaggacaagaccctgtcttttaaaaaataaatttaaagggaaggaaggagactgtgggggctcccacctggaattggactgggagggaagggagaggaaacccccagttggggnaaagttaaagtt

SEQ ID NO: 534062 - DNA, 113 bp, Homo sapiens
  misc_feature (9)..(9): n is a, c, g, or t
  misc_feature (103)..(103): n is a, c, g, or t
ggacattcngggcacggggcctcctgggccctcgttcggttggcagggcctaaggcccaaagcaattcagtagggccccttttaggcgccccaggaaccctangggtccccaa

SEQ ID NO: 534063 - DNA, 286 bp, Homo sapiens
ttggagcgtgtgcttaagacttcttggtatgtgagcctgacctccctttcttattgggtattccccttggtattttctggtggctgaagacccaaagcctctaaccagatgccttactactggctccaaataaagagggtgcttgaaagaagctgcattagaatgtaactttccgaggatgggcatttttgtccgctttgttccctgctgagttccctggcccctagaatagtgtctggcacatagtgactgctccataaatatttggtaaatgaaccaaaagaaa

SEQ ID NO: 534064 - DNA, 175 bp, Homo sapiens
ttgtccacagttggcaaagtgtgtttttaagggaaaaacaagagacactttttgttgtttttgagacagaatctcagtccgtcacccaagctggagtgcagtggcacgatctcggctcactgcaacctgcgcctcttgagttcaagtgatattcatacgtcagcttcccgagtag

SEQ ID NO: 534065 - DNA, 355 bp, Homo sapiens
tttaacattaattcctttagtttcttaacttataaaactgagagaaaaaaaatgcaaactagaccaggctcggtggcttacgtctgtaatcctagcacttcggtaggccgaggcggtggactgcctgagctcaggagttctgagagcagcctgggcaacacggtgaaaccccgtctctactaaaatacaaaaaattagctgggcatggcggcgtgcacctttagtcacagctacttgggaggctgaggcagaactgcttgaacccgggtagcagaggttgcagtgagccgagatcgcgccactgccctccagtctgggcaacaaagcgagacgccatctcaaaaaaaagtcgacg

SEQ ID NO: 534066 - DNA, 171 bp, Homo sapiens
tgtcagcaccctgctcgacgtgtcgacggaactcgtacagagaggcatgcaccgcagtggtgaatacacgtcgaccaggctccatcttaacgatatttggaggtcagcacggtagtctcacgtgtcgaaggaactagtccagggaggcatgcaccgcagtggtgaatacac

SEQ ID NO: 534067 - DNA, 1091 bp, Homo sapiens
  misc_feature (222)..(222): n is a, c, g, or t
  misc_feature (552)..(552): n is a, c, g, or t
gcttgtcgcgtgcggtgtgtccggtcggagactcgattggtcgggtgacagcgagagaacgataacgaagatgccggacgcgagatagtgagccgtttctccaatcctgtgggtcgcccgagtggcaccacgatgtggatgaatgcactctacatccttccaagcagaatcaagagactcagccaattgtacagagcttgcaggagagacttacgtacatgnatccctcctagtggactgggaccgtaccgtcgtgctacccaagccgtatctaagctcgacgtcacccagtgagcatgccacagggagtcacgacatgcatggcatcgtagagtacccgacgtcgggccacgcaaaggtagcgagaacccagaagacacgtatatgtatgccgaagcatgacgccaaactagagagagatccgagacgcagaggagagaagcggtagcaggacgaagtgagcggaggtatcgtgcgcgaagggaaacggaggatgattggtatggtgagacagagaagattatactgcacgatcaacgcgacgcttgtaantgaggagaaacaaaaggacatagacgttaatcgtggctgtgtggagttcggcaaaatgcatgatgggagtgacaaatagtgagagctgggtatggatgcatatgcatggagagaaggaagcctttggatggctcaggggaaagattactcgggagggtgttcctcgggtgatggtggtgcacttttatggcaaaagggaggaaacaggcgagtaaagggacttgggaaaaaggggtttcgtggagatttcagcagttggcatggggaatttcctagaacaaggggagttacttggaatcggcactggattttacattttggcggcggggggtttggaaaaagttatcggaagtagaacggaacggaacggacaaagggagggggaggacccttgttggagggttggtgttaaaagacgctgttgcgcgcctggagggaacaaaagcggggtaaaatttccaagagggaaaaaacaaagagggtatttatgcacgaagggttggttacccagttggaaagtaacgccggtaaattgggac

SEQ ID NO: 534068 - DNA, 594 bp, Homo sapiens
aaaccttcctcggacccgttaacaacccccctcctaattagtaactacctgactcctacccctcgacaatcatggcaagccaatgcaacttatccagtgaaccactatcacgaaaaaaactctacctctctataataatctccctacaaatctctttaattataacatttacagccacagaactaatcattattttagtatcttctccgaaaccacactaatccccacctgggatataatcacccggatgaggcatccagccagaacgcctgaacgcaggcacatacatccatatctacaccctagtaggctcccttcccttactcatcgcacttaatttacactcacaacaccctaggctcacgtaaacattctattattcactctcacggcccaagacctatcaaattccggagccaacaactaaatatgactatgctttacacaatagctttatagtaaatgatacctctaacggactccacttatgacccctaaagcccatgtcgagccccatcgcggggtcaatagtactggccgagtactctaaaactagcggtatgtatatagctcgattcatctcaaccttgaaaa

SEQ ID NO: 534069 - DNA, 1080 bp, Homo sapiens
ggagagaactagtttcgagtttttgtatttatttttttgggacaggaagtaaaattatgggggagtatataaaaggggggcagaacatgggaagccctcatgagtgcagggcccgccatttgttccagaaaggccacgaacgggggaatgtcacttgaccccacagccatcggggaatgagccgcttttcagcccaccagtgtcttcaaattcatcagcatgtgacactgggtgaaagccccatttcttgtgaaaatgtggatctactcgtggccggcccaggaacacttgtgaacttgtggccctgtgcgcaggggccctcaactcaccattgctctcacttgggtcctgtgcagctgtggatcgcgagattgcgacatgtaaatacacttgggcccaatgtgtaaacccctggggccacagtggcctcgaggggactataccccaagaaggcccacccacggcaatggccgtggtagggagaacccggttcacaagaccgcccagaacacgagggaacaaacaatcctggccaggaacacgcgcggaatgcaacggtggaacagcggggggaagacagaccgacaaccgcgggaaatacatgaagaaaacgccaacaaccgtgatacgcgccaaccacaccatgtaagaacacacagaggacaccgtactaatggggccaacaacaaattccggcggccaagccccctccaagggcgacaacacaagcaaggcgaaccaagagagagacgccccaatactcaacagtcgtcgaacacacgcaagtgagtgagccccaaccaaacacgcggagcaacaatacagtcacaacagattgggaccataaattacccagcccccgaagggcacaaaacggcgcccaaaacccctgaggacactcaggggggccccccacgccggcgccacaaacagccgccagaaacaaaggggacacacggcacagcggaccctacaacaaataacccgggaaaacacaccggaggcgagcgacgcgcagagccccaagcggccaaacacccaaagaacacacacaaagcacccagcccgccaaccccccag

SEQ ID NO: 534070 - DNA, 234 bp, Homo sapiens
tgatttcatgatcttatatcgatccagatgtcatacaggacacgccgctctctggtctctatggcctgggcagcccgacaaatggcgagattcagcaaagtggctgggccaaccccgctggcctatttgcccaaagtctttctgcgtcacacatggcagcttggttggcacgcaggagtcggtagcaagcagcgccaatcaaagtggacgtggctgtctgtccgggttaccgag

SEQ ID NO: 534071 - DNA, 260 bp, Homo sapiens
gatgagccggtaccggcagctttgatctagcacagacccttcacccctcagcctcccgagtagctggactacaggcgtgcaccaccacacctggctaacttttgtatttttagtagagacggggtttgcatgtgcccgggctggtctcgaactcctgaccttaaatgagcctcctgcctcagcctcccaaactgctgggattacaggcgtgtgccaccatgcctggctaatttttatattttcagtagatcaaagcgtgg

SEQ ID NO: 534072 - DNA, 190 bp, Homo sapiens
cctgcgcgggttgttctctggagcagcgttcttttatctccgtccgccttctctcctacctaagtgcgtgccgccacccgattgagggtttgatgggacaatggacaagaggccccttagggcccaagaactaattttttgggttgtaactctaagggccgcaagagatatatacaattaaggttggtat

SEQ ID NO: 534073 - DNA, 622 bp, Homo sapiens
gagagaactagtctcgagtttctgttttcactgcgctgtttagtttttccctacgctcctgactatcctcaactaggggacccttttcttcccccttgccttgcggaccttttctatcaaatctttcaggtactggatctccttggccagggaatccgccctatcttttagagcctcggtcttcttttccaggtctttgcactcaccagtaagagcctcctgctccgcccttttcttttggcggtacctagaggctgctggcttgttttgctccatttttttcaggttcttatccagtatatcaccctttacttttgctggtaccatattgtctccaggaggatcgtaaggttttggacgggcagacccacagagaacacctggagatggaaggctcctatttggagagcgcctgttagaggggctgagctgaggagaccccagaatggactatgggctaatacagatgcccctatcattatctgaagggaggggtaccttctttatgcactggggaacatggcaacgtaagcagtggaatctgggtttctaactcccttagtggaatccacttaattgccagctctttaaggaatgattggagtggaggacgcccctgggt

SEQ ID NO: 534074 - DNA, 946 bp, Homo sapiens
ggacctgtaattccgggtgtgacgagagaacgagatttaccttcctgaattagaaaacgggtcattaagcttgggccctgactcttctatgtgagaaggtacagagatggaaaccttacaagccgagactaaaacgagggtccgttcctctcatggcgtgacgagcaccaggtggcatacaagagaatgtggcaccaatgaaggcccccaagaggatgagaatggcagcagtgcctagtggcagcagcaaggtgctgactagttctggttcatgaatgactccgtgcgaatctgactccctgcgacaaggactgtgtacttgcatgaatgaaggctgagactagttgagtgttgctctgggcaatcctgacttgatgagccgctaaacaggaacacaggcctgcgagcagccggccctggacgaggaggcttggataaccactagaagcacgtccgcctcgcctggcgtccgtagtcagcgcgtcagcacaagttgctgggagcagcagtgaggaagaggacagtgggaagacaggcactggactccaggccgtcagcggccttcccgagaggccggggggttccagcgtctgcctgtacgcagtgagccctgagcgaggaggaggaagaggatgtgctgaatctacgtaccgggagatctttttcatgctagggcataaaactgtgcactgaactgtctgccgagagcagctggaggacagctgagcttccactggtgctgctgggccgcccgcctgtgggacatgggggctctctgtgctcctgacctttgtgccttcttgtggcctggcagattcacctcaggccagaagcccctggacactccgggcctggggctgccgttctgactgtgcggaaaggcaggactcagattgagatcccatttgagtcctctgtatgtactgtgccctttcctgggctcttg

SEQ ID NO: 534075 - DNA, 627 bp, Homo sapiens
  misc_feature (521)..(521): n is a, c, g, or t
cagggtgtggacctgccatctgcccagcaggccagtcccggcaattccatgcttagtcactgcctgcaaaggtcatgtgcgtgaggccttatcagttcattcttagctcttaatggtacagttcggagctgaaagtgcgtgcattgaaattttaaccaagaacatgtcgtcctatatcctggtttctgtagccttccgtccacaatcgctttctaaactaagattttaacagacatgtgggtgtcgtcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtggctgctgaagatgaatcaatgggaaatactactcctgtaattcctacctccctgaaaaccaattacaaccaagctctctgatctactcccaagtatggggttcaagagagtaatgggtttcatatntgcttatcaccacagtaagttcctactaggcaaaatgagagggcagtgttccttttttggtacttattactgtaagtatttcccagcacatgaaaccttatttttc

SEQ ID NO: 534076 - DNA, 105 bp, Homo sapiens
ttttggatattctaggagaaagcctataatttcccatagtttctctttttcatgtagctgtaacctaaatgtactacctctgataggactatatatcaaatgtca

SEQ ID NO: 534077 - DNA, 82 bp, Homo sapiens
  misc_feature (64)..(64): n is a, c, g, or t
tcgaagtcacgctgaggccgaggcctggcccagggtgttggaggcctcacagatatagacaccntcatccgcttatccaatg

SEQ ID NO: 534078 - DNA, 252 bp, Homo sapiens
agagcaaatactagactaaagaaatgatcatctcaggtacaatgttacaatagatgaaagctcagtccagttttttggcgattttatttattcaacagtgtcctcacataccactcttcagtctatcaatacatttctgactagctcaagcagaaaggtcctctgtcatcgtttcccagagatccagtgtcaatctcagacttccaactttacctccgtgaaatctcccgatatcagtttctcaacaatcat

SEQ ID NO: 534079 - DNA, 398 bp, Homo sapiens
  misc_feature (2)..(3): n is a, c, g, or t
  misc_feature (33)..(33): n is a, c, g, or t
  misc_feature (36)..(36): n is a, c, g, or t
  misc_feature (229)..(229): n is a, c, g, or t
  misc_feature (267)..(267): n is a, c, g, or t
  misc_feature (275)..(275): n is a, c, g, or t
  misc_feature (293)..(293): n is a, c, g, or t
  misc_feature (295)..(295): n is a, c, g, or t
  misc_feature (297)..(297): n is a, c, g, or t
  misc_feature (326)..(326): n is a, c, g, or t
  misc_feature (352)..(352): n is a, c, g, or t
  misc_feature (355)..(355): n is a, c, g, or t
  misc_feature (360)..(360): n is a, c, g, or t
  misc_feature (382)..(382): n is a, c, g, or t
gnnctgtccccgttgacctttctttttggtatnccntgggggttctgataatgtgtggagtctcattatggctgagagtttaagtgttttcaccagtgaagtgcagacatttgatttctttatgagttcccctgtgttagaaatggctatagaaaaatttgtcataataatttcatttgcatgaaatcctgaggggtgcattaaggaaactaaaagcaccacttacccnatctatcggcagaactgatgtgaggtaagtgagcatgncccccccnataggagctcacatgganananttatgtcactgagttgtcagaaattatgnccccatgaaaactgtttgtttcatgnccnattanatagtctataaattaaactggnagtaattattacttta

SEQ ID NO: 534080 - DNA, 266 bp, Homo sapiens
ggtgggaaatggtggatgatatctggcctccatcttcggcaccgagaaagacaaagtcaactgttcattttatttcaagaatcgggagcatgtcgtcatggagagcggtgctctcggttgcacaataaagcgacgtttagccagagcattgccctctatgaacatgtaccgtaaccctcaaaactcttcccagtgctgcggatggtttgcgctgtgccgtgatgcgatgtggagagtgcggaatactaatgatgagtgcggagagg

SEQ ID NO: 534081 - DNA, 167 bp, Homo sapiens
ttttctatacagcaaatactatctccggtttgatcaagtcccctcacagcttacattttttttacaaatccttgccttcccattagatatgaacaaactccggtttctcatgatcgtttagttcggttagctctgtacaggatcacattggccatcgaaggactata

SEQ ID NO: 534082 - DNA, 241 bp, Homo sapiens
tactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattaacatattttgtatgctttgtgttg

SEQ ID NO: 534083 - DNA, 372 bp, Homo sapiens
tggggccttcagggctttgggacattttgtcctcaaccctctccctagatcagtttgtgagggtccctgtaaatattgtgtacaccatgcccacgtatatacaagtacacccagatgtacacacagatgtacacatggtccagccccagttttgcaaacctgcacttgcaccccagccttggcccctgcttgggtttggcttaaaagaagcagctccaacccggcttttgtccccttccccacccactgcctgagccttttgagcagaccaggtaccttgggtgcaccggtgtgtggcccgctttcacccaggcacagccccccccccatggatttccgtgtacactatcaataaaagtgggtttgttccca

SEQ ID NO: 534084 - DNA, 630 bp, Homo sapiens
agtgtggatgccccacccagaacatctctgcgtgggcctacccctacgcctacccgcccatgccagccatggatgccacaccattggcattcgatggacatggatcccatgaatccgcataccacatgagtcacagaaagtgagaaagtgtgagaagagaagcagatgagcatgatcaagatctgaggcactctaatcaataacgcctagtaataaacccattgagagtcaccacaccgcgcctaggagggcggagacggcggagagccgcacgagcgcccgcaaggcggcaggcgagcagcggaccacggagcccgagcgcaaaccacgaaccaggggccgcgcgccacgacaacacccaggcgacaccacaccaacagcaccagcgacccacgcggacgcgcgcgcgacatccgataccgttcacacacccacagtgcagatccgctgtgcatcagagacatctagtcaatgtactgccgtaacatcacacaatcaatgatgacccagcactgctcgacacacctgcactttcatcacagtgccaatgtgcgctcgcactaggtcctacactacagaggccgccaccaacaatgatcgtggtcatagtatctgcaccaacaccagcat

SEQ ID NO: 534085 - DNA, 321 bp, Homo sapiens
  misc_feature (55)..(55): n is a, c, g, or t
  misc_feature (65)..(65): n is a, c, g, or t
  misc_feature (92)..(92): n is a, c, g, or t
aggctacctccacaaacagaagactaagggtatgttaaagtgcttgccatgagcntgggttacancggggaatttgcaaatactacataacnattttacaatttgccatgtggtgtaaaaacttaagggaaattttttctaaaaccatcataagaaaaaattggaactaggccagatgcagtggctcacacttgtaatccccgcactttgaaggtcaaggcaggtggatcactggagcccaagggttcaagatcagctgagcaaaggaaaatgtcatctctaaagaaaatacaaaaaattagctgttagtggaggtagact

SEQ ID NO: 534086 - DNA, 349 bp, Homo sapiens
  misc_feature (1)..(1): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (215)..(216): n is a, c, g, or t
  misc_feature (243)..(243): n is a, c, g, or t
  misc_feature (280)..(282): n is a, c, g, or t
  misc_feature (290)..(291): n is a, c, g, or t
  misc_feature (329)..(329): n is a, c, g, or t
  misc_feature (333)..(333): n is a, c, g, or t
  misc_feature (337)..(337): n is a, c, g, or t
ntggtcataacgcattgtatttattttcaagtattttcttgaaagtctgtgctcataaaaatcatgaaaagttggaaagactgtttnatncgntgaaacttcaaatatatcttacacaatcttgtttgtacaaaaatacaagttaaatataaacataaagcaatcatggtaattttatgcaaatctgttttatgtgatcatcagttatatataannctttctcagttctgttatttgtcaaangatcaataccagattgaatgactacctattggcaaannnccctaagnngcttactttagccctcatcttttacatggttaaatgcntttnctantttgggatcacc

SEQ ID NO: 534087 - DNA, 197 bp, Homo sapiens
gtgctttggctaccagtctgtccagcctccaccagttgctcttggagacaggtgagctgattgtaggtgccagcaccttaggtacaggccactagttggtgaagtggactagggcacacgtgtgtatgcttgcagcaagtacacttgtgtgtctgaacgtccctgatgtcgctctgtcctgatggtggcacagctct

SEQ ID NO: 534088 - DNA, 277 bp, Homo sapiens
taaccttcgcaccaagaatatcaggcggaggctacttatacttcacccggcatgagggcggccacccgggccatctctcctacaagcacagaagcacaaatcgaacagggatggaaaacagaagaaagtgcttttggactacgtgaaacccagtcagtctttacaaggtgtagtccaatctccgggaaagaccaagggaaatgggaggacttccgggccggttcttcagtccatggccggcaaatctctaaacttcccctggtgcctgcgggaattg

SEQ ID NO: 534089 - DNA, 101 bp, Homo sapiens
gatctacaggatccttacgttgacacttcagagcaaaaccaaaaaaataaaacccaacccaaacaaaaactttggtgggtctctcccccccatttgtaagt

SEQ ID NO: 534090 - DNA, 559 bp, Homo sapiens
aagtaaaatgctatcagacagatcacatgctatagagaaatcttttattgttgtctgattgtatgaaattgccacagccatctcatgccttcagcatgcagcagccctatccctggatcagtcagcagccatcaacatggaggccagaccctccaccagcagaaagattacgacttgctgaaggctcagatgatcatgagcattgttgagcgataaagtatttgttaattgagatacactctggaaatgattaaactagtaccacgtaatgagagtgcctggaactatttgaaagggatttggcaggatcgtggtctttccaaatatcctaatcggtgaattcagttacttgatttgcaaccaggtcatagttgctccctgggtaattgcctttcttgtggatatctatgaagacgtgctagaaaatcagtgtgacaataaggaagacattcttaataaagcattagagttatgtgaaatcctagctaaagaaaaggacactataagaaaggaatatcggagatacattggaagatcccttcaaagcaaacacagcaca

SEQ ID NO: 534091 - DNA, 1129 bp, Homo sapiens
cccacgctgtcggccaggaggagcgcgcgggcacagagatgccgctgaccgaggcgtgcaaagactccagaattggaggcatgatgaagactctgctgcatgtttgtggggctgctgctgacctgggagagtgggcaggtcctgggggaccagacggtctcagacaatgagctccaggaaatgtccaatcagggcacagtcacgtacgtcccatcaccaggaaattccaaaatgctgtccaactggggtgcaaaccagcatacaagcactcgtcatcagcaacaacaacgaacacgcacagcagcgcaagaccactgctccagcaaccatagacagcaagccaaagcacagcaagcaacagcaggatagccctaaaatgcagcacccaagggcaaatcaggcagaaaaaagctgcaaggcagctccacaggagatgtggcaatagagaccaatgcatggccctactggcgcagagtgtaagcacctgacctgaaacagacctgacatgaagtactacgcacgcgtctgcagaagtggctcaggacaggttggacgacagcttgaggagttcctgaaccagagctcgcccttctacttactggatgaatggtgaccgaatcgactccctgctggagaacgaccggacagcagacgcacatgactggatgtccatgcaggacaacttcagacgagcggtcagacatcatagcacgagctcttccaggcaaaggatcttacaaccgggagcacccaggataactaacaaatacatgccatacaacctggccacaccggaggactacatatttacatacccaaaggacccagcaatagaacggcaagaggaaagagccaacatcaaccagaacagagcccaggcaaagaccaaggcaagggagtaccaagcacccgtccatgagacaggaacaaagaatggccacacgacggcacacagggacacacccaagtacacaaaagcccaggcagcacaaaaacacagcaaaacgaaaacacaacagagaaaggacgaaaagacccaaaaggggacagagagacacggaaacacaacgaggagacaacgacaaaaaagagaagagccaggcacacaacatagagcacacaacaaaaa

SEQ ID NO: 534092 - DNA, 179 bp, Homo sapiens
aatctcagtacatctctagctagtgaagaggccgagttagtcccttagaaaccgcacccagcctgaattgtcgaactcaatgcttgggtcacctccagattcattttcacagtctttcctgttcttggtcatactaccttgtatttctgctgccatactgactgatcttttttttgtta

SEQ ID NO: 534093 - DNA, 501 bp, Homo sapiens
  misc_feature (299)..(299): n is a, c, g, or t
  misc_feature (316)..(316): n is a, c, g, or t
  misc_feature (476)..(476): n is a, c, g, or t
  misc_feature (485)..(485): n is a, c, g, or t
gatgacccagatagtctattccttagggatatacccaagggaaatgaaaatatacatccacactaaaatttgtacacaaatgttcatagcagcattgttcataatagccaaaaattggaaaaaaaactcaagtgcctatcaacagaggaactgataaaatatggtatatccattcaaaagattactcagcattagaaaagagtgaagtgctgatatacgctacagcatggataaaccttgaaaacactgtgccaagtgaaataagtcaatcacaaaagaccatatgtagtaagatttcnttctgtgaaatctcccngaaagagctaaactcagagaccagaaaggttaagcctagtttattggccaggggacgagagggaaaaggggaattaaggatgactggctaattggggtattgggatttccttggtggacttgatgaaaatggtcctgaaaggtatcctagacacctgtcntgggttggngtggttctgtggacat

SEQ ID NO: 534094 - DNA, 504 bp, Homo sapiens
  misc_feature (97)..(98): n is a, c, g, or t
cccaaaacatgttgcttaggtcaagccagtctcccccagcaggggtgaacaatttttcccacagcctgcctggcccaccctttctccgagggacggnntccagtgggccttatcttccccatgccaggtgtgatggttaatactgtcaatttaattggattgaaggatacaaagtattgatgctgggtgtgtctgagagggtgttgccaaaagagattaacactagagtcagtgggctgcggaaggcagacccacccttcatctggtgggcaccatctaatcagctgccagcgaatgtcaaccagaaaaacgtgaaaaggagacgaacagcctcgcctcccagcctacatctttctcctgggctggacgcttcctgccctcgaacatcggactccaagttcagctttgagactcgggctggctctccatgctcctcagcttgcagacggcctattgtgggaccttgtgatcgtgtgagttaatacttaataaactccccttcat

SEQ ID NO: 534095 - DNA, 1080 bp, Homo sapiens
gaccaagaccagattgtgactgttgcggatggagatggacacctagatgaatgatttaatccaccaacaattgtggcacacatggcatcgtcttccccacgccaggactcagaggctgagcccagggtgcatgagaggctgagcccacagactccggggtgcggaatggagctccccgagcgcggcttatcttatcaagggagctcacactcttttacaatcaacccatcgaggatgagggctccattcagcacatctcccaagctcacacccatggacaacagacctccggggcagggctcactgattccatacccacacacactcaagctccattcatcatcacacaatgacccaggcataacgttagccacactggcagcagggggaacatgaccctgagcagacaggcgctggacccatgatccaagcccatgcattaccgagatgaactcttgataccagctggaatcgtcatccgggatgcttcctccgacagaccacaggtcaagtgcaggtacagtgtcttagcgcgtcagcatgtccagtcggagccaggctccagccattcaatccccacagcaaaatagccagcttcgacaatcaggctcactatgacacggcgtcattcagactcatctgccataactacactggatatcctacactccatagctaatgtacacctatagcacagctgaagggttcaacaatacgcatcgcaaggaagacattgactaaacgatacactacatcggcattacaacatagcacacagctgcgcgatcgaccacaaaaaaaacagaaagagacaccacgacaacacaatgaccacagaaatagacaacaggacccaaaaacacaatgaacaacaagcacagaaacgaacacacaaggaacaagcaccaaaagagaagaacacaaccactgaccacaaactagcccacaccgacacagaaccacacaaaaaacacaccaagaaggataaagcacaacgacgacccaaagcaagaacaaaaggacacagaacacgaaccagaaggaaccaaacaaaacataaaaaacaaaaagcgaacagaa

SEQ ID NO: 534096 - DNA, 428 bp, Homo sapiens
aacatgcggaacggggtagacttgttgagaaggaacagggcgcaaggtcgcaacggtgtgcacgtagatgattacggcgatgtccagtagatgaaaagcttcatgtactgccctggaagtatgggctgcccgcccacagctggctggggcatgggcatcgatcgagtcgccatgtcactcacggactccaacaacatcaaggaagtactttctgtcccctgccatgcaacccgatcacgagaaagtagaatgtagtcaagccacggatatcactggaaaacagcaacgaggtcggcactgctgtctagaaattagtaatcggcaaggtgtataactcaggcgtctctgggtagctgcgagagatcaaggtctgcaagggaagtcttgtgtgctgcgtttccattgtgacaccggatgtccgcttgggg

SEQ ID NO: 534097 - DNA, 1337 bp, Homo sapiens
ggcctgcatctgcgccgcccaatgctggcctgcctgcacccccagccccgccaggcccgcactccgctgcccctggcctcctgctaccatgtggcatgcctgcaatgctgctgccctgccctgccctgcctgacccctgtgactgctgaccatgtgccatgtgccatctgtgccctgcatggaagacttgcaggcttgtcggtggacagatggtttccatgccccaggtaccccgcgaggccccagagcagtcccaagactgaacagcttcgtccggtgccagaacgactaaaggaaatccagccccgtgcagacaggtcaagccggaccccagccatgacaatccgcagcaggaccatggacaccatctctgagacttgcagtcatgcctgcaaactggccctgggagcttgggtgtgcaatgagtcctgggcaggcttgaatgtgccaagtgcccaggatgctaggggagtccatgccaccccagacggccgagaggacctgacctgaggacgccatgtaggctgagaagagcgcaacgactaccagacgctatccatgaccctaggacccagaaccggacctgaccggggctcagtgcttgcccctacagatgttaccaaggttgctaggctggcagattgttcctgcaggcactgtgacaaccatacgctggagcagtagcttccaaaaatacagcatccagaggaacgcccaaccatatatagccaaatggtaccataccgatcgctgtccagcgaccacgtgactgccagataaccggcagatacaatggagacactccgcaaaaaggacgagcaccagaacaaaaagcacagagcaaaaccaggagcatcatacccagcatcccggcccagggaacagcccagcacaccccacgcattcgacaacagacagccagcccacgagcaggccacgaaaacaaacatcgaccaccagaccaacatggcggtggcgcactgaagagcaggacaggagtacaagaccccccagagcacaagcagtcaaggcgcgctcctacagacagagagaaggagacttatagacacaaaagatagttgttgccacgcgccaagagaagccaccaggcccccgcacaccctccaccaccagcaacgagagcgcaacacaacgactacacaagcaccgcctaacaggaacgaccaagaacaaccaaccggacacagccgcaaacaacaccgacagagagacacaaacaacaaacaaaaaaaaagcaggcacaacccgggactagatagcccaagacagagggagaaaggagagcatgagcacaagaaacaaaagacgcgcacaaa

SEQ ID NO: 534098 - DNA, 695 bp, Homo sapiens
agcgggaggtcaaggtgggcggataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctccaaaaaagaaagaaagaaaaataggccaggcgcggtggctcatgcctttaatatcaacactttgggaggctgagcttggcagatcatcggaggtcaggagttggagaccagcctggtcaacatagcgaaaccccatctctactaaaaatacaaaaaaaattagcctggcatggtgatgtgtgcctgtaatcccagctactctggaggctgaggcaagagaatcacttgaacctgggaggtggaggctacagtgagccaagattgtgccactgctctccagcctgggcaacagagcgggactcggtctcaaaaaagagaaacttaaacaaattaaaccgggcatggtggacatgcacttatcatcctaagctattcacgtgagaactgaaggtaggacgattgcgtggatcctgaagaggtcgacagttgcattgaagcagtgaatgtaccaa

SEQ ID NO: 534099 - DNA, 1373 bp, Homo sapiens
gggctggtgctcgacggttccgagagcgcggagtagacgatagcctgagatcagagtctcgcccttgggggccggccatgacgtgggtcgaagctgaatgcttggatcgtccactgtgcggtcaatgaatgtcagtgctggactgatggaatgcatcatgggcttcaattgatcggaccgacgcttaccctgacattacgtcctagcagtcagcccagaacggacgtcctaacagagcttccgtgagagcgtgtgtgagtcagtttacgctcagcttccagccatggaatccatcatgcgtgggctacgtctcccatactttcagcggacgatggtgggcctacagacggacccccgaatcatacgaatgtacttctatcacccaaagcacaaggagtccgatcgttacgctccatatcttgacttgcgcagtgtgacttagcctgaaagaatcgagcgcgtacagaaggcaatggatacggaggcgaaggctcaagagcttgctatacaacccttccccagatgcactccaagaaagagcttgcgatctcttcgctgagaggatcctttcctgggggagcagccatggatagccctggaagaggggtggcccccattcgtaaccttcttacctaggggggggacgtaggaaaccagaaaggtaggaggggctccaagacctaccattagcttgaagccaagggccgtgggtgtactattcaccgcgactttgagaaacctaggaggcgcgacggaaaggagagttcctggccagaggaaccgttttcgttggtgagaccacagaagggcggaaaaaccaaattgttgtggtcgggaagagttttgcaaaaagagccaagtaacattctaaaatgggcaccttttccaggatccccggtgggcgactttggtatgcctttgaacgcaaatccctacactgtggaaccctcggactctggcgcttaggggtagattatatgggccaaacggctcagattgggggaacacgttggctttggcatagacatgccttgggagcgcatgaggatcccgcgttgtgcgaatgaatttcctttcccctggtgaacacacttcgggcggccccgtggatagcacgcctgactacggagaaatgacaatcggagttttgtggttcagaatttccaagttggccccccgggggcgttaaccgtttggagcagtttctgcgatagagcgggtcacacacagctacccaggcccacacactaaaaaggaattccgcttccaaagggcggtgagcccaaggcaggggacgacgcgctccggaagcaaacattggcgatgcggatggccgacgccactgggttggcttgggcaagctggttcaacag

SEQ ID NO: 534100 - DNA, 141 bp, Homo sapiens
  misc_feature (20)..(20): n is a, c, g, or t
aaaaagaaaggaatttttancttggggtttttgggggcccccccccccccccggggggcccaaaaaaaaaaaagggcttttcccttttttcaaagggggtttttgggggggggggcccccaccccccccttttccccccca

SEQ ID NO: 534101 - DNA, 266 bp, Homo sapiens
tggatgggtggttccgatggggaggtggatttcatgagcggatgtgatcagtgatggaggagtgtggcgtaagcatgagatgggattgaggtgtccactcttgtataggacatgagtgtgaacagatgcagtccataccatactgtacccaaacatgtacccaaatcacaggtagtcctgggtgggtgataactaggtctcgatggcagcttagggacgaggagtatcaggccaggggtggtcgtaacactgcaatattgtgtgac

SEQ ID NO: 534102 - DNA, 2114 bp, Homo sapiens
gtggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaataaaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaactgcctcagacttaatctcaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctattttttttttttttttggttgttgttaaacagaaccttaagtttatgtttgaggtatgtactgcataggaacctattttattattaaagatgaatgatt

SEQ ID NO: 534103 - DNA, 491 bp, Homo sapiens
  misc_feature (134)..(134): n is a, c, g, or t
  misc_feature (176)..(176): n is a, c, g, or t
  misc_feature (202)..(202): n is a, c, g, or t
  misc_feature (207)..(207): n is a, c, g, or t
  misc_feature (212)..(212): n is a, c, g, or t
  misc_feature (215)..(215): n is a, c, g, or t
  misc_feature (231)..(231): n is a, c, g, or t
  misc_feature (234)..(234): n is a, c, g, or t
  misc_feature (236)..(236): n is a, c, g, or t
  misc_feature (240)..(240): n is a, c, g, or t
  misc_feature (247)..(247): n is a, c, g, or t
  misc_feature (257)..(257): n is a, c, g, or t
  misc_feature (260)..(260): n is a, c, g, or t
  misc_feature (268)..(268): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (284)..(284): n is a, c, g, or t
  misc_feature (294)..(294): n is a, c, g, or t
  misc_feature (302)..(302): n is a, c, g, or t
  misc_feature (304)..(304): n is a, c, g, or t
  misc_feature (306)..(306): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (338)..(338): n is a, c, g, or t
  misc_feature (355)..(355): n is a, c, g, or t
  misc_feature (388)..(388): n is a, c, g, or t
caccagcacccacagaaccacagtgccctcaacaatgacacccatgctcgtgacagacacagaggctttctggcagccacagccctggtttgtggtggtgttgacagcaactggtgctcttctcctcttggccntaggctggcttcttggcaggctcctccaggggttggcccagntgctgcaagcacccagcaaaccagcncaggntttgntgntaaacagcatccaggnaantnaggnatccatngagggtttcntgnaggcaccnaanatgnanatgtccnaggcacccancagtgtanantntgcgcattttnangncagagcacaggactccngtccggaagagactacntgtttaacacacacacaggagcccggcgctggntctgaggccaagtagctgtcttactatgtgtggaatttctttttcacaccatcatgggctgtattttcaagttgattcataataaacaaaattacaaaaagaa

SEQ ID NO: 534104 - DNA, 1161 bp, Homo sapiens
  misc_feature (25)..(25): n is a, c, g, or t
ttttcttagtgtctgatggcctggntgtctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtacgggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgagtcccaaacacgacgcacagatccatatagctcggcctgcactgaccgaaatcgtagtatagagagccaacgcagaaccacacaaccgcaacacgcaccacgacccatgataaccaaaagggaccaggaggtaacccccagcgatagaaaggagcaaacaaacagcacggcacgaaccaagagaaccaccatacacacagagaactcaacccatcacgagaacaataaccgaccaagaccacacgccaacaccccaatgaacaagaacccacacagcgcgacgataacaagctcaaagcagaagcgcggacggcgcggcgacgaggcccagacgccacacaacacaacagacagagagcagccgggagaacgaccagaaacccgggcgacaccagcaaagccacgagccgagagcacaacacacagagcaaagcaacagcacaaacagcaaccagagagacacaacagcaagcaaaacgagcagcacaagaaagaccaccgcactgaggccacagacacggcgaaa

SEQ ID NO: 534105 - DNA, 1128 bp, Homo sapiens
  misc_feature (25)..(25): n is a, c, g, or t
  misc_feature (787)..(787): n is a, c, g, or t
  misc_feature (806)..(806): n is a, c, g, or t
  misc_feature (819)..(819): n is a, c, g, or t
  misc_feature (882)..(882): n is a, c, g, or t
  misc_feature (895)..(895): n is a, c, g, or t
  misc_feature (898)..(898): n is a, c, g, or t
ttttcttagtgtctgatggcctggntgtctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtacgggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccagcggccccgccccttccccaggcccaccatcaccaccgcctctggccgccaacccgcatcttccacctgtgccctcaccaccacactacagcagcacaccagccgctgcagggctcccatgggctgagtggggagcagttttacccntggcctcagttcccagctncccccggccaccnatgcatacagacatgccctcctggacaaggctaacatcccacttagccgcaccctgcacctgntgcgtccccactnccnttggttggtggggacattgctctcctgggcttttcggttctggggggcgcccatctcgtgcttccgcttcagctgtttcccatcgtggcttcccatacgtggggccatgggaggggttacccctggcctttaaaaggtggcccaaagccccatctcaatcctggcaacgccactaactccaattgccccctggatatggcagacaggttgtggagcaattgggaggaagg

SEQ ID NO: 534106 - DNA, 408 bp, Homo sapiens
gcggccccgacctactactactaaattcgcggccgctcgaccctgcattagtgagacctggcctgccacaggagtaggtcaagtactaatctagcatactcttaggaagttgaacattgtatttctatttttatattcatcagaactaacatggccacactcagctggaaggatatctgagaaattgagtatatctagggaagaaatttgcccagttaacattcagaagttctgttactaaggacaaagtggagaatggattttatagtactactagtactagtagaattctctactagagtggatgcattgaaaagtgtttcaatttaatacatgtttcagagaaaacactaatgcatataaaggaagcacctactctgtgttagagactacattgttagtcgacgc

SEQ ID NO: 534107 - DNA, 336 bp, Homo sapiens
tgggttgggccagggcctttgggtcccctccttgcttgggcctttcacagtgcaagccccccaccctaggcccttttgggtggtggtggaatggttgggaaggggcaaaaccaggtgaggagtcctccctgggggggcatactttgcattacagctggggaggttaaaacctggggggccccagttggtttttggactccaaagcccaggacccttccaaatcctgcttggggggccccgtggccaggagcccacccagcccttcccttttttgcgagggttttttgtttttttgattataaaaaaacccctgttggtggggggaaaaaattacca

SEQ ID NO: 534108 - DNA, 1057 bp, Homo sapiens
  misc_feature (25)..(25): n is a, c, g, or t
  misc_feature (716)..(716): n is a, c, g, or t
  misc_feature (735)..(735): n is a, c, g, or t
  misc_feature (748)..(748): n is a, c, g, or t
  misc_feature (811)..(811): n is a, c, g, or t
  misc_feature (824)..(824): n is a, c, g, or t
  misc_feature (827)..(827): n is a, c, g, or t
ttttcttagtgtctgatggcctggntgtctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagcttttgctccgtccaccgcccgccttcccaggcacatacacgcttgtgcgcaccccatttgcactgtcctaacaatagaagcaacacgtgagggctcccatgggctgagtggggagcagttttacccntggcctcagttcccagctncccccggccaccnatgcatacagacatgccctcctggacaaggctaacatcccacttagccgcaccctgcacctgntgcgtccccactnccnttggttggtggggacattgctctcctgggcttttcggttctggggggcgcccatctcgtgcttccgcttcagctgtttcccatcgtggcttcccatacgtggggccatgggaggggttacccctggcctttaaaaggtggcccaaagccccatctcaatcctggcaacgccactaactccaattgccccctggatatggcagacaggttgtggagcaattgggaggaagg

SEQ ID NO: 534109 - DNA, 1094 bp, Homo sapiens
  misc_feature (25)..(25): n is a, c, g, or t
  misc_feature (753)..(753): n is a, c, g, or t
  misc_feature (772)..(772): n is a, c, g, or t
  misc_feature (785)..(785): n is a, c, g, or t
  misc_feature (848)..(848): n is a, c, g, or t
  misc_feature (861)..(861): n is a, c, g, or t
  misc_feature (864)..(864): n is a, c, g, or t
ttttcttagtgtctgatggcctggntgtctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaaggcacggaaaaggacggcactgagaagcggggccggggcaggccgcgcaagcagcctccgggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccagcggccccgccccttccccaggcccaccatcaccaccgcctctggccgccaacccgcatcttccacctgtgccctcaccaccacactacagcagcacaccagccgctgcagggctcccatgggctgagtggggagcagttttacccntggcctcagttcccagctncccccggccaccnatgcatacagacatgccctcctggacaaggctaacatcccacttagccgcaccctgcacctgntgcgtccccactnccnttggttggtggggacattgctctcctgggcttttcggttctggggggcgcccatctcgtgcttccgcttcagctgtttcccatcgtggcttcccatacgtggggccatgggaggggttacccctggcctttaaaaggtggcccaaagccccatctcaatcctggcaacgccactaactccaattgccccctggatatggcagacaggttgtggagcaattgggaggaagg

SEQ ID NO: 534110 - DNA, 357 bp, Homo sapiens
acgtgccgcaacgcttcaacggcgcacgacaggggccgactctactcctagggtcccgagtcgccttccctcaccccgtaagtgacggcctgggacattctaacttaccccctcagcgtcagccactgaccggtcccatctaccacttttctagtgtctccttaggccccagcacctccctcctctcaaactccagtatccagcacacccgtgggtgcccagcactgccttagaggaggctccttctacctaaaccaggtgtcctatgggctatctcgtatcagctaggctgtggacaccaagaatccagaatctgggttcacttagtgtactgcaccccttttctgctccctgata

SEQ ID NO: 534111 - DNA, 1160 bp, Homo sapiens
  misc_feature (25)..(25): n is a, c, g, or t
  misc_feature (284)..(284): n is a, c, g, or t
  misc_feature (301)..(301): n is a, c, g, or t
  misc_feature (819)..(819): n is a, c, g, or t
  misc_feature (838)..(838): n is a, c, g, or t
  misc_feature (851)..(851): n is a, c, g, or t
  misc_feature (914)..(914): n is a, c, g, or t
  misc_feature (927)..(927): n is a, c, g, or t
  misc_feature (930)..(930): n is a, c, g, or t
ttttcttagtgtctgatggcctggntgtctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagtccccccccccntttttggggggcccccnttccaaaagcccaatgcggaaaaaaaggacggcactgagaagcggggccggggcaggccgcgcaagcagcctccggtgagtcccgggacagcgctggtacgggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccagcggccccgccccttccccaggcccaccatcaccaccgcctctggccgccaacccgcatcttccacctgtgccctcaccaccacactacagcagcacaccagccgctgcagggctcccatgggctgagtggggagcagttttacccntggcctcagttcccagctncccccggccaccnatgcatacagacatgccctcctggacaaggctaacatcccacttagccgcaccctgcacctgntgcgtccccactnccnttggttggtggggacattgctctcctgggcttttcggttctggggggcgcccatctcgtgcttccgcttcagctgtttcccatcgtggcttcccatacgtggggccatgggaggggttacccctggcctttaaaaggtggcccaaagccccatctcaatcctggcaacgccactaactccaattgccccctggatatggcagacaggttgtggagcaattgggaggaagg

SEQ ID NO: 534112 - DNA, 574 bp, Homo sapiens
tcagaagaggccaggctggtctcgaactcctgacctcaagtgatctgctggccttggcctcccaaaatgctgggtctagaggcatgagccaccgtgcccagcctaagaatgtcactttctaacaggtccaagaactccaagtttatcttgggaccttaagagaagagaatcactcaactcacaggcatttgaggatacaaacccatgactgggcttggctttaaaaggtcttatctgagactccttgtgaaacagttccatcaaagccaatccaaaaggcctatgtagaaataattattcctcttgcactttatgcaaataatcagaccaagtgtaagactacaatctattttgcaaacaactcagtcctatcatgatttatgtttttttgtttgttttttccaaaaatgaggactagagagaaagaaattgtgtttcaaaacttatcatacatttgccattaaattctaaactcactagttggttttaagtttttgcctacagtttagatgaaccttgcttggtcctgtgaacccacaagcaggctccagctccaggttaaaaaagaaccaaa

SEQ ID NO: 534113 - DNA, 397 bp, Homo sapiens
  misc_feature (47)..(47): n is a, c, g, or t
tgagctagagtctcactctgttgcccaggctggagcgcaatggcaantcttggctcactgcaacctctgcctaccacgcgattcttgtgcctcagtttactgagtagctgggattacaggcgcattcagccatagccggctaacttttgtatttttagtagagactgggtttcaccatgttgcccaggctggtcttgaactcctggcctcaagtgatcctcctgcttcggcctcccaaagtgctgggaacacaggcatgagcaccttgcccagcctagaagatgttaatattatgtttgaattttaagatgatcaatattttttaagaaaaaatttatgggagaatcaactaaacaatgatcttttgaattctttcctacttctaaggaaattaagt

SEQ ID NO: 534114 - DNA, 166 bp, Homo sapiens
  misc_feature (45)..(45): n is a, c, g, or t
  misc_feature (71)..(71): n is a, c, g, or t
  misc_feature (96)..(96): n is a, c, g, or t
tagaggatccccatgcctcatccagtggcagtgtcagatatgaantgttaaggacagaggaaatgctccangattaaaggaaggttaagagaacantgaaatttctgtatttggtaattgtaactggtggaattaatttgcaaagaggaagattttggtattttaa

SEQ ID NO: 534115 - DNA, 387 bp, Homo sapiens
  misc_feature (37)..(37): n is a, c, g, or t
  misc_feature (77)..(77): n is a, c, g, or t
  misc_feature (81)..(81): n is a, c, g, or t
  misc_feature (92)..(92): n is a, c, g, or t
  misc_feature (107)..(107): n is a, c, g, or t
  misc_feature (118)..(118): n is a, c, g, or t
  misc_feature (122)..(123): n is a, c, g, or t
  misc_feature (131)..(131): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (162)..(162): n is a, c, g, or t
  misc_feature (190)..(190): n is a, c, g, or t
  misc_feature (202)..(202): n is a, c, g, or t
  misc_feature (210)..(210): n is a, c, g, or t
  misc_feature (222)..(222): n is a, c, g, or t
  misc_feature (232)..(232): n is a, c, g, or t
  misc_feature (235)..(235): n is a, c, g, or t
  misc_feature (239)..(239): n is a, c, g, or t
  misc_feature (246)..(246): n is a, c, g, or t
  misc_feature (250)..(250): n is a, c, g, or t
  misc_feature (259)..(259): n is a, c, g, or t
  misc_feature (261)..(262): n is a, c, g, or t
  misc_feature (265)..(265): n is a, c, g, or t
  misc_feature (268)..(268): n is a, c, g, or t
  misc_feature (295)..(295): n is a, c, g, or t
tatctgttttctgaaaaggggcacataggggcctggnagcaggtgggggtggtagctggggcaggtcacacactganatcnttctcatcgcncgttttgggaacagnttccattaatnggtnnccaggacntncntcntntncntcnttggcctcgctggcnttagagttggggacccagtaggccaganttaatgcagcgntgtatgtngtattttgcgtnggtggggtcnatnttgntgatggngttntgcagcatntnnacnttntttatatcgaagcacttttggagttcntcagggagggactcatagacctcgacggggtccaggccgccagggccgagccgcttcttgcgctcctcctcctcgtactccttcatggcctt

SEQ ID NO: 534116 - DNA, 954 bp, Homo sapiens
gctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggcaacctttctgaaagatgacgcttctgaatatcaagttgtctgctagatcatggttctgtattgaactaacaaggtttgccagcatctgctgacttatataaagctttctgattcctactaagctttcacagatctcaacacaacatgttcaatgtcgcaaatttctgtggaggctctataccagcttaggctttctggtgcagagagtgaggacagcattctttcctccactaagtttgtcttatcttgtcttctggatagatctgactcttaagagactaagggaattaaccaaactaacagattttaagtcatctggtggaacaacggacactttaacgattgtccagggctggccggggtgactcgcatctgtaatcccagcgctatgaacggccggcgcaggcggcaaccacttgacaggaagtaccgggaccaggcggggccacgcgtcggcgaaaccccctgtcctctaatcaaaaataccaaaacactcgtcacagctctgcgcaccattaataccactcaaaaacacgtcaaacacccgcactcctctaccgggcacaggacaccaacagtatgggacaatcaccaaaaagagacaacacgtgacaggcattcagctcgcggccctgaccccaccacaccgccacccctcacaccacactccaggcgcgactacagtgacggcacgcaccacccgggacgccacccacccacgggacagcacacaccatccgctcacaa

SEQ ID NO: 534117 - DNA, 983 bp, Homo sapiens
ggaaaactgctccccaccatcaccaccgcctctggcgccacccccatcttccacctgtgccctcaccaccacactacacagcacaccagccgctgcagggtcccatgggctgagtggggagccagttttcccctggcctcagttcccagaatcccccaccgacccacctcacacgcatacaacacaatgccctcctggacaagggctaaacatcaccacttagcctgaacaccttgcaaactgcttgagcgtccccacaatccccttgagtggtgggggacattatgcatcctcctgggggctttatggggatatgggggagccccatcatactgctcccttcaccttgttttccccatcctgtgtttcacccccaataagttggaggccttggcgaagaggtttccccgtgcgacctctacacaaagggtcggccccaaaggcccaagtcatcaaatccttggccaggcaccgtactccaacttgcccattgggaacgagcaagacagggtggtaggcccaaaatgggagtggagggatagctggcccccccacgggatttaccgccacatggcaagaactgtagtttgtcaaccaacgtagggagcgctccaccttttttcaatacctatcgccacaagttttccactatgtcccacgtaactaaaggctggaacacagcgcacccatttcggctccaaaggaaagggcaggcagggggtgaagtcccactaatgccctcttcacatgtgagcgacaggcccccctcgaacttccgcgcgggatctgacgtacatacttgcaggcgatgcagaacgacaagcagatattcgtcaacgagaaggccaaagaccccatgaggccgcacccctgcagctgggctagagatggagcccgcaaaaacgaataggcagccgcaaacacgacacatagcccgcgcacacaatggggacaaccaacaagggcaccggcggacacaccac

SEQ ID NO: 534118 - DNA, 175 bp, Homo sapiens
cactgggtcgtatctgtccctcataggatggtacaagcatatagtgcacagtggcccgtaatagcctgcagtctcgatcatttcccatactaggaactggtacaagatgcacgtcacaggctcagctcctaccccactagcatcttactctacctctcaagaaccagcgcagccc

SEQ ID NO: 534119 - DNA, 296 bp, Homo sapiens
atttggggggggattttttcaaatccccccggccctttttcctttttcctaaaacgggcccttttttggggggtccctattcccagcgggttgccttttaggaggttgccgaacccgtggggcccctaccctgtgggggggctttttgccggtccctcccccccctgggcccccccccttttttttttttttgaatggggctacccggtatacattcccccccccccccccccggggggttgtgggggtccaatggaattatgttccggggggatcccgtttttttgtttagggga

SEQ ID NO: 534120 - DNA, 670 bp, Homo sapiens
  misc_feature (492)..(492): n is a, c, g, or t
aaaggttaatgattcattgaatctcagcatgagaacagtggatgcatacacagaatgatgaatggtcaagtgagagttgttagggtaaaaactaaaaatagaactaccataccatacagcagttctttcgcctattcataaaatactaagcctttattgagttaggagagctcgttatgtaccgggttacaagacttttatcaaatatgatgtacaaatgtttcatcctattcagagggtgaccttgcaactatttgagagcaacttttaaagcatctggcctctcatgaaaactttgaggaaagctgcgtatcttttgtttggtgccacttagatgcagcgtctatattcattctgacaagaggaaggtgataacagacaaggacaaatgagagaatgacgacttcacggttcatattagtaaggcaattatctaccatatgaggtttcactatctggcttacattctgttagtgggctagaagccacgtnggcgacacatgcacgtcgtcacctatttcatctaccctgatggagcggaaactacagcacatgactaaaatcctcccagaagaaaccaactaaggttttaaccatggaaaatgttttgggatgcttagcacactaatcaagctgattggctacgttaattggttcattacaaaacaca

SEQ ID NO: 534121 - DNA, 435 bp, Homo sapiens
  misc_feature (430)..(430): n is a, c, g, or t
cactatcatcttctcaggtattcttctcttgctttgtggcaccactgctctttcccgcacgcacgtccaggacatcactgaaggaaagacacaggtttgctggcttcatctctgctgcgattgtgatgatcgccattccttgccctgtggaatcttctggaacccttgcatatatctcggtcttgtccagctgttgtaattgccaacctgaaacggatgtttatgcatgctctgtgacattcctcgtctgttgagaccgaataagattgatgcttttatctgggtttttaccgtgtatagtgtccaatcattctggggctggatctcggtttactagctggccttatatttggactgttgactgtggtcctgagagttcagtttccttcttggaatggccttggaagcatccctagcacagatatctacnaaagt

SEQ ID NO: 534122 - DNA, 339 bp, Homo sapiens
  misc_feature (169)..(169): n is a, c, g, or t
cctaaatgttaacatctaacattcacagagcagaattaccaaagctaagaaattaacattggtaccacactactaactaaattacaggctttattcagatttcagctgttttcccacaacacatcctataaaatattttaaaaacattaatttctccacgatgtcccanaactcacaaggttatagttaaacattttaattatatttcaaattaccactgtagctaggaaacaaaggagctaaagttcctatattttctattatctggcaaaacaaaaaggttggcttaagcaggaactttaaacacattcaaaaacccatttataagggtaagaacta

SEQ ID NO: 534123 - DNA, 407 bp, Homo sapiens
  misc_feature (14)..(14): n is a, c, g, or t
  misc_feature (35)..(35): n is a, c, g, or t
  misc_feature (44)..(44): n is a, c, g, or t
  misc_feature (79)..(79): n is a, c, g, or t
  misc_feature (82)..(82): n is a, c, g, or t
  misc_feature (87)..(87): n is a, c, g, or t
  misc_feature (89)..(89): n is a, c, g, or t
  misc_feature (91)..(91): n is a, c, g, or t
  misc_feature (93)..(94): n is a, c, g, or t
  misc_feature (113)..(113): n is a, c, g, or t
  misc_feature (137)..(137): n is a, c, g, or t
  misc_feature (165)..(165): n is a, c, g, or t
  misc_feature (167)..(167): n is a, c, g, or t
  misc_feature (182)..(182): n is a, c, g, or t
  misc_feature (184)..(184): n is a, c, g, or t
  misc_feature (189)..(190): n is a, c, g, or t
  misc_feature (194)..(194): n is a, c, g, or t
  misc_feature (198)..(198): n is a, c, g, or t
  misc_feature (200)..(200): n is a, c, g, or t
  misc_feature (237)..(237): n is a, c, g, or t
  misc_feature (249)..(249): n is a, c, g, or t
  misc_feature (251)..(251): n is a, c, g, or t
  misc_feature (275)..(275): n is a, c, g, or t
  misc_feature (306)..(306): n is a, c, g, or t
  misc_feature (313)..(313): n is a, c, g, or t
  misc_feature (325)..(325): n is a, c, g, or t
  misc_feature (341)..(341): n is a, c, g, or t
  misc_feature (349)..(349): n is a, c, g, or t
  misc_feature (354)..(355): n is a, c, g, or t
  misc_feature (373)..(373): n is a, c, g, or t
  misc_feature (381)..(381): n is a, c, g, or t
  misc_feature (391)..(391): n is a, c, g, or t
  misc_feature (395)..(395): n is a, c, g, or t
  misc_feature (397)..(397): n is a, c, g, or t
  misc_feature (399)..(399): n is a, c, g, or t
  misc_feature (404)..(404): n is a, c, g, or t
aggagaagtccgcntctctgccgtggctctctgcnaggcagccnaatgctctgtgggagggactttgctgatttccccncgncccgncngngnnaaaatatataccccccggntgcagtcgaaaatgcgtcagtacntgtgaaacacagctgttcttctgttctncngacacgccgtccccngngccannccgnggcncntaagcacgagcagagtgcacagctgtccactgggccnttgtggtgtgancntcagatggtgaagcattctccccngtgtatgtcttgtatccgatatctaacgcantaaatgnctactttggttnctgcctgtaagttaancaccgttngaatnnggtttaattttttcccgncgaaaagnaataaaccgnttgngncngatangat

SEQ ID NO: 534124 - DNA, 90 bp, Homo sapiens
cgtggtcaggctggtgtgatgggattccctggaccacagatgtgtctgggagagcctggcaaggcattcctcatcaccatcgtgtttgca

SEQ ID NO: 534125 - DNA, 869 bp, Homo sapiens
cctgctctactttccgttataatcttactttcaacaaatgtaggtacctcctctaaaacttctcccgtgtctgtgacatgctctgctccaggaattcagaggcctccagtgactctgtcattgctccaggaccaccaggctcatactcgggttctggagactgatgtgtgtcttccccatgctcatacgtacacagactcttttcaaccacctaacggaccaacactgaaaaggtcaatgcctaaacatcactattaccctaatattatgagctatattaagagtcacaattcatcaacccaacatcatgcccaacacattaaccacacataagccatattaatgtctgtctcgccctcgggaggagggtagcgaagctccatactatcctcttatcaatatgcactcttcacggctatcagtggatctctccataataacgatccaagcttaccacccgatattcgcaatcgccacagtacggacgccgacctttctttacttacttcacatccgcagttgtaaccgatctactatcagaaaaaacgcgcaaggtatagcccgctctagaacgacgtcaaaaggcggtatcacgcaagagtatttgcgtcccgcccgtttcgtacactatcattccagcacatcgacacccgcaatagtacaaaccaacataatcgccgctcacaatagatcggcattccatgcctcacgctctctcgcttcgctccccagctcgcctggatgaattatgatccactccctactcgctgattggatagttatagatcccacgttgtcgttcacctatcagccccacacactaccatcaccatcgccacagtcaagtatattgactatttccccccctg

SEQ ID NO: 534126 - DNA, 1767 bp, Homo sapiens
tacctaagcgcagattaattggtgaaaaaattaactcttaagatggccattaataattaggaaagtttacagagtggtcttagtagaaaattcaagtcctcctaatttatttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagattggaggcataattttagtgattttcatacttttagctttcttcgcataaaagctaattgaaaccgtatatgtagtaaaattaaaggcagagctgttgcagttgaattggagagttagggcaaagaacacttattagcccacacttcccacctttctacaggtggtcctttcagagctcagcctgaaaacccactactgtgttatcgtgcgtcttttggggttagtggttcttttgagaatctgaaggaagctgtggactcttcctagaaaaaaaaaccacacatacacatacaatgttgcatgcagtttcaagggatttggacatattgaaacctatcacaggctgtaggttatggacctctgtgccatgagaaaattgatacattaaactaagaactttgtttttaacttaccaatcactactcagcacatcttatataagctgataatttgtgatggaaaaggtctgtagcatgtgatataaggtgaccttatgaatgcctctcttgctggtacattaagttgttttaatatatcatttggaggggactgaaatgttaggctcattacaagcttgatacagaaatatttctgaaggatttctaatcagaattgtaaaacaatgtgctatcatgaaatcgcagtcttcacctcatggttcatggaacatttggttagtcccataaaatcctatgcaaaacaaagtagttcaagaatttttaggtgggtagtcacatttataaggtattcctcttactctttgggctttttcagtctgatttatttaaattttcatttagttgttttacttttggactaaggtgcaatacagtagaagataacttcgttacatttatgttgtaggaaaactaaggtgctgtctcctcccccttcccttcccacaaaatctgtattccccctattgctgaaatgtaacagacactacaaattttgtattctttttttgttttttgttttgagacagggtctcactctgtcacccaggctggagggcagtggcgcttcacagctcactgcatcctcaaccttgggggctcacgcagtcctcccgcctcagcctcccaagtagctgggcatgcgccaccaagcccagctaattttgggtatcttatagtagagaatggggatttccgccatggttgcccaaggttggatgtggacattcctggggctcccagttactatgcccaggctccagcctcccaaagctggctgggcattacaggaacgttgaacccaaacgtcggcctgggccgcaaaactatggtcattactaattcaacaaatttcccgtctggattacgtaattaagcctttaattgggcaatttggaatcctggaaagcaaagatattaacattggccctataggggatcattacaaggccaaaattgttcataaaacaaggttatggggaatta

SEQ ID NO: 534127 - DNA, 1045 bp, Homo sapiens
tacctaagcgcagattaattggtgaaaaaattaactcttaagatggccattaataattaggaaagtttacagagtggtcttagtagaaaattcaagtcctcctaatttatttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagattggaggcataattttagtgattttcatacttttagctttcttcgcataaaagctaattgaaaccgtatatgtagtaaaattaaaggcagagctgttgcagttgaattggagagttagggcaaagaacacttattagcccacacttcccacctttctacaggtggtcctttcagagctcagcctgaaaacccactactgtgttatcgtgcgtcttttggggttagtggttcttttgagaatctgaaggaagctgtggactcttcctagaaaaaaaaaccacacatacacatacaatgttgcatgcagtttcaagggatttggacatattgaaacctatcacaggctgtaggttatggacctctgtgccatgagaaaattgatacattaaactaagaactttgtttttaacttaccaatcactactcagcacatcttatataagctgataatttgtgatggaaaaggtctgtagcatgtgatataaggtgaccttatgaatgcctctcttgctggtacattaagttgttttaatatatcatttggaggggactgaaatgttaggctcattacaagcttgatacagaaatatttctgaaggatttctaatcagaattgtaaaacaatgtgctatcatgggaccgcagttgaaagacgcatgcgtctttcaactgcggttgagtgcccacacagtcaagctttaaaggaaagtgtttgctgaaa

SEQ ID NO: 534128 - DNA, 310 bp, Homo sapiens
  misc_feature (99)..(99): n is a, c, g, or t
  misc_feature (161)..(161): n is a, c, g, or t
gaaacggctaccacatccaaggaaagctgaccaggcggcttgtgaacagtcagtgcgaatttgaaagaagaaaaccagatggaacaacgacgttggganttctcctacaatgggatccacaggatggagagccaggctactgccctgtgagactgggaatnacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaa

SEQ ID NO: 534129 - DNA, 886 bp, Homo sapiens
gtaccagctccttactgccctgcagacaagcgtgccgtgcgtgcttgtggcaagggaaggaagagctggttgatccacagatagctccttcctccccgcccttccttttgtttggaggtcccaggatctgtgtcacagacatctgggggaagaaacggagcaggaaactaccccgacagagttaagcaggaaacaacaacaaatcatgcaaaaaaccctgcaaaagaaaacgaacaggaaagccaaagtgccagcgtgcaaaagagggaggaaaaacgcccgtatggacgaattgaacgccagcaaacagaaggggaatttaaagacagaggctgcttcagtctctcgaagaatttcaacgaggaacatagactataggcatttaacgatgaagaaatgacaagggagggagatgaagatgcaaaggtgttggacgagatacagggggtctgagaaagaaccatttagggctctgattctaacccataggcatctcgggaccgtccttatcccatttaattaatttctcctgacaaatcacttacttttctgtcattaatgttgcaactgttacgttgtctgcacttctgatgaattcaatttgctaatcgttaatcccagtcactcgacggtgctgagatttacttatgactctggccgaccatctcatcgttgtgaccaatttattcatttaataagaggtgccatccattggtggaaaactgccctggatatcggaacggacaatacgggtggaccaaggatcctatttcgtgtacatgccccagatgggatcacatccacaggcagagacgcgactaatacccagaaggacctgagacatacaggaacaccccgaaaagattggtgttttcacccaaaaaca

SEQ ID NO: 534130 - DNA, 140 bp, Homo sapiens
agaagacttttaccagcgtctattggaacacttcatcaaactatcaaaagacgacgggcaaagatctaggacagacaatgagcatctcagacactcggcgcgaggatgaccaggccacacgggcccttctctcatagcaa

SEQ ID NO: 534131 - DNA, 197 bp, Homo sapiens
  misc_feature (190)..(190): n is a, c, g, or t
tgggtgctacgcgtatgatctcttcaaatttaagttcacatcctcagatccaggaaagcaccgcaatatcaagcagatacatgctgaaactaacctcagcccccatgtcaaaaacacagcgggcatcagagcattgcctgcagcgaaggtcttcaggatttcggtacagccgctttcctttacatggacnagctgac

SEQ ID NO: 534132 - DNA, 767 bp, Homo sapiens
cggcgcccttttggttttttttggggaatatatacttattgtattatcgtcattttgtgtttacactttgaaactctgggaattcaaaattaacatcctttgcgcgatggaccttctttattggaccacccagaaaagtgatttcgaacccttgttgttttcccacaatatgattctgagcctgctgcttgagtccaaagtgaaccctttatgagccggttgccatctcagtttgacgcggaaattctcgtgtgccccaacaattttcgctgtgtggaagcaccacagtccctcaagggtatggctatcgttgccaccaagctttgtcagagagtaagcgggttccccgtggggaaaccgcctatttggcgctatatatttattgtaggtgtaaagcggatcttattattgcgggagtatagtagtctttaaagggcccgagaatatatctccctctcttgtagcgcgctattaagagaacgaacctatgtctttcgccccccacttgagaaactcttattttttgtctcacccaatttgcctcgcgagtaacataagacccgcgggggatctatggggacttatatatccccttggcggaacaaagagattttactccaaacgtctttcgggatggagaaacaccgggggaggaaaaccaacaagaagagattatcactccggactgaggtcatattttgcccgaggacccccacgacaaacccagaatctttcccaaagttttccgcatttaaggcttggcccag

SEQ ID NO: 534133 - DNA, 995 bp, Homo sapiens
  misc_feature (532)..(532): n is a, c, g, or t
  misc_feature (995)..(995): n is a, c, g, or t
gaccattctccccgcgtgcggggctacgttgacatgtacctgttacgtgcctcaagaatgtaacatcccagggacttccctccattctcctggacgcggccaccggctgtaccccagtctgcaactcaatgttcttggtagacgtattgggggagccgagggagttctgctcatgatgtttgtgatacctgtgcatgagatagcacatcggctcgcatgcccgttagtacaagaggccgagatgacactctgtctgccgctcatcttccagtctagtctggcatggatagtctcctcaaaagacgatacactcgagctgctgtcctcgtcttcatcctatcatcgctcctcgcccgtgtttaccagtcagtggtcctatctcgcacttgtcccagagggaagacttccggacatacctttcagcatacagtatagtcctcgtagccagagtgcgacatgtctactaatgaagcagccaagcgcatttctctgcgcatgtcttattacattaatggctacacccagacattgntcgacagttactgtggagaattccatagcttcgccccggtttggattaggagacagacatagagagacgcagagatcacaagcatacacgcaaaagaatcaccgatgggacccctagattaaaacaggcacagcgcccggtcgggcaagctactgcctttggatgggagcgttgcgcgtgaacaaggaaaggagagcgaggcctagagagcagaaagcgagctccgacctgattcggtgttagcgttcccaggtgctgtgagtccgtttgcgtacccctcagaggtgtttctctgccgcgaagaaacgcgagtggcatgaggcatcttgccgcaagcggtactcccaccccttgtggagagtaggcaagcgcggcgttccctcaagatgtaaaggccccccaactgggcaccgggtaacaccatcccgtctggccttataagaagttggccgcacaaaggagn

SEQ ID NO: 534134 - DNA, 220 bp, Homo sapiens
acggctctctcggttggggcaggaccctcatccctctcaagtctcagtggtgggggtggacaggactcatctctgggtccgctggccaccggcacctcttcactggttcccggtttggctgccattttctcacactctttcctgatcgatgccgtcatggccccacccccattctctcttcaacatagtccaatttctaccgtccccacagagagagcgt

SEQ ID NO: 534135 - DNA, 282 bp, Homo sapiens
ttcgtcggagactctccagatcgattggtgcactctcttttgtcgtagtttggcggtctggctactaagggcctgcgtgttgttgtcctactgttacaaccattctaaatcccctgcgggcactttactgacatcgatggctcatttgaagctgctgaaacgttcagtagaagctgctatgaggtctcgtaaacagggtcttgactatgttcacaatctgagggtggcagaagtgctcaatgaccctgagaacatggagaagcgccggagccgtgagagcct

SEQ ID NO: 534136 - DNA, 1490 bp, Homo sapiens
ggagagaactagtctcgagtttatgttttgtattgttgtttgctctctctccccgtcggcccaagatgcacgtacagaggacacaaggctcatagggaaaataacgtgtgggcttcggagagcagcagcgttctcgaggaaatacacacacaggataggtctacagaaagaggtggtgaaatcctcattgtgttgtgacaacaaggtgcttaagaacacttagcgcgagtatgtgcggaccagggaccattcgcagagccctaaagaagagagaacatctccatcgcctggagttggtctgaacaagtgggacccgcgattgattatctcgaggttgtagcatagtagactaggtagagagcgcaactcgcgtcttcattaaacggcgtgctttgcaaataggtgtggcacttcgcgtgaggacacattttaacacaagtgtgacgaacgcgcaaggggagccgcgtggtcatcactggacgaaaaccaagttggtactactcacgttgtgtagtatacaagcctgtggtgcctcccgaaaaagtctcaacaggaacccccaagaagaacacagaaagcgcagaacgcgagcagagacgaaaccacggaaacaacaagcgtgggtgagaccacccgggagggggcccgcgcagaaaaaacagcgggggcgatgccgatgcgcacaaagagggcgggaaaacgggtcccccaagacgggaaacaaagaaccccacccgtggccccctatccggagcgccagggaaaatttaagaccaccggtctagacgagcccctttggagtgttgtgaaacccagcacatagagaagagacgtttcctagccgtgtgtgtgagcaagacattggtggaccaggaagaaagcggtgtaggaaattcccccaagcgtagaagcctgtgcgaaatgtgtgtccttacttgggacaatgtggcacccctgttagtgtactcggaataaaccatgtggggtggcaccccgatataccggtgcccattttatccaggtgacaaacggtagccccagcagtgtggagacacgtttattactctccacgagaacaacggactacttgcaacccatgtgtctccgaccttacgcaacacaggtgtgcacccctccggaaacacaccaccgggggcgcgtctgtgtattaaaccccttgtggtgcacaggctttctcacagggaccaagattcacaacgaggtcagatgtccaataataattccggggctccacatggccatagccaatgtccgctgggcctacctaagcgtgtggggcccctatactgccagcgcctataatagggaaggcttataacaatttccgtaaagcgggttaaagatccaacggagaaactcgctcgacgacacttgagacctaacagaaacgctagcgtaacacatgtgtacgccaatcaataaacaagaatctttgtcgcggcgaaacctcacacgcgtgctccatacta

SEQ ID NO: 534137 - DNA, 128 bp, Homo sapiens
cggtttacggatggctgactgtggtcatatcttccacgataccaaagttgtcatggataccttggccagggtgctaagcagttggatggtgcaggaggcattgctgatgatcctgttggctggcgaca

SEQ ID NO: 534138 - DNA, 138 bp, Homo sapiens
cgtgcgtcaagaagcttagtatactagtaaccagaattacaggtgcccgccacacgcctgacttatttttagtagagatggggtttcaccacatgggccaggctagtctcaaactcctgacctcacgtgatccacccc

SEQ ID NO: 534139 - DNA, 554 bp, Homo sapiens
gaccatagaatgaaatgggttgtgcaatgcatcatgactgaagcccatgcgctaccaccgactttacagcgggactggctccccattccatgtgactagtcttagattgacgagtcctgttcactaacaagtgtcggatcttttcagaccctacatcaaggaggtgtgacgagaacggccgaacccaccccgtggtctccaagatgacctttggggacacctgatgtacgacatccaatagtagcatgcggctgtgcgtacatggcgtctgtattctcagccagagtgagccgtcgatgggactgggtaagccacgacaagcaccgtctgccatggactgatgcctgacaagaagatggccgtctgcggatcttggcctctgaaacagttagcacttgactgggtgcttgaccattcagtcacagacaagcagaccgtggtggcagcggggcaccagacatggcttacccggtgctgtacaccgtatgactccgcacgtcgggtgaatgcctgaagcttctagtcgggcggatggacgataccgtaagtcagag

SEQ ID NO: 534140 - DNA, 481 bp, Homo sapiens
  misc_feature (151)..(151): n is a, c, g, or t
atgaagccccagactccctagctggggagctgggtccctcagggtcacctaaccagaatcccagcttccactgcggccttcccccaacccactgcctcaccagccatgcttaacttctgcccattcctctgggtggtgtgactcagtttcncagggttatagatccctttggggccacagatgtggaagactcccagattaacagttgccaacttgagtctggaggactcacccccggagtcataggctgctttgtggggtggggagtctaaggccagatccccacacccagagaagcccccttccacctgtttgtccttttgaggggagacttaagtagtttgaaaagctgtgatcctctttggctgggcgcagtggctcacgcctgtaatcccagcactttgggaggccaagatgggttgatcacttgaggctaggagtttgagaccagcctcgtcaacatagtgagatcccatctcta

SEQ ID NO: 534141 - DNA, 802 bp, Homo sapiens
tgatacagccgtgttggcgtgtcccagagtcatctgatgggacatggcagtgggtgcaagtgaaaatatagggtactcaacctaagtgcggttccgatgaattcttatcccctgtcccttcctttaaaaaacttagtgacaaaatagacaatttagcacatctggctatgtaattcttgctaatgtagtatttagagaagtgtggacagggagtgtggcaagagtgtggaggctgacgtgtgagggaggacaggcgggaggaggtgtgaggaggaggctcccgaggggaaggggcggtgcccacgaccggtgacaggccgcagctccatttcttatgcgctgtaacgtgacttccaggcacggtttggaaagtattcacatcgctgtctgtgtatctctttcacatcgtgtgctgctatgggaggatcaggcccggtgttacaaggtcatatactgccagtgtactagtgccagttcactcttagaacatgtgtattacagatgcctttttggtagttaagcgccgccatgtgatcaagtgtgactcaatggatgctggtcgtattccgaaaaagggttgcgtgtttgcacaaaaagctcagtgcttcagttaggcaagggggtcaccaggggggcaggatacaagccggatagccggcggcagacaacgcgggcgcgatcccacaaggcgggggaggccggcccaatggtggagttgtgttaaaaacgcgccgggtccgaagaccaggagggccccttttatccagggcgcgtgaagggggaacacacggaagggggagaa

SEQ ID NO: 534142 - DNA, 248 bp, Homo sapiens
ttattactagggccactttcaatcttaaaagtgtcatagtttggacgacgtattatgtggttacctgttaatgaggcttggaaaatgtaaaagtaggttcaagaccaaataaggagaggaaagcaaagttgttttgtacaataaagtgaggagagttgagttggggtagggtggagggggcaagggagataagaggaaagttttgagggggaaaaggggctaaaattatggagatgtaaaaggctttc

SEQ ID NO: 534143 - DNA, 94 bp, Homo sapiens
tcgtagatcttaatgtttttgatcgttgcgttaaagtggattgtgtcacccacagtgaaaccagatcccattaataaatatgcttattggctta

SEQ ID NO: 534144 - DNA, 373 bp, Homo sapiens
tgatccactggccgtcgttctccacccaggaaccagcatataacgatgctaccgcatcaaagggcgggcgattggatgtcgggaaacacttctcaacggaagacatgtattcggggacgagagaacatgaaggaatgcacatcatcactggccatcagacaatatgcgggtcagaaccacagtgagatgccatctcacaccagtgagaatggcaatcattaagaagtcaggaaacaacaggtgctggagaggatgtggagaaagtaggaacacttttacactgttggtgggactgtcaactagttcaaccattgtggaagtcagtgtggcgattcctcagggatctggaactggaaataccatttcacccacc

SEQ ID NO: 534145 - DNA, 120 bp, Homo sapiens
ttggtcacgagtccctgtcgtttcccaatgtcctaacttaggaagaacctttacgcgtgacatgagaggtgctgaagttgtccttgcaaaagggtgttgggatcagtccgttcgcatgtt

SEQ ID NO: 534146 - DNA, 101 bp, Homo sapiens
ggcgtggcagaggcagaagcaaattgcatatgagtagactgcacgggtcaaacccatgtagtgcaaggtcagttgtattacttggggatactttttaaagt

SEQ ID NO: 534147 - DNA, 133 bp, Homo sapiens
ctggcttgtttttttttgggccccggttgggaccaggctcctgggggtgagggtctgtttgagtctgtttttgctgctttagcaaaatccctaaaacggggtaagttataataaacaaaaatgtattggctca

SEQ ID NO: 534148 - DNA, 342 bp, Homo sapiens
caagcgaagatgcggcaaccgtagtagattctcatttccagttggcacgtatattctggtgaaccaaatatgttcacacatggtgattactacttaaaaaagaaatcaggagttcccattgtggctcagcggttaatgaacctgactggcattcatgaggacgcagttcaatccctggccttgctcagtgggttaaggatccggcgttgctgtaagctgtggtgtaggctgcagacacagcttggatcccgcattgctgtggtgtaggacggtgactacagctccgattggacccctagcttaggaacctccacatgccacaagagcagccccgcatgttcg

SEQ ID NO: 534149 - DNA, 265 bp, Homo sapiens
tctgtaataagagagctgacaagctatgaattactctgcgaacaaaactgtattatgtgagctaatacatttagtagggattctcaaacgtgcgacgacgaagagacgcacatttttcttctcattattccagatacaggttgagaggagaacatagggaggcatggacgatttctaagcagtcgactgtaaaatcctatggtctctgaagccttcatatgtcactcagtagaacaatgaggccagtacgtctactctctgggat

SEQ ID NO: 534150 - DNA, 292 bp, Homo sapiens
aggacctgaagctgggattacaagtgtccgccagtacacttggctaatttttgtagttttagtagagatggggtttaccatgttgggcaggctggtcttgaactcccgacctcaggtgatccgccagcctcggcttcccaaagtgctgggattacaggcaggagccactgtgtccagcctatttacttagttatttaaaagtaaaacattttttaaaaaggtaagcagttttccaacactgtcactccacaagtgttttaagtgacagatcattgcagtgtgtctcccgata

SEQ ID NO: 534151 - DNA, 179 bp, Homo sapiens
gatcactcccattccgatagatcgcttccacccttacgtaccaatcgaagacgccctcggttattctcttccttctctccttaatgacattaacactattctcaccagacctcctaggcgacccagacaattataccctagccaaccccttaaacacccctccccggataatgtgatag

SEQ ID NO: 534152 - DNA, 435 bp, Homo sapiens
  misc_feature (378)..(378): n is a, c, g, or t
  misc_feature (387)..(387): n is a, c, g, or t
cctagaaccaggtataggttactaaatattgtcaggaaaaaaaaaaaaagaggccaggcatggtggctcacgcctatggtcccagtactttggggggctgaggcaggtggatcatctgaggtcgggagttcgagaccagcctggccagcatggtgaaaccctgtctctactaaaaatacagaaaattagctgtgtgtggtggcgcgcgcctgtaatcccagcaggaggctgaagcacaagaatcacttgaacctggggaggtggaatttgcagtaagccaggatcacgccactgcactccagcctggggcgaccagagtgagactccatctccaaccaaccaaccaaccgaccccacttcttccatgcttcttcagantacatttgncattttttgggatgggaggggcaaggtttttttagttgggccctttgg

SEQ ID NO: 534153 - DNA, 411 bp, Homo sapiens
  misc_feature (7)..(7): n is a, c, g, or t
caccctncagtcccaggagatctcctggcatccaccagggaaaagggacaaaagttgcccaggaacctccagattgaaggtcacattacctgagcatgcccagatgaaccaaggattcaaccatgggtggaacctaaggtctcaaactggggagcagggactgaatgaagacgcagaccctgaatggcaagatacagaatccaatcagatggagccctggtgtcacctcatggcaggatctagtcagatcatgcgtccctggcagcacttcatcggaagactcaatcagatcatggctcattactgtacgcctataaagcctgacccagtccccagctcaggaagacagattggagcatttcctcctgtctccttgacaattagctagaaataaagcctttcttttctcaa

SEQ ID NO: 534154 - DNA, 358 bp, Homo sapiens
atagacacagatcttaggcgagagactgtcgggttgggtgcatagtgaactaggctgctgggtagagtcacagaaattaatgcccattacagcagtggcagattctccaggtgcagggactcaattacgggaaattcttgtgatgctgatgccagaaggcagtttgcgagtgcccacatgcaggcccttgatggcgcgtatcacgagctgtcgcagaactgcctgtgcaccgggcggcatgtgcggatccccgcacacacggttgccgcgctgacgcgtgtagtccacagccagcccctcgccagcccacccggcgcacccgcctccagcccgaccaaaacccgatactgcactcagc

SEQ ID NO: 534155 - DNA, 119 bp, Homo sapiens
gcccgtattgattaacacaccacaatactataaatggaaaagataatgtttgttacaggagtgcacgcaaattatagagagtgtctcaggtagtgtggctcactggcagctcgcccctg

SEQ ID NO: 534156 - DNA, 291 bp, Homo sapiens
agaatgacgtgaacccgggaggcagagcttgcaggtgagccgagatcgtgccactgcactccagcctgggagacagagcgagactccgttaaaaaaaaaaaaggtttctggagggaacgagtacggtatgtccagttacgggttccggggtaagcggaaataatcctttaagaaagcaataggggtcataaacatgtttgggacttctgggactccagcctgggagtcagggctggctcaataatatcaagggccctggcctctaatgtcatttccggggtaccggagctc

SEQ ID NO: 534157 - DNA, 518 bp, Homo sapiens
  misc_feature (399)..(399): n is a, c, g, or t
  misc_feature (458)..(458): n is a, c, g, or t
  misc_feature (500)..(500): n is a, c, g, or t
  misc_feature (517)..(517): n is a, c, g, or t
ctcttaacaccaaggagctgaaattcttggctgggtgcagtggctcgcacctgtaatcccagcactttgggaggccaaggcaggtggatcacctgaggccaggagttcaagactagcctgaccaacatggtgaaaccccctctctactaaaaatacaaaattagccaggcacggtggcgggtgcatgtaatcccagctactagggaggctgagccaggagaatcgcttgaacccgggaggtggagattgcagtgagttgggatcttgccattgcactccagcctgggcaccaagagcgaaactctgtctcaaaaaaaaaagctgaaattctcaaattgggtaaacatagttcacccttgtcttctggcccatttgcagttaaaatgccacagcctgggngttcaatttccctttcctaaatgggggttggtgcttgctgttagtgttcaggtgataanttttcattctagtgacttgacagttttcccaaaagggctttnttctttgctcaggaaant

SEQ ID NO: 534158 - DNA, 107 bp, Homo sapiens
agtgctttgtccttgcctggtacctggtggaggaaatgaagaagcgggaagggtttgagctagtcatggagcctgagtttgtcaatgtgtgtttctggttcgtaccg

SEQ ID NO: 534159 - DNA, 601 bp, Homo sapiens
gcggtggcaaatgcaaatataaaataaaaaatacctcagctgtacatgaattaatgaaagtgttgaatttaaagaagtccatttatagtattactagatgataaagtatggtatgtctaggaagccagatatacatgaacaggagagaggggtagagaattcatagaatctaaaattgcaagaaacaaacatataatatagaagagacagagatgaatagagaatcctaatctcggggtacgaagacatcccacagattattcagtccagaaaaccaagtcctgaacatcgtaaactataaaggctaggattatagatgataactgtacctctcataccaactatgggtagcagggccatagaacctgctgtccttgaccttatttaaacgaaatgatgcagtgctagggcgtggtgactcaggccagtaatctcagccctttgctaggccgagccgagagaatcacttgagcccaaggagttcgagaccacctggtcaacaaagtgagaccctgtatctacgatacataaaatcaatcaaatgaatcagccaggtgggggggcacatgtctggagtccagctgcgcagaagtctgagacg

SEQ ID NO: 534160 - DNA, 162 bp, Homo sapiens
cggtggcggaccggaggcaagcaggggttcggcggcattacctgtacccattcaaccggcggctaccggcggcggcgcgcagggttcaagcggagagacccgccggcaagttttacaactgaggaacaaggttcaagaaactaatcacaggccaagtgccta

SEQ ID NO: 534161 - DNA, 1223 bp, Homo sapiens
gcagtgtctaatgattccatcacaaatttgttataaagccaaactcccattgaaagtgtcactttatacttaataggaaatcgttatgattaaagcatcaaggaagcaaatataaagtttaatgaaaatccaaggggaagttctaaattgcaaaacttggcacttatctacagtattttgaaaaataacaccaccggtattcaaacctacctaggaatatctcaaaataacctgttaattaagtgttcttagaaaggggagtgggggcaagaaagatgatgtatgcacatggcgaaaagatcagatggtacagaaaggtataaaaacttggtcccttccctcctaccctaatactcctctccaaaagtaaccagtttcaagtgtcttgtactcacaggaaaacaattttttattttttatcagcaaatttgtactttaaaaatttcacattaatagaatcagactatatatactcttctgtaccttgctttttttgctacctgtgttttatgagatctttctgtatcagtatatataaaaatacctcattatttttagcggctgtgtggtattctaatgtttgaatgtgttacaaatgttcaaacactgataggctctttaggttgtttccaatattaaatcacattgtggtgaatatacttgtacatataatgagtttttattctacagtgtacctagcaatacaattgctggatcagagggtattttttattttcagttcagtagttactgccaaattgtcctctagaaatctttgcccagtatgcttccacatataatgtatgagaatgattatttaccaaacccatgccaatactgggtactaaacttttgaagtctgatcatgtgaaagtgaataaatggtatcttgcgttttaatgaagttctaatgcattttaatgaaggtctggtacattttaatgaaggagatggaacacattttcatgtttattgattactgatatttcctgtgaaatgtgtagtcatgttctgttttctattaggtggtatgtgttttattgatttgtatgagctttttgtaagctaagaaaattggtccattgtcatgtttaataatattttcctaagttttatttatgtagttaaacttagtctttacagcttctgagattttgccttgcttagaaaggccacctttgcatttaagaataaatttaatgtatttttccagtaaaaaaaaa

SEQ ID NO: 534162 - DNA, 101 bp, Homo sapiens
ggatccccatggccaatactcctacatcaggaagtcgattgtcttactccaacagattatgatgtttcatgtcgtgctggctgaaaaccctgtgacttatg

SEQ ID NO: 534163 - DNA, 520 bp, Homo sapiens
  misc_feature (5)..(5): n is a, c, g, or t
  misc_feature (86)..(86): n is a, c, g, or t
  misc_feature (91)..(91): n is a, c, g, or t
  misc_feature (104)..(104): n is a, c, g, or t
  misc_feature (119)..(119): n is a, c, g, or t
  misc_feature (121)..(121): n is a, c, g, or t
  misc_feature (132)..(132): n is a, c, g, or t
  misc_feature (136)..(136): n is a, c, g, or t
  misc_feature (169)..(169): n is a, c, g, or t
  misc_feature (171)..(171): n is a, c, g, or t
  misc_feature (179)..(179): n is a, c, g, or t
  misc_feature (186)..(186): n is a, c, g, or t
  misc_feature (190)..(190): n is a, c, g, or t
  misc_feature (201)..(201): n is a, c, g, or t
  misc_feature (229)..(229): n is a, c, g, or t
  misc_feature (266)..(266): n is a, c, g, or t
  misc_feature (281)..(281): n is a, c, g, or t
  misc_feature (287)..(287): n is a, c, g, or t
  misc_feature (298)..(298): n is a, c, g, or t
  misc_feature (312)..(312): n is a, c, g, or t
  misc_feature (343)..(343): n is a, c, g, or t
  misc_feature (352)..(352): n is a, c, g, or t
  misc_feature (362)..(362): n is a, c, g, or t
  misc_feature (375)..(375): n is a, c, g, or t
  misc_feature (384)..(384): n is a, c, g, or t
  misc_feature (396)..(396): n is a, c, g, or t
  misc_feature (404)..(404): n is a, c, g, or t
  misc_feature (413)..(413): n is a, c, g, or t
  misc_feature (418)..(418): n is a, c, g, or t
  misc_feature (420)..(420): n is a, c, g, or t
  misc_feature (424)..(424): n is a, c, g, or t
aatcnctgaactgtgtaatgtgtctagagtaagcaaatactgctaacaattaactcataccttgggtcccctcaagtattaccccnatagnattcccccccatngccgtccccatctgngnattttaataangatnttaggatggagcagaacatggagaggaagattncnttttaagntcctccntttntttgaaatacnataatttatatagaaatgtgtagcagcnaattatattggggattagaattttgaattaatagctntcctactattaattnacatgngctttttgtgnggcgctataagtgnctatggttgtaaagtaataaaattgatgttnacatgcccnattattgttnttttatgaatccnatgaatttnaaactattgttnaatataanactgccccnctttnanatangtaagcaacttcctacttaaacccgacgtgttccttaaacatgttttaaaggtgaattttttaaagttttccataaaagtagggggttccacagga

SEQ ID NO: 534164 - DNA, 929 bp, Homo sapiens
aaacaactaaaattccgctatattagaaaaatagagaagacctaatgggcaacaactctatgcattttccaccgctacacgaggatttgacagctaaggatattgaagaaatttttgatagagctcaaagctggcacaatcccaaaacctgggccaaggagtggacactgttctagagagccaactggaggacttacctctttgactgaaccacccaagggacctgaatttgaagtacaaacacgctttttatttatatggaactgagaatatatcaatataaaaattaagtatgtgcttacgatgtacggttaaattaatacaaaaaaaatatataaagtagatatacaagaataaatatcaagatactattcgattctgattaaaggaggggaaaattatagaccaagaatgcactgatagagatttaaaatgcatattcaataggaatactagaccctaaacaactaaataaagcgataacttgtgtttctctaactccggaagataaagaaaacaaagaactgtgagcataatgaagtccaattaagcacaaatatcacaagacgcacatgatgtaattgtaaccactaagaatctatacccccattgattatgtgagatgacaccttcacagcgcaaatatctaaataaattcttgtatttaatgtaatttcaggtatcattacgttgtaaataatatattagcacgagagcttgaacgtacaaagcaatttcacgagtgaagtcagaatactagcataagacacataagataatgcatgacattattctgtcagtgcacgaggcgtattaatatatagagactagtaagatgacaagagctccagattagacgtctcgattcatacataaggtcagccattcgcaattaccaccaaaaaaatatagaaaatgcatcacagcga

SEQ ID NO: 534165 - DNA, 838 bp, Homo sapiens
ggtgtctgtccctttacttctgaccaggagtactttctctttcccatgtaacgtattctactttccctgagacaggaacgcctcctttgtgtgtatccagaggcagtgatgactatgcgtgtgccatgacagcctccgcgtcgcgtggcatcgacacgaaagtgtctcgaaggtgtctagcttggaacacagctgtcgttgcgtctctgtatgaagacgtatgatgctaagcgtgtcgcacctttgcactgtggccgtccgatagatgtctccacctagcacccctgtgctcccctgacacactgatggctcaagacaaggctggcagataccctcccatgaatacatctcgtggccgcagaagagcctcgtctctccctcgcctctctcgatgatggcacaagccaagccaaggcgctcacgttgagccagtgggccagccacagagcaaaagagggttcatttgtcagtcccctctctctgggtcagaaccatgagggcatgctgaatgccccctgcttacttggtgagggtgccccgcctgagtcagtgctctcagctggcagttgcaatgcttgtagaagtacggaggaacacagttctcactgggaagagtcaagtggcaagaacccaagtgcctcagctcgaaatggaggccctgttccctggagtcagggtgaacttgaaagcttatggctgagacctgggatatgagataccacaaacacctgctgaacaacagtgtctgttcagcaaactaagcagcattccctacatgcctagggcatgacaatagtatagaagtctgggaaacaaacagagacagcaatttgagaag

SEQ ID NO: 534166 - DNA, 168 bp, Homo sapiens
aggcggacatgctgctcatactataataccagaactttgggaggcgaggcaggtggatcatttgagctcaggaattcaagaccagcctgggtaatatggcaagagccaactctactaaaaatacaaaaagaaaagaaaacagccaagcttggtgggtcctgcctgggt

SEQ ID NO: 534167 - DNA, 239 bp, Homo sapiens
gtggggggtggggcttgttcccctgcagtatctgttctgtgaagtttgttaaatgtaagggaagcttaaattcttgtttctttaaaagagcaaatcttatttaacccttgcgtgttctagatttacttacacacctggcctggacccctgttttagttttaacattgcgaaaatagtaaaagaatcttgtaactttattcttttttctcctgctgaaaaaaatatttaaaccattcgta

SEQ ID NO: 534168 - DNA, 879 bp, Homo sapiens
  misc_feature (59)..(59): n is a, c, g, or t
tctgctgaggagcgggcaccgttttctgagggaaagtcgccgtaaaaaccttcccttcntggggggtatagacaacgtgtttccccgccgggggtacacgtgggtggcgtgcacacctgcgaacaagcaggggacccctgtgtctcccctcgcgaacggggttttcatcatggtgccgggcttacaggttcccccaggcggccaattagcgccccgtctttttcatgttgggcagtagaggctcaccacctgcgttgtctctagtagatgtccgtcgtcctttcccctcaccgaaacggtgctttctgcctctttgtggaaaacttggaacctactgtcgtttgtacagagcaccaccgccttataggcccccttcaaggcccccccccctttaataagcgccctttaaaaagggtctccccaggatataatgcccccttccaatcactcctcactctccaagcccgacatcaaccagaccacaacgatgtgtagagacctagtattgcaccaataaagccatcagggaacataaattttgttcattaatcatcaaaacaggcagaatttcggcagaatataaatatcctactctaacaaataacatcataaaactcatcatatttcgcgtatatagattcttgtacacccccgtttcacactacgagcgtagtaacgatgtccccgtctaccccactcacccacaaactgtcagtattcgcctacagcccccaacctatatgatcatgagaacaaaatcctctttcctcagaaatgcccaccataattctctatgtctaagcttgaccagggaaaaactcccatccatcagcaaccctttttcggacgggaatcccaaaattttcttccacaaataac

SEQ ID NO: 534169 - DNA, 349 bp, Homo sapiens
tgggccgctccccttggaggccctgctcaggaggccctgaccgtggaaggggagaggaacttgaaagcccagctcctcccccagcccttggggccattttttcctgcagtcccctgggccccagttaaaggggcaggggcagggccggcagtaggtggggcctgtggtcccccccctgccctgagggccttaactggtctaactgcccggaggcccccggccctgggccttaggcccccccagggcttttttgctattttctgctcttattgttaaggataataattaagggtcctatgaataattaatgaagatgctgatggctatgaataataaataattttcctga

SEQ ID NO: 534170 - DNA, 104 bp, Homo sapiens
aacttgtggggctggctcagcccgaaggcgggcgagcgcgaggatgctgaccgggcttcacccaagggtacagacgcttagctggttcatactcatagcatgct

SEQ ID NO: 534171 - DNA, 496 bp, Homo sapiens
  misc_feature (468)..(468): n is a, c, g, or t
ttcagacgagccttaaaaatcaaagactttgccaataccatgcctggccatggaggcatcatggatcgctttgactgccactaactgatggccacctttgacaatgtatacatcgccagttttatcagaggccctaacccaagcaaactgattcagcagttgctgactttacggccagatcagcagctccacatcttcaacacgctgcggcctaatctgatcgacaaagggatgctgacatgcaccacagaggactagtagggtccacccaggtccaggagaacaggaacagaactgagcaggggcaggactccaaggcaagcacagctggtgagacttagacaatgacgaggctttaactcactgacttttttatttttttttgaagggaattaaatatttgagggtccaaaaagattgtatatacagactatgagtttagaaatcgcgctgaaagttaacaacagntttgagttggaaagaaaatttttttaca

SEQ ID NO: 534172 - DNA, 274 bp, Homo sapiens
cctggtaccctccgggtttcgggatctgccgcgccgctgcggctctggtcccgcgcccgccatggcccgtctgactggagagctgaggcgcgccgtgctagcagcttgcagctcctgcagccgcgtgccctcgccctgtgggcatgcagcgggcccgagccccccggggggcagccctgacggcatgaatggacctggacgccatcaaactcttcgtgggccagatcccccggcacctggacgagaatggacctcaagccgctcttcgagcagt

SEQ ID NO: 534173 - DNA, 572 bp, Homo sapiens
tggaaaaagtcatggaggccatggggttggcttgaaaccagcttgggggggttcgattccttccttatttggtctaaaattttatgtatacgggttcttcgaatgtgtaggtagggtggggggcatccatatagtcactccaggtttatggcagggttcttctactattaggacttttccgcttcagaacgcgaaggcttctcaaatcatggacaattattcaatattactggctggttcagacgaaatggaatggacgcctacacgatgatcagcgattgttccatcgtggtcgtaatcgcatcgggggttatgctccgagtaacgctcgggcgcattccggcataggccgataaaacgtgtatcgtgcggaagacagagttcagattttacgccgcatgcacatactcgatagctgacaatcggcttctggcccgttagcgtctgcggtactatgcggtgctacccttgaccacttagggggaacatccctctgaagtgaatgctctcctaataatgccacacttaccgttccctaattgcagaggaccattttgaaatttgattctacc

SEQ ID NO: 534174 - DNA, 890 bp, Homo sapiens
gactgcgcatgggatctccgttcacggtgacactctggctcccgggatacagtccgttcttgtgacatcagtggatccactgcaggtatggtgtgacatcacagtgatgtcctgccaaccgacaccgtgctatctaatgcgatacgatacttactgccagactgagtaccaaatggactcacatgtgcatatggtctagagagtcatgccaaacatggcttggcctgtactcatccactgggagtggtgcggcgtattactcagacacatggtgttggttcgattcgcacgaaaagtccttgtgttactaactgctaagagtatgctactactagcgctgtcgggtaatggacagactgcagtgctagtgctttgtctgctagcacatctccagaatctttattgactacttctacatcaaggttgattggatcgtagattcgtaaaacttgatgagggacccgctttttgtggatccttcccccgtgatctgtcagggattccctccgcattgccctgttgttgaccaattgagatgacctgacctcgtcctccttctactggtggactctgactctcttggccataggccactggcctgggcttgtcataccttgctttttgccctggactgctttcgtacgacgggccccccttgtcactcgatcggtgtacaccatcaattgaccctggggatgtatcgcgcgacttcaatgattcgttggacctgaacattggcccggaggatacccgattgtcatgcctgttcagaaaccaaccgcaaacattaaaccaagctggtcagcaccagaggccacttttggacaagacgtggccaccaacgttaaaaccttgcttgccaataatgagacaaccattgtttccaggaa

SEQ ID NO: 534175 - DNA, 284 bp, Homo sapiens
  misc_feature (7)..(7): n is a, c, g, or t
  misc_feature (49)..(49): n is a, c, g, or t
  misc_feature (111)..(111): n is a, c, g, or t
  misc_feature (194)..(194): n is a, c, g, or t
  misc_feature (233)..(233): n is a, c, g, or t
  misc_feature (269)..(269): n is a, c, g, or t
gattctnagttggcacaaatgccctgcctagcccccttaactgcgtcanttcacagatggagtgttttgttgttgttgttgttgttgttttaagaaagagttttgagtttnttgcccaggctgtagtgcagtggcacaatctcggctcactgcatcttccgcctctggggttcaagtgattctcctgcctcagnctcccgagcaacttagactacaggcatgcaccactacanccggctactttttgtatatttaagtagagggcgagngtttcacagtggttg

SEQ ID NO: 534176 - DNA, 193 bp, Homo sapiens
cggctgcttctctctcgcttcgggattcacgctcatcacggtcattcctggtctatgatggaaccgtatcttccactacgctcatgttcatacgttcactctattagtctgaacccatagtcccactgatagattgagcacacagttcctaaaggttcaaattttatttttttcccgaggaggagaagcatca

SEQ ID NO: 534177 - DNA, 627 bp, Homo sapiens
ggcggttcccagctgcgttggtgacatggcgacacccccagagatgcctggtgctcaatgcaggcgcctgcaatcacggaatcgatgaaggccccggtgggacttcgtgctacgtggggattgactccatcctggagcagatgcgccggaagtgcatgaatgcatgtggcttcggagttcaacatcatggtggtcgggcagagcggcttgggtaagatccaccttaatcaagacgcctcttcaagatccaaaatcagcgcggaaggtcggtgcaggcccacctcagagtgagctgcattccccaatgaccattctgagatcaaggtccatcactgcacgatattgacggaggaaaggcgtccgggatgaacgctgacaagtgattgtgacacatcgcagggtctgggggaccacatcgaacaagcgagaactgcctggctagcccatcgatgaagttcatcaattgaccagtacgagaaatacctgcaggaggaggtcaacatcaacctgcaagaagcgcatcccggacacccggcgtccactgctgccatctacttcatccccgcctagctggccactccctcaggcccctggacatcgagttatgagacgcctgagcaatggtgg

SEQ ID NO: 534178 - DNA, 635 bp, Homo sapiens
taaaggaagtaagcctttattccctgtgtttggcaaataaaacgggctaagtgggttgcttttgggtgattagtcaaagagaccaaactcccatatcctcgtccgactcctccgactcttccttggcttcaaccttagctgggggctgcagcagcagcaggagcagctgtggtgtgcagcagccacaggggcagcagccacaaaggcagatggatcagccaagaaggccttgaccttttcagcaagtgtggaagtgttgtaatccgtctccaaaagacaaggccaggactcgtatggtccccgtatgatgataggaatgggggtcactagatagcaacagtgggtgtagccaatctgcaaacagacactggcaacattgcgagaaaccctccaggaagcgaagaatcgcaagagttccctctgtgatatcaaagcactatcagggtatgtaaatcgctgcctttggtcagaacacctgctgtgattgaccacgcccaagaggaaaaggggagacagatgttagaagcattttcagcacctgtggtttccgctaggctcccattattgtcaccagtctagatcagctgcacatcacccaggattccaatggtcccctggaaattacgaggaatcca

SEQ ID NO: 534179 - DNA, 275 bp, Homo sapiens
gcagctatgtcaatataataacaatacggtattgtatacttcaagttgcccaagagggtagatgtagtgttctacctcacttatagggagatgatggtaacattgtgtggtgatagatatgttaatcgcttgattgtgatttcccacaatgtatgtgtctatcatacatcatgtagtgcagttaatataaatgtaagataatatctccggccacttatagagtgttgtgatttacagtgagatctcctcgtctgagggttaggttttagcctcca

SEQ ID NO: 534180 - DNA, 588 bp, Homo sapiens
gacaattggctagccatgggaagaagattgaaactgaaccccttccttacaccatatacaaaaatcaactcaagagagatcaaagatttcaatgtaaaaccccaaactgtaaaaaaccctggaagacaatctaggcaataccattctgggcacatgaatgggcaaagaggtcatgacaaagacaccaaaagcaatcgcaacaaaagaaaaagtcgacaaatgggatctaattaaaactaaagggcttctgcacagcaaaataaagtaccaatagaataaacagacaacctacagaatgggagaaaatgtttgcaaactatacatctgacaaaggtctacatgtggcaaataagcatatgaaaaaaatctatatcattgatcattagagaaatgcaaataaaaactacagtgagataccatctcacaccaatcaaaagactttcatttaaaagaaaaaaattaaccaataaattaataaataacacatgctgcgaggttgtggagaaaaaagagagcttatatgttggtggtgagaatataaattagttcaaccagtatgggaagcaaggtggtagtttctcaaggggc

SEQ ID NO: 534181 - DNA, 680 bp, Homo sapiens
  misc_feature (339)..(339): n is a, c, g, or t
  misc_feature (354)..(354): n is a, c, g, or t
  misc_feature (383)..(383): n is a, c, g, or t
  misc_feature (432)..(432): n is a, c, g, or t
  misc_feature (445)..(446): n is a, c, g, or t
  misc_feature (448)..(448): n is a, c, g, or t
  misc_feature (464)..(464): n is a, c, g, or t
cactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctntcgccccatcttctncaggctctatggggggcctggtgtccctnggggcagcagttgtggcactcaagcccgccaggggaccccagcaccggncccatcattgagnngntgattgaatggccctncgtgataagtcagctgtgactgtcatggctatgctatgggccttcttaaatgcttttatgatcctgcctttcagagatgaactttctcttcaaagcttgaactttctttccaagattacttgaagtcttttgacttttttgccgggagggctgatcaatcctttttgtttaaattaaaaagtctttaattatttaaacttgagttgtactttaact

SEQ ID NO: 534182 - DNA, 207 bp, Homo sapiens
ccccagggtcattacgttggctaagtggaagccgtctttccctaaagcctacggggggagcctcaggcaggtggtgctcccatctgtccgtccccagcaactgtggctgagctggtgccagcctgcagagccctgctccagggagcgttgggtggatgcgctgatagaacatcctaagcagtttcttgaaatgaataaagtactgtg

SEQ ID NO: 534183 - DNA, 104 bp, Homo sapiens
gatcccgatatacgtgtggaaagtaagtggaagttgttctgaaataagccccatggcaattattctgccactgcagacggagcagcggtcatttacttatacat

SEQ ID NO: 534184 - DNA, 267 bp, Homo sapiens
agctctggatcaagtggatctgatagatttctacagaactctccaccccaaaacaaacgaagatatattattctcattgccacgtggcacttactgtaaaattgatcatataatcagaaattaaacactcagcaaatgcaacataatagaaataacaacagtctctcaaagcccagaacaatcattagaattcaagattaaaaaactcactcaaaaggcaagctatccggttcaatacactgctgttggcccacattgaaccggata

SEQ ID NO: 534185 - DNA, 192 bp, Homo sapiens
caaaaaggggggggggaaggtttgtggttccccctggggggtttttcccccccccaaaccaaagggggggtttacccccttttgcgggggtttggtttttgggggggattttttgggggggggggttttttttttttaaacccccccgttttttggggggaagggccccttttttaataaaaaaacccccca

SEQ ID NO: 534186 - DNA, 1000 bp, Homo sapiens
  misc_feature (461)..(461): n is a, c, g, or t
caaccgttcctacgcctcattgtacccattctagtcgcagtggcattccgtaatgcttaccgaacgaaaaattctaggctatatacaactagcgcaaaggccccaacgtgtgtatggcccctacgggctactcacaacccttcgcgtgacggccataaagaactcttgcaccaaggagccccgtagaaacccgccacatctagccatcagccgtctacatcaccgccccgatcttagctactcgaccatgcgctctctctacgtatgaagccctctatctgcagtacagcaaagcgcagtggtgtccaacttcaccagccttatggccttacgctacatcatgatgtcataggccgccatgctggtgcacgagccacgtacttcatgcatcacagtgcggtacctgtcatcagggcatgtaggcaatgcagcatgttccagacgtaacggggcacgtgaanttcgggcgtacacatgtcaggacacaaagcaatgaaccccagacctgtaactactactcattcgcatatgctacgagcacacctaaggcgcgagtacgactatgcatgagctcaatcaagaccaagtataacggggaagagtaaggggtcggcgatcacccccttgaaatcacctgcatcgcgacttcggatgtgcaagcataaatgcgaagggagactagcctgccctgtgtttccctggcgttagctcaatgtccgttgaccccccatgggggggccccattctgggacactaggtgagcattgagtaggtcgtagggcaactgagtcctaagtggcaaagtgaagctagccacaaaggggcggggaaaacacgccctcgggtatcggtaaaaccccctctgacgcgtaagaagaggtgaggggaagcctgcgcggagaaactaaggagccccgacgaaggcacaatcaggcgaggacgcacaccgaaaaagataacgtgggccgatgaaccgggcgcacctttccggcccccgcgg

SEQ ID NO: 534187 - DNA, 561 bp, Homo sapiens
  misc_feature (153)..(153): n is a, c, g, or t
  misc_feature (236)..(236): n is a, c, g, or t
ccactcatgataagtgcagagacagtgtgaaggggatgtcccacttcattctataacagcacatgaaccgagaatccaataagaggggtcttctcatgtctctctcacccattcttcattatgagtccagttggtcctagagggtgcaggggncatctggacgtactgggctgggagtggggtgcagtgagtggcctcaaagttgtgcagatgttccgagccagaaacacagcagnttttcgcggacatctgcactcatgtcctaccccacgctccaggggaagtcgggcccgtgttctgcctggtaggagcggaggacagacagacaccagtcctcttccacctcccatcggctataaattgaggcttcctccagctgtgaggaggcctccaagcactgcctcaccactcgaagaccctcctctggcatcagccgggtataccgatgctgcaggagcttcagcaggaggtcatttgctcggtaggacatgatgtcctcaggaaccgtcgtggtgatgatctcatccttggatctccggatcagcagtacaggacctggta

SEQ ID NO: 534188 - DNA, 313 bp, Homo sapiens
gcagctgcatagagccacacagcaggaggtgagcggtgtcgagtgagggagtgagggaagcttcgtctgtatttacagccactcccctttgctcacattcccgcctgagctccaccttctcagatgagcagcagcattagatgctcataggagaacgcaccctgttgtgaaccgtgcatgtgagggatcgaggttgcgctgtccttatgagaatctaatacctattgatctgtcactttctcccatcacgctcaggtgggaccatccggttgcaggaaaacaagcttaacaacgcccactgattctacattat

SEQ ID NO: 534189 - DNA, 122 bp, Homo sapiens
tatgtcaacggtggctccagacagtccttgtaagtcccaaagagaggtcaatggagttcatggctgcaccagacagtggagttggggagttagaagcagccacgggactacgtgagtggctc

SEQ ID NO: 534190 - DNA, 123 bp, Homo sapiens
ttatggtctagaggatcccgcgcgggtccgttagagaataatgtaccacagtcagctggctgctcgtgcccagagtacaattcctgcatttttttaggggctatcatgatgacagaatcgtcg

SEQ ID NO: 534191 - DNA, 266 bp, Homo sapiens
ccggggtcctgcagatctctgctagggcagtgtggaagggagaagtggggttggagtcccacacaaagttgccactggagcattgcctagtggagctgtaagaacagtgccaccatcttccagaccccagaatgctaaatccacagacagcttgtactgtgcgcctggaaaagccacagacactcaaacgccagcctatgaaagcagccaggaggggggactgtaccctgaaaagccacaggagtacagcttcccaagactctgca

SEQ ID NO: 534192 - DNA, 225 bp, Homo sapiens
cacatcatctcaaacatagccagtagctttctgtgtaattacatacaagtgcacagtagaattaaactgcacgatttaggcctcatcgaaccattatgtatttatttatcttttaaaagggacacatcagacatgaatatttcaaactgtttcagtgcattggagagcaatcagcatttgcttctattgctcattttaacagttagcatatttcatcccaaaact

SEQ ID NO: 534193 - DNA, 707 bp, Homo sapiens
agcggctatttttgtattttatagtagagacggggtttccccatgttggtgaggctggtctcaaactcctgacatcaggtgatctgcccgcttcagccctcccaaatgcgtgggattacaggcgtgagccacctcgcctaggctagagctacttagattacagagtttttgtttcccaaacgtcctgttatcgacggtcctgtctataattaagttttatttaaataatatagcaacagtttgttacgcagaagagggaacaaactagtagtctgtacgtgtccagaggatagacggtacgaggtctacagtatctacgaaggttgaagagtgcacaatacatgcctcttcctctctgggagaatttgatgccgttgataaaataaaagcaacttcttcccttacaggtaactagcaaggatacaccactgatacactgtataccaagaagtgtaccacacacagtatgagaagggccagctgggcctgaatagttactgacttgactcttatcttaaccgactgatgtgtgactaagcattcccactgcaagcaatgcatagactacggaacgacacgatttcgctcttataatgagaaacagaacttcctacacggaacacgatccaagctcatgtaaccactgtctagctctcataacggacacattaactatattcacgacccagaccttgccctgtgtaccg

SEQ ID NO: 534194 - DNA, 286 bp, Homo sapiens
gatcataggagactctagatcatacaccgatagagaaatttctagtaagagtggtaagtagaagtaataagaaatattaaggtcttcagagaaatgtaaacaaatattctaaatgtgccctttaaatgtttttttaatgagaagagaatcaatttccaaagttttacatttgtttcattatatatgtcttaaatactcggcaaaagtaatatcaaccacaaggtacagatatggctcatttcatttcatggcactcagcagtagcccgggtaccgcagctcgcaat

SEQ ID NO: 534195 - DNA, 607 bp, Homo sapiens
cccgtcaccacgaggcccaggggcccgagtgccgagccctttgctccctcagacgcgcggggacagggctgctgagcagcctccggctctcccggctgtgggggccccactgagtatgtcggacgagagcgacatggacaaagccatcaaggaaacttccatttgagaagaatacagtatcaataggactcataagctgggagctggaattagtggtccaattagagtctgtgtaaagaaatctactgaagaacggttcgcgctgaaaattctaatggatcgatcagaagctagaaatgaggtacgtctgctcatgatgtgtgccacacacccatacataggtcagattattgaagtgtttgctaacagtgtacagattccccatgagtccagccctagggccagactcttaattgtactggagatgatggaagggggagagctatttacagatgcagccggaaccggacttatcacagaagcatgccagtcaataccactacacatagctctggctctgcagcactggtagtcatgggcacagatacctcaagcctgattgatttgccaagattgcccaagtgacttgatacaccctttacccttg

SEQ ID NO: 534196 - DNA, 575 bp, Homo sapiens
  misc_feature (55)..(55): n is a, c, g, or t
  misc_feature (63)..(63): n is a, c, g, or t
  misc_feature (99)..(99): n is a, c, g, or t
  misc_feature (203)..(203): n is a, c, g, or t
  misc_feature (206)..(206): n is a, c, g, or t
tatattttattcaactttattaaaaattaaaactacagaaaccaaaccgaatgcncaaataanagaggggggaaacagacagggagcaagggcagctgntaacgggggcgaggggataatccgcatgactcacatcccaccccggcgactgaggagcccaaaacgctgcgctggcactgtcgtgccctcttccaccacgaggngcncagaaacctgcaggagactgaaaacgattacaaacatcttcaaccagctctcgggccaaaggcagcaaagagcagccgtgaaatacgcaacttcagcgccaagaagggcagcagactctccggacatccagtgctaagaaggctaacacctaaaccacacgcaggcatccggaactcagcaggctctgatccagggtacggaggtggagacaaagcactcggagggggcaagatgttcagcaaccaagtaagacacacgggcaaggcattcccacccaaagggtgagaagcaccaaagcacggctgggacgaaccacaaccagctcagtgccagggtgcagccacgaccatccgggctataacgccctg

SEQ ID NO: 534197 - DNA, 249 bp, Homo sapiens
  misc_feature (217)..(217): n is a, c, g, or t
gcatagcagctacaccacagacttagactgctctgaaacctacacttcctgtgttttgcaacctgtctccaccagttgtgctgcctgtgtgatcttgggcagattcgcagaacttactcataacctcagtctctgtatttatacaatagggataatcattttgagctccttcgatagttaggagggttcaaacagagactgtatgttagcacatatnaaaagtgtcctctaggtcgacacgaatgttca

SEQ ID NO: 534198 - DNA, 320 bp, Homo sapiens
cttaatctttctgaagttcagtttccccattggaaaaattaaggctaggcacaatggctcacacctgtaattacagcactttgagaggttgaaggaggtgggtcagttgaccccaggagttcaagaccggcctgggcaacaaagtgagaccccccatctctacaaaaaaaatttaaaaattaggcacagtggaatgcacctgtagtcccagctacttgggaaaatcaggaagatcattcgagcccaggagttcaaggctgcagtgagctatggtcgtgccattgcattccagcctgggtgtcagagcaagattctgtctc

SEQ ID NO: 534199 - DNA, 381 bp, Homo sapiens
cggtgggtgtttttaaaaaagtgggcaaaaagggtttttgaggtgggaaggttcccaagttttccccaaaaagtcaaaagggttaattaatttttttccttaaacccgccccccccctttttaaaaaggggggaaaaacggtttcaaaacctttttttttcaatggcccctttaattttgtagttaaaaactgggttattataaccaaggcttgttaaacctttcaaaaaaaaaaaaaaatttttttgggcccccttggtttttttttttgggggggggaagttttaagttttagttttttaaaacagggcttttttaagggaaaaactttgcccaaaattttttccaaaattttttggcccctttaaaaagttttattta

SEQ ID NO: 534200 - DNA, 268 bp, Homo sapiens
gacggagtcagtcaggatgcaccttattcatcccagcacgaggcactgtacagacagggggagggggtcttgtctttttattttttttttaatttgaaacggctgaagaaaacattaggagaggcaaaaatatggttaaaaactagactctaaacaccccttccggctgtgaggatagtgggtgtgacaatggaaggtcacagaggttttggtttttgtgtttttttttttttttatacaaaaaaaagatgaaaaatgaaaaaaaaag

SEQ ID NO: 534201 - DNA, 146 bp, Homo sapiens
ctttcctcaactctgtggacagtgtttcttgaatttcctttcccccccccttttcccactcaagaaagtggggggaaaaccagggttccagcttttggtttttttgaaacccctttccaccctttaattaaggacccccgcttcca

SEQ ID NO: 534202 - DNA, 434 bp, Homo sapiens
gggatactattctgcccaccagagtcctcccaggtccttccgttgtcttcgccaccccagatctacatggcatgaaggcgagctggctgcggatctatgctcactactagctctgcctcaggttcagctggattctcgtacctcatccttccgagccagcgggtgttacaggtgtgcggcactacgcccagctaatttttgtatttttagtagagacggggtttcactatgttggccaggctagtctggaactcctgacctcaggtgatctgccctcctcggcctcccaaagtgctgggattacaaacgtgagccaccgcgcccggccagtagagctttttaaaatcctttttcctccccatccagtcctgaaagcttcagctgttttgcacctttccccttaacattccccagaaaaactcctgtatagtccc

SEQ ID NO: 534203 - DNA, 172 bp, Homo sapiens
taaagagatgaggtcttacttgcccggtcaagtgatgctcccatcttggcctcccaaagtgctgggattacaggcatagccgcagcacccagcttgagatatttttatattccagggttttaggtgttactaagaatgtgaactctataggaggatttccaggatgatagag

SEQ ID NO: 534204 - DNA, 960 bp, Homo sapiens
cgtgggtggcctccgtccaccacctcagctgcggacctgaggcgagatggcggcaccgcgggggtcggggaggctgcgcaagggggcgagcccggggcaggcggcgcaaacccctgcccagccctgcacccaccggcgccccaggcagccagcacaaggaagagatggcggcgaggcttttgtgcagccgtggacgtcccccatggacgacgggtatgtgagcctggactcgcacctacctatgtcctgtacagttagagatgttatgattacttccgagctgtcctgcagcgtgatgaaagaagtgaacgagcttttaaagctaaaccccgggatgctatttgagttaaatgcaaggcagattgatacagtgtggcatttaccggagagttcttattgaagatcacgttcagaaaggatctacattgaggaaatgaaagtacatcagcgtgaataaattgaggagcacgccagaaagctatcaaagtttgggcatcataggcgaagtaatagtggacatgtgctcagagatccatcgtaaggagcttgaattaagttggttgatattctttaagtcagggatgcagcagcaattatcattgacctggcaggcatcggacaatggggttgattcccggcaatctaagagctattggagatacgctgagcatgcaggatgtggaagcaagtttctgaccagaaggattgtgaagaaagtaaccgtcaatggatgttgggagaaccaaaaaaggaatccatttaggaaacttttacatacaggagagcagagttgggtgacagagatggatacagtgactgacatttggagagaagacagcatgtaccaagagtatcgacacagtgaccccataacaagaatgggacaaattaatagataccgaaagaccgtgttaagggagttcatacacgcagtgttaaccaaggacacctacgagaaaa

SEQ ID NO: 534205 - DNA, 407 bp, Homo sapiens
cagattcccgccaccatgcgcagctaatttttgtagatttagtagagtcaggtttcaccgtgttggccacgctggtctcaaacccctgacctcaagtgatcctctcttctaggcctcccaaagtgctgggattacaggcgtgagccaccacacccaggcaggttcttcagcatttctgacttttttactggaaactggttccttcatacaggttaagaatatgacccaccagcatttcgtgggatggtcttgattcaaggaagctctacaccttggtcctgacagacccggatgcttccagcaggaaggatccctacacgagaatggcatcatttcctgtgggtcaacatgaagggctgacattagcagtggcacagtcctcttcgatttgtgggctctgggcctcc

SEQ ID NO: 534206 - DNA, 91 bp, Homo sapiens
gggggggcccttccccttttttccccctccacgggaggaggttactgggaggggtttcccagagaattaaaaaaggctccttccgtgggga

SEQ ID NO: 534207 - DNA, 523 bp, Homo sapiens
gtgatagctgcccattgtgtgatatggttcctggcaagcccctagtgtgttgagagcttctccagactatcccacctttgggtccgctttagctgttccgtgataatgagcaccagcaccagttgccggtgggtgtccatccaaagccagtggaccagaaggctgctggagctggcaaggtcacccagtctgccccaggaagctccagaaggctaaatgaatattatcccttatacctgcccacccccactcttaatcagtggtggaagaacggtctccagaactgtttgtttccaattggcccatttaagtttagtagtaaaagactggttaatgatcaccatgccatcgtaaaacccttccagaaggaaaggagaatgttttgtggacccccttggttttcttttttgcgtgtggccagttttaagttattagtttttaaaactccgtactttttaatggaaaccacttgacccaaaatttgtcccagaattttgagacccctttaaaaagttaaatgaga

SEQ ID NO: 534208 - DNA, 186 bp, Homo sapiens
gttttagcaactcttaagagaccatggtattagataaacattgattttgttgttggttcacaatctctattgtagacttttcattattttatacagtgtatataacaagaatccactgctacctgccagtgcatcatcttctcttaacatctgttggtcctcctttgaaaactcacgtcaggatgc

SEQ ID NO: 534209 - DNA, 427 bp, Homo sapiens
  misc_feature (50)..(50): n is a, c, g, or t
gtcctcgctgcacttgtgacccgttcgactgtggtacttccgatgcatcngcagacgtgcaggcagcaccttctacggacacatactggcagcgcttcatgtcactggtccccatcaggctggatctcaggctccacgctgggcactatgccattctgctggcagaatactggaataacgggccagcacattggccttttccatgatggcgcgggctgagggggtgtgttccccaatcttcagcacacaacgccacttggcgaagtcagctccgtccttcttgtactgggcacagcgctcagaccgcccatccaacccttgggtggacagctcgccattagtcccggcccgggagaccacgcccttgtctacctctgatcccaacatcgaaggggttacccgcaggctccgcacttcggtactcatg

SEQ ID NO: 534210 - DNA, 112 bp, Homo sapiens
gcccactccaccttaccaccagacaaccttagccaaaccatttacccaaataaagtataggcggataagaaatttaaacccttgccggaattaggtattggcccccgaaggg

SEQ ID NO: 534211 - DNA, 400 bp, Homo sapiens
gggggggagtctcactgtcgcccaggctagagtgcagaggtgtgatcttggctcactgcaacctctgcctcccgggttcaagggattctcctgcctcagcctcctaagtagctgggagtataggcacgtgccaccacgcccggctaatttttgtatttttagtagagatggggtttcaccatgttggtcaggctgggacttgggttcttaataaaataccactctttgtgatggctacatctaagcctttgaaggtgagccgtggacataccacatgtggacagcatgaaatgctttttctgacactgagaggcacttgaaaaacttgaattcaaaagccaagccggcccaaatttcacacccccatgaaatcccacgagggtcaacaatgaaaaagacc

SEQ ID NO: 534212 - DNA, 172 bp, Homo sapiens
gtccagcacgctgctcccaagttacagatttggtagaactggacagggaggtattctgcgaagttttggatggatggatttggcaaagctaaggagatgaaagcatttcgagccgtctctgctagctgtgagcagtcgtgatactaactgtttgcttgaaagcggattcgtg

SEQ ID NO: 534213 - DNA, 214 bp, Homo sapiens
  misc_feature (189)..(189): n is a, c, g, or t
actgggcttgcaaaagggagctcactctctgggtggacccatgtgaggtgtgctgtcggtatggagagaaaaacaatgcattcatttgttgccagactttgaaaatacaagatgagaacaatggatgagatctccagtgaaagttaccagtggcccattgataatggttacctcctgattatcattcanggatcctcattcttcagactgaaga

SEQ ID NO: 534214 - DNA, 290 bp, Homo sapiens
cctctgctgctccctcttcactgctgcttcgctcttgagcagaatgacacacagacacgtgaggagttccatattattttaaaaaaagaaaagtaaggccgggtgcggtggctcacgcctgtagttccagcaatttgggaggccgaggtgggcagatcatgaggtcaggagatcaagaccagcctggctaacatggtgaaaccccatctctactaaaaatacaaaaaattaggcgggcgaggcggcgggcgcttttatagtcccagctactcgggaggctgaggcagcag

SEQ ID NO: 534215 - DNA, 137 bp, Homo sapiens
actgtgtggcatccgcaccccctcccccaatgaggacactttatattaattgtataacatagaatacagttgtttccaaagagaactcaccctcactgtgttttagagaattcttcccaaagttccgttgaagccgt

SEQ ID NO: 534216 - DNA, 256 bp, Homo sapiens
caaaaaaagggaaaaccccgggggtttccccccaaattttgggaaaggcaaaaaaggggggttttccccccccccgggggaaatgggcaagggaaacaaggggggtttggggttttcccaaagggaaaaaaatggggggtcccctttttgttttccgccccaaccaaaaaaaaaacagggttttgaaaccccctggggggcccccccccacccccccccttaaattgggccccaaaaacaggccgggtttttttta

SEQ ID NO: 534217 - DNA, 1632 bp, Homo sapiens
  misc_feature (480)..(480): n is a, c, g, or t
taaagggctggtttaattttaatggggtggatctatgttaatccacagaaggcccagtagtgttacagaacaaaggtggggagggtttatattctcttggggtctctttccctcctgtggataaagttctgtgagtgatcttccctcctttctgtggccgtgggagggcgcctctttcagcgggcgcctgtggcgtgtgtcttcctgtgtggttcttgagaaccgtgtgcggtgccctcgagccgcgtggtgtacagccacagggagcgctttctgtggcgggggccctgtgtgtcgtggctcttcagtctgtgtgtgggatggtgttctccagtggaagaatctctcagctgtggggtttgtgagagaacaccaattctccgcacttttcagccttttcagggtttaccacggcgcgtggtgaaccacccatgtgtgtgcggagacctcggagctctatctcttatacgaatttcacgngggaatatatctatatctgtggaagccaggccggcgggcggacacaaaaatctcccgctcaatatctctctcctctcaatttcccagtgtgtgtgtaccccttatctctcctgggggacaatatctcgggggggccacttgttgcggctgtggtgtaccccccccttctcggcgggtttatacccctatatgtgtcccccactgttgtgtgtccctttggcgcgctatactcccggggggggggcgcccacagggcgcgtggtctcatttacccccgggcggagcatttctagagaggccccgcgggagaatatttgcgaccccgggtccacccagcgcgctcttgtgccggcgatttagaacctccaagcgccccgacatcttttgtgggtattgcgaagacgctatcctcccccggaggaacatcctgctcggtcgttgaaacccgggcgagagaagatcctgtgcgccccaattgtgggcgcggcacatctctccacctgctggcggggctccctccacctggtgcggggggggcgtctctataaaaccgccaagaaaagcccccttcatacctatctctatttgggcccccaacaacgggcggggacagggggcacaccccccttatacacagggggcagaaagacgccccacttttctcacctgtaaaaggggcccctgtgtatagggccaaataacctcacacacgacggcgagtgccgcggcgcaccgccgccacccaaacgaactctcatggcgcccccccacgctgcgttaccaaacagcccccgcctgttggtaccaccacacccaccaccacgcggggcggggcggcccccgtgtggccgctagaccccctgtgggtgcaccacacaacaagcgcagcggctcacaagccatagggtctcgcccggcggacagaacggccggtgcggcgcgtacgcccgccaactaccaacccccgcggcgcgccccccactgtaccaacaccccgagtcgtaacgcccgtatgtaaaggcgccgccaccacacccaccagcgggcggtgagtagctaccccaacccttccaagctagcactgaaccacgacgcaccgcagcaccagccagctagcaggccggcactcgccaccaccacagcaccactcgg

SEQ ID NO: 534218 - DNA, 1081 bp, Homo sapiens
  misc_feature (927)..(927): n is a, c, g, or t
ccagatagtgggtttcggctcacataagtttgctcgggcgcccttccgggtgtccgccgtgagcaggacgtgtttgggggccccgttttacccgggggcctatttttgcgcgtcgcccccctcggcgttttcctgggcttgcccgtggccccacatgggggggctccaaccccctgttttgggggaaccaatccccttgtgtcgggccctcaggaccactggatcccccaggtggtatacccaggagtgccaaccctggagggtaccagagccacacttggggaggtgtataaagtgagggcgtccccgcgtgtggcgcgtacacccttctgcccaggaagccttgcctgccagtggcagcacgcgtcccccgcccaatgggactgacccggggtgacgctgcgacgacacagacccaccgcgctatagtgcccccaggggcgcccaacccccccaggacgggcccccatgcccaggcgtgcaccagtcggtcaacggcgccatgctggccctggccacatgggcaggcccttgtcgcggccagaaatcttggcccatgagctggcgaaatcttcccatcaccgggcacaaagtcctgcccttttggtggccatcaagagagaaagaacccattgcggcccaggcgccccagagggtgacactgccatctgtccgtgcccagaccggtagtgcaccaagataagagacatttttcagaccctggccagcccttcgtatctcaccgagggccctggagagtgccacattctgtggaaccacatacccgggagatctttctgactatctgccttctcctcggactgaggccaggcagaggcgcgtggccctggaacgggtgacagggcccacccccgggacatgccaaggccggccggatgtccaggcccctgtcttgggcccagaacntgagccgctgtggggagcgcgcccggacctggccagtggagacccccgagcgaaccagctcggtcccgtgaccccagatccccgggacctccgatcggcttaatcaagagatgtggcatagaaggctatttaatgattaaaatccatttgccag

SEQ ID NO: 534219 - DNA, 501 bp, Homo sapiens
cctaaccaatatctgccccttggatcttgttctcttcccaaagaactatctatgtgtcaacaagtcatttaaaagacaccaggacacagttaattcagttgcttcctccagtcttactttctctgcctgtctggcccttcttctgtaagctcattgtgaaaggagcatctttacaggccagcatgtcaggtagactatcctgaaaattttataacattttcgggaagcagcttatgtaattaatttacttgtgggtggatattaatgccaactccagaactaagatttgcatacgtgtctgagcctgtatccagagaaatgtatctcagcagcagggataaaggtcattttaaccattatcaaattagatgctcatcctccaatttagcattgctctatcgggaggttggacagcacacagtcactctcaatatgcattattcaagtcctttgtggcttttcttgtctcctcttcctgccttcctttggttaaaaaaaaaa

SEQ ID NO: 534220 - DNA, 211 bp, Homo sapiens
ccagataggtgctggactaaggtacgtgtacatggccactaatctttttggtttatagtagagacagggtctcaccatgttagccgggatgctctcaatctcttgaccttgtgatctacccacctcggctcccaaagtgctggggttacaggtgtgagccaccgtgcctggtctgcttgctgttctctttagtgttcttccctaagtttaa

SEQ ID NO: 534221 - DNA, 205 bp, Homo sapiens
aatgagccgagggaaacgtaaagagacccacgatgaacggtacactgtgcatgtgaaagctgacaaaaatgtatgtaaatacacacggaatatatcagagtgttagatattataaagggacactcagtgccctctgccttttccccatcctcttcgttccacaggtctggaagccctggtagctcttcctacaggccatctggcc

SEQ ID NO: 534222 - DNA, 346 bp, Homo sapiens
tgagttctaacaaggaggataacctctagggctagacattttaaatgaatcctggctctgcatttatctaaccatgtaagtttgaccaaatcatgtaaccttcctctgagtttcatgtttctcatttttaaaaagagaagataatatttatcttctgtggtcgctctgagggtcagggataatggaaataaaacactcaatgtttgactcacagaaaaactctaacacaagatgatagtgatgatgatgataataatgtgattcaaatcttaaagtatttgatttactaacaattgtttcttatttctctctgtgaatcaccaggaagacaggacctccttttcat

SEQ ID NO: 534223 - DNA, 148 bp, Homo sapiens
tcacttgtggcctggattactggtctgtcctgtcccctgggtgttcagccggggctgagccaggcttagggattgcagggccttcagaagggtagttctgaggatatcagcgtcccccttggtgaccaaggggatcctctaccagctg

SEQ ID NO: 534224 - DNA, 258 bp, Homo sapiens
aatctaacgacaggctctacactctgtcaccccggctggagatgcagtggcacaatctatggctcactgtagtgtagacttcccaggctcacgggatttctacccaccccagactcccaagtagctggaactcacgggtgtgcaccaacaacacacactggataaatgtctctcacacaaaggtaaacacagagtatacactatttaaccctcagattggtactccaaatcctggcctacaagcgatcctacctgacc

SEQ ID NO: 534225 - DNA, 226 bp, Homo sapiens
ttccatgtacaacaggagagaatcacagtaaaatgttttatctagggtcagctacttcttagtggcctgaatgtcatctcctatatacaatttacagacttggaagatccccgagtgtccacctcttagaattgaagccacttttgcccctatacgtgaagtgtttcctgatacacgctgacgtatcgagggcactacagcccgagcaataggaggaggaggagga

SEQ ID NO: 534226 - DNA, 813 bp, Homo sapiens
agagcatcttcagcgggcgagttctcggttcctccagctccttcctcctcttccgtcctcctcctcgcacctctcggctttagggggatcactgtcctctctcgggagcagaatgagccggcaggtggtccgcgtccagcgaggttccggccacgtgtttgggacagccgggcaagggctgaccagtgctatgatagatgtgcgcggtctcactagagcacactgggacagttggcttctgtgctgtcgaacccgtaagtttgtggcccgtgatctgtgaggccagcgggggaggggccttgcctggttgctgcccctggtgcaagactggacgtgtggacaagaatgcgccctacggtctgtggccacgacaggcccctgtgctagacatcgcctggtgcccggcacaatgacaacggtcattgccagtggcgtccgaggactggcatcagtcatggtgtgggagatcccggatgggggcctgatgctggcccgtgcgggagcccgtcgtcacccatggagggccagaccaagcgtgtgggcataggggcctggcacagcacagcccaagaacgtgctgctcagtgcagggttgtgacaacgtggatcatggctgtgggacgtgggccactggggcggccatgctgacactgggcccagaggtgcagccagacgacgatctacgagtgtggactggagccgagatgggagggcctcacttggtacctcctgccgtgagcaagacgcgtgcgcaatcatcgagcccgcaaaggcccggcgtagctgagaagagcggtcccacgagggacccga

SEQ ID NO: 534227 - DNA, 172 bp, Homo sapiens
cttgctctgtacactgtgtgccatcttgctccacgtccatgcttgtgcctctgccggcttgggccctgctgcatgtgtggggctgggcttcctggtctgcgtctcaccatgtgtgtcctcacccaagcagcgcatcacatggggtcccggcagctcgcacttctgtcctcca

SEQ ID NO: 534228 - DNA, 206 bp, Homo sapiens
aggatccccttcgaggctcggtaatccatgagcttattggaaatctggttgggacatctttatttttgtcctaatgttcagatacccaatggacttgggagtgaagaaattttctatccacacctcagtttttgtaccgctggctgcccagtatgagaggaggagtatcacgatttggtgtgccccctgctagcacgaggctatag

SEQ ID NO: 534229 - DNA, 326 bp, Homo sapiens
  misc_feature (250)..(250): n is a, c, g, or t
tcagtggcttctaatttattcagagttgtgcctgcatcaccacagtcgattttaaaacattttcatcaccccaaactgaaaccctgcagccaccaatctgccttctgtccatggctgtgcctgctctggacattttatgtcaacagaagcatagaccctgtggcatttgagccaggcttttttacttagcacagtatttttgtagcaggtctcaggactcctttccttgttagggctgaattgccagtanaccttcagctcatgtcatcttgaagccggtgggggatccctgggcctctggctgctgcgccaggggagggggaatc

SEQ ID NO: 534230 - DNA, 335 bp, Homo sapiens
tagaggatccggaccagccaaacaataccatatgatgtagagcgtcagtataagacagaaagattgaatcatggtgctctttgctcctgtatggtctgtccacagaagaacgtcccggatgcagcagaacataagtggcctgttacatatgaagtgcgcaaaatatactagcatttactatatagcataatggtgaaacctgcataggttagagggccctttacgctcatttcacatatcaggcaagttgtctgtcacattgaatcactaatctgggaaggctctggaatcgcagtgtacgatgtgctgatcatgggtagtctttgaggggatgg

SEQ ID NO: 534231 - DNA, 217 bp, Homo sapiens
aaagaacgaggcggaagtgagcagatcgctcctccctggtatgagcagactgacagtttagcttaacgaatctgcgaccacagcttgccgcataaaagaatttcatgagctgagccggacactgagcaagagtttaaataaaatctaactgtcatctgacacgcagagaaagacatagctaattcctgataagcttttgatttttgtattgtttgca

SEQ ID NO: 534232 - DNA, 590 bp, Homo sapiens
  misc_feature (132)..(132): n is a, c, g, or t
gacggtcaaagaacggcaggggatccacgattcgcagcacagatagctggcacccagcaggggatgccgtcagccttcacaggccctgagtccagtatacggagctgcctggaatccatgcaaatgcgttcntccagaaagggaattccactggatcctactcacatcccaagaaacatgctgctgtggcacagcaccattttaagaggctagcccccaccagattatatcctgcccacttggggtccaataagcccctgcagtccacatctctggaaccccaagaacatcctcccacatccatccagaaggttgcagtatcacaatcacccagcagtgcagtcaggtccccagtactctgacccatgaagtgtcttctatcccagggaacaggcagtatagcacaccaggtaggctaccccaggaaaaagggagctgaagctcccagaagctgggagccatcttcccaacaccaatgccaacaacagaagcttgcccctctcaggagggcaacacgcatgcctgtgtgcaccttcaggggggcctgagggacagtatgtccatatgttgccatcaagaacctaaagaca

SEQ ID NO: 534233 - DNA, 443 bp, Homo sapiens
  misc_feature (144)..(144): n is a, c, g, or t
tatattggcttttttccaaggccccaatcttccttttctctgggccttcccctggctcctgggggtggggccaacagagccccggccaggggtttgtttttcccccccctgcttttcctccaaatgtggggggggggaggcccngcccccgtttttttcccaacccctttccctttgccctggggccccagaattttcccttttaaccaaggccctgccttttcccccccccccttttccgggggccctttggttccttccccccccccccccccggcccccggtttggaatattggtgggaggaaggggaaaggggtgggcctcccccctcccccccatttaaggggcccccctttttggggccccccccttaagggggggcgggcgtggggggggccccccctttttttttttttgggccattaagcttttttgccccgca

SEQ ID NO: 534234 - DNA, 907 bp, Homo sapiens
  misc_feature (205)..(205): n is a, c, g, or t
ggagcgcgtgggggcggtaagcgcggggtccagcgcgcaatgggggcgcggaggcggctaatggtgaccgggatccggagcttcctgcagcagcccggaaggatggtgccatattgggagacacgcatgcatgggtcggcgtaaagaggccttgtgaagctcgatcccaaggcaggactgatgtgaaatactccaaccagcatcntctttgtgcccatcaggaggagaagcttgtcgcatgcgctgtgcccagggtccctgtatgtccctacgggcttggtgctatccagatttgcacatgtcctagggtcaagggttgacatgggtcacgagtatgagtccatgcaagaatatttcagactggagccacacgtacgggcgagtcccacgaacgaggcccagatgccaactacttcgatggatgccgtccaatggtagtccaggaagcgcctctcagcagcaactttacttcttttaatgacttacctgcctcgccgaccattggtcaatggagcacccaaccaaatccgcagtgcgggtcattggcacccaacaggatgacgtggacccaggcgctcgcaatgtcaatacggttgacccctaagatgactagcccttttaacgaagaaagtccgaggcagcgccgaggcaccgaggacttgccgataccctgttctgctgtaccgacgtgcacgaacaggggcagaggctcgggatggcataatcgcgcaacaaagacctcgagtaacgtcctgaccgagtggggaacgtaccatagaggaaacgggttcttcccacgcagggaacccaaagtcacacttgcttcggaggaggacggcaacagaccagacggacccttcggaataagagacgggacagggcgtaacggctgcggccagaacgaaca

SEQ ID NO: 534235 - DNA, 1035 bp, Homo sapiens
tagtaaaacaacctagttctttaatttgtgcccaaggccggcgtggtggcaagcacgtgaggccccaagaatttccagaaagggaaggggaggaggggcaaagcacgtggtgcctaccagggtgctgccgtgccccgtccgtgcttccgtgcaggagggtgggacagggagagaaaagcggacattcggcgccatcaagttattttccccgaggttttacagccactattattctcagtgtggtgggaggaggaacacgtggaggccacaacgccattcccccccgagggcttcatactgtgcatagattccagaggcgttataacttatacatcaccttccccttcaatcttcttacccccgagacagaaagtgagcgtgataagacagccgtggggaagggtcttcaagggagcccaatcgtgggtggccgtggtggaagccgggggcacaggccccaggccgagggtgctcaagggccataggggcgtggggggacagccagagaagcgggcatggtgcgatggagaggaagccacatgtgaatgagaccgagcaggagcgagcgaaactcggacaaccacaaacagagggacacccccagaaggaggcgatacccaacaccgcggactaagagcaggcggggcgagagcacaaggccaagaacaccccgtaccaagcgtgataccacgacacgcggcacaccactcggcagcgcacgcaaaaagcccctcccacacccactggggagacaagacggacggggcccctccctctccaaacaacacccagggctcacacaccattatcccccccacagcaacaacgctgaggcaccaggggcgattagagcgcgccctatggacaccgaggagcaccaccagtggacaaaaccgcggagcatggaccaacggaaatgacgagacaggcagccagtgagcacccacgagcgcacaagagcccacccccatacaaccctgctggaccaatctgggaggggagaccccccccccacacaacgcgccgggcaaaccg

SEQ ID NO: 534236 - DNA, 468 bp, Homo sapiens
  misc_feature (223)..(223): n is a, c, g, or t
  misc_feature (228)..(228): n is a, c, g, or t
  misc_feature (235)..(235): n is a, c, g, or t
tgtgggcagagagggggcctgagagctggcgcagggggctggggcaggcccaagctcatcccctcactagccgacctcactagccgaactttctggcctttagtgtccttgtctgttaattggggcaggcagtacccaccctgtgggatgtcagaggggctggccagcaagtggacaacacatggtccctcagggcaggaggaccagagagcaggagaggagngccangttggcngcctcaaaggccacagtgaggccccaggtctaccagatctctaacactaagaccggtgagctgggcagggggaggaagtcacatcccatggggtgaggaggaagatcaaacgtaaggaagcagagaaacatccaaatcattccttgaagaagtgtctcaataccacagggaacaaactgattttttttttctggagacagagtctggctctgtggcccaggttggagtgcagt

SEQ ID NO: 534237 - DNA, 270 bp, Homo sapiens
gcttgctgtcccagcggcgccccctcatcaccgtcgccatgccggagtctgcttctcgggggacgtggctcccaacttttgaggccaataccaaccgtcggccgcatccgtttccgagcctttcctgggagacttatggggcattctttgttcccaccttgggctttacccaattgtgcaccacaaaggcttgcaagcttgcaaagtggcaccagaatttgccaaggggatgttaagttgattccctttcaattgcaagtttagggccac

SEQ ID NO: 534238 - DNA, 184 bp, Homo sapiens
  misc_feature (29)..(29): n is a, c, g, or t
gaaaacacccaaaccccccggacaaattngggggggttctttaagggtttcacaaacattcaacccaaaacttggttttttccttttttttgttttcccctttaaaaacaaaaaaaaacgatgataattttttttggggaaaaggaggggaaaataaatccacaaaagccccccgtttgtggga

SEQ ID NO: 534239 - DNA, 398 bp, Homo sapiens
tgtatttttagtacagacagggtttcaccatgttggccaggctgctcaaactcctgatcgcaggtgatccacccgcctcagcctcccaaagtgctaggattacaggtgtgagccaccgcactcggcctcttttttttctttttaaatagagatgaggtccctgcctatgttgcccaggctgttccaggctgttctcaaactgctgggctcaagggatccacccaccttggcctcccaaaatgctaggattacaggtgtgattcaccatacccagcctctgctgggactttctataagaaattgctggctgggcacaggggcttacacctgtaatggcgacgcggccgcgaatttagtagcagtaggccggcgctcttaaggagccaagccttacgtac

SEQ ID NO: 534240 - DNA, 386 bp, Homo sapiens
gggtaaatagcgctgtgtcatgctcactgaagagttttttttgatacacagtctcactttgtagcccacgctggagtgcactgtgatgatcacaggtcactgtgtggctcaaactcctgtgctcaagtgatcctccaactctagactccccagtaggtgggaccacaggcttgcaccaccacacctagctaatttttggtggttttttttttttggagtgaggggggtttggcatgttggccaagctggtctcaaactcccgggcttaagagattcacatgtctcgggtttccaaaggcctgggattacaagcgtgagccaccatacttgggcctgaaggatttgtgattgctgcatttatgatttatttcacacatgggctgggg

SEQ ID NO: 534241 - DNA, 291 bp, Homo sapiens
gctttatcagcgtgcaatacgccggtgacaaagttctgatgttttccgggcaaggcctgaaagtaaaccggggcgcgagcctgcgggagaagaagaatgatgcgttttgttttgtttctttgcgccagtctgtttttggcgggctgcgccagccattctggtgatgatctgcaacccaagaccgcgagcaacgtcaacctcaagcgttaccagggcacctggtatgagttggcccgattgccgatgtacttccagcgtaactgcgcgcagtgtcgacgcggccgcgaattt

SEQ ID NO: 534242 - DNA, 150 bp, Homo sapiens
ggacacgtagaaccggtcaagccaccactacggtcatcgagctataaagcggtggctacgacaaatgatccattgagaaaccgagtaggatgcgctgagtaggtattgggctcttcatgatgtcctggtctggataatctgaagttgagc

SEQ ID NO: 534243 - DNA, 386 bp, Homo sapiens
  misc_feature (76)..(76): n is a, c, g, or t
ggtacccgcggttatgtcttacgcctacaccatagctcaggcaacgctgaatctgaacccactgagcgaggccagngatcaaacccacaacctcatggttcctagtcggatttgattccactgtgccacgatgggaactcctaaaaaataatttaaaaacttccgtaacgtaagacataaccgcgggcggttatgtcttacgtgtcttacggtaagtctagtaatttccttaatgatcacagtggattttatttttatttttttcctctttttaaggctgcacccatggcatatggaagttcccaggctaggggttgaatcggagctgcagctgccagcctacaccacagccactgcgacacgggatccgtaagacataaccgcgg

SEQ ID NO: 534244 - DNA, 122 bp, Homo sapiens
agagaggtgtgcatggtggcatggctggtcttgaactccttgactcaactgacccgccctcctcggactctcaaggtgctgtgtgattgataaggcatgagccactgcgccctagactacga

SEQ ID NO: 534245 - DNA, 133 bp, Homo sapiens
gtctgaactgtgcatcctaggggtataagtgcgctcattatgagaatctaactaataatgcctgatggtctagaggcgtgtgtggggggtgtggtgtggtgtgtgtctgggatgtggtgtctggggtgtggtg

SEQ ID NO: 534246 - DNA, 176 bp, Homo sapiens
acctttcgctgatttcatcaagatgaagaaattcggtcccatgatctggtgtaatagaatgaacaaattctttaggaatggcccctaacagttcaactaagcctttatttatctcctgcgagtccttttgcacaacctttttgataagcgtaagcgactaagccgatcgacaaccg

SEQ ID NO: 534247 - DNA, 623 bp, Homo sapiens
agtggtggctcacccctgtaatcttagcactttgggacaccgaggtgatggatcgcttgaggtcaggagttcgagaccagccgggccaaaatggtgctactaaaaatacaaaaattagccaggcgtggtggcacacacccgtaatccaagctactcaggaggctgaggcaggaggctcctctgaaccccgaaggcagaggttgcagtgagcagagactgcatcactgcactccagcctgggcgacagagtgagtaagactccatctcaaaaataaataaataaggccaggcacggtggctcatgccagtaatcccagcactttggaaggccgaggcgggtggacttcctaaggtcaggagttcgagaccagcctgaccaacatggtgaaaccccgtttctactaaaaatacaaaaacaattagccgggggaggtggcaggatcctgtgggaggctgaggcaggagaatcgcctgaacccaggaggcggaggttgtggtgagccgagatcggccatttgactccagctgggcgaagagcaagatctgattcaaaaataaataaataataataaataatataaataggtttatgttagatgattgccaagtgtaaggtaatgtaa

SEQ ID NO: 534248 - DNA, 615 bp, Homo sapiens
acaaggggttacagcaactttctcaggacttcgccagtaccggggccgttgagggtctctgttctcgactcctagacccccctatgaatcatggctataccccgaacctgttaaaaagacagaaattagacaagggtggatgcgaggggctctgaatgcagatgctctggaggacgatccaggaacaagactaggacctatgacatgaacagtggcaagcgcaacttgcattctatgagttctggccattctggtttacactgttggagtgctgtggagacatgacaacgacactagagaactattcctataagtaaacacatgggaggaccctgtggccaagcgttagctgtgacagcttatgataagccagttctgctgctggacctagaaacagtcaatctgtacaaggtgaagtcccaatcgtctgcaaaccaaacttgtctatatgaaagacccccgcgtatcctacatatgctcgcggtattctgagtactagttgacctccatagactgagacctcagccctcccgtgtgcccttcataccacttcaagctgggggtaaagagcttgattcttgttccaattggaaacttgtttctgcatttctcccg

SEQ ID NO: 534249 - DNA, 407 bp, Homo sapiens
  misc_feature (9)..(9): n is a, c, g, or t
  misc_feature (17)..(17): n is a, c, g, or t
tagcccctnacctgcanaacctactgtctgtctggagctaatgtctgtattagcctagggaatagccccacaaaaattttatttcctaactgaaaattttatttcacctctggttgataagacccccaccccatggctgggcgcagtggctcacacctgtaatcccagcactttgggaggctgaggcgggcggatcacaaggtcaggagattgagaccatcctggctaacacagtgaaaccccatctctactaaaaatacaaaaaattaggtgggcgtggtggtgggtgcctgtagtcccagcaactcgggaggctgaggcaggagaatggtgtgaacccaggaggcggagcttgcagtgagccgagatcgcgccactgcactccagcctgggtgagagtgcaagac

SEQ ID NO: 534250 - DNA, 275 bp, Homo sapiens
tgaactcaagtgatactccttgcctcatcctcccaagtggctgtgacctcttcctcccaaggagcatgtgccaccatgccgggctaattaaaaaacattttttttagaagatggggtcccactaatattgccccgtgcttgtctatgaactccgtggtctcaagtgagtcctccatacttcgtgcctgccaaaggtacgtgggataacacgacaagaagcgcgtcggtgcctggcgccccagatttttctcgttaagtgtgcttgtgtcgttttg

SEQ ID NO: 534251 - DNA, 1782 bp, Homo sapiens
gaatgcacgtgcatcaaacgtgtggtttggtttttggggggattcccagacccactctccatcatggaacgcaggtggactcctgtccagattagtcttgaaggaggtctgtgcctgatgggaaggcagagcctctcacctggcctggcctcagctggcttttggggtgctctgcagcagggcaggcacgtggccagccacgaggaaagccaaggggactcagcccgggaagcggcctcgctggctcaggcgtggctgtggtgccgggcctcctggggagcagcctggggacagggagttgccttctctctgcctggttgccctctgcgtggggtgaaaccttcccgcacgtctgtgttgctgtctgacttttaaacactgcatgaaacagaggccttgccatgccgtggctgcgtggatctgtggagccagtggagactcacagcagtgagcagtcctgggggcccagggtgtgacccccgtcgtccaaaccccggcccaacgtgtgcagagccctcccaccatccactcgctgcaacttttctttaaatatgcccatctttttactcaaatttacttatttaaaagttaattttgggctgagtgcagtggcttatgcctgtaattccggcacttggggaggccaaggtgggcagattgcttgaaccccggagttcgaggccagcctggttgacacgctgaaatcccgtctctacagagaatacgaacattagctgggtctgatggtgtgcagctgtggtcccagctactcgggaggctgaggtggagggattgcttgagcctgggaggttgaggctgcagtgagccatgatcttgccactgctctacagcctggaagacagagtaagatccaatttcacacacacaaaaaagttaatttaacaaacccctttcactatttaattgaacatacttcaaaattagttaaattaggatcaataatttatataaaaattgtagaaataccggaacaaagtgcagatgaacacctttgtcccaaggggcctgggccatgctctatagtcagcactcaagtgggagaggagctcacactctcagagcattgagcattgagaggcagcatggctgcaactgtgaggaaatataggggagccacatgaccgagcaagggcttacctacttatcactctgcctaagagccacctactggatcacatcccaaagcttcaacaccaaaaatgcctcactaacatatccctgctgtaaaaccaaagaccagaagtcagatataaataaagaccctgcacaaagcttcagccctgtgaaaacatccaaaagtctattgactgtattcaatttacaccacagttaaaggaacacccacatgcagagatgagaaagagccaatgcaagaactctggcaactcaaatggccagagtgacttccatcctcgaaacgatcactccttgttttccaacaagggctcttaacgaggctgagtcggcaggaatgacagaaatagaattcagaatatggatagaaacaaagattattgaggttcaggaggatggcaaaactcaatccaaggaaactaagaatgacaataaaaggatacaggagcagacagatgaaatagacagtgtaaaaaagaacctaactgacctggtagagataaaaattacactacaagaatttcacaatgcgatcacaagtattaacagcagaatagaccaagccgaggaaagaatctcagaacttaaagactgactgtctgaaataagacagtcagacaagaatag

SEQ ID NO: 534252 - DNA, 110 bp, Homo sapiens
acagagtatacctatacaatgtcgtgtcgtgccaatgacatttcatttgcatggattttgggttttcatgctcagtcctcccctccatttggtcttactgggtccctctg

SEQ ID NO: 534253 - DNA, 249 bp, Homo sapiens
ctcattgtgggagagatcgtgtttacgggacgcaggagctgagggtcggtcagttctggggtagttccatcacttggtgcacagaaatgactcccgggtacaggggagcggatggattcatacagaatgtcaggagcagtcgcagtacagggcctctgttagacatgttttctcatgcctggggctcccgccctacataagtgttctgggagtaagctagtctcacactctgcggtcagcagtcacttc

SEQ ID NO: 534254 - DNA, 148 bp, Homo sapiens
gactctagagtatcccccacctcacaggacgccagccttgacgcttgaagcttcggagtcacgggtttgaaacttcaaggggccacgtgcaacaacaacaagctgtcactgtccaatgccatctcgaaccgcccgggctaccgagctc

SEQ ID NO: 534255 - DNA, 480 bp, Homo sapiens
  misc_feature (2)..(2): n is a, c, g, or t
  misc_feature (386)..(386): n is a, c, g, or t
  misc_feature (434)..(434): n is a, c, g, or t
  misc_feature (466)..(466): n is a, c, g, or t
anattcggaacgaggttggcccatgtctcttacatctccttacccagtttttacagggccgtgttagagccttcacccatggaacagtacaagacatgatgctactccgagaataccgacagctccaggaacagcagtccctactacccagcctctccccccaaccatcgcccctattcagcaagaagcagccagaggacaacggcgcccctcttctattacctattaaaaggctggaatgttaggaacaagttgcaccagaacccctccccaccccaatgcagctgtcccttaccctgaatactctggcagctgcattcctggggacccttatctagggcgctacagcaaggtcaccagatttgctttacagccctacgggaggncatggggggaggtcaacgagaaacgtgggattaaacttaagtttacanccttttgttaaatttcctattatttgttaacntgggttcacgagat

SEQ ID NO: 534256 - DNA, 781 bp, Homo sapiens
catgcccgctcggcccacccggccgggacccccggacccggtgctgctcaggcccagttccagaggcttcgctccttcgggcgctcttacgccggggtcgcccggccgcacaccccggccaaccgcctttccacgggcctcttttctgcgtctataacctgggctccgtggatagcccctccatgagggttctacagactgcctgtctgcccctgcgcgcctgcgccgcccctctcgcaaggccttggcggtagatctgccttccgagagggccatctgcccgcctgttccgtcttgctcccagaccctgccctacctgcccaggttgcgctgtgcagtgcccagtgggccaatgccccccgggaagcctggcccgcttcgctcgtgccttttagcaccccccagggccccgaccttgtcctctgggcttcatggtcaacctcttggcctggatggactcagggagcacgggacctgtgcccggcccccgggctgcccttggacggagaggagagaattgtgttcctgaggggtcgctacgtggaggaagggctaccgcctgcccgtacgtgcaaaggtgttagtggagacgccaacttcgaggacgtaccctggaggaggtggtcatggcagaggaggaaaatgagggcacggacagacctgggtccccagcctgaggagggagctgagcctccccgagcccccggactgggcccgagcacttaggtttttttttcccaggtttcccggttattaaaggaacttgttttgttggtaccca

SEQ ID NO: 534257 - DNA, 324 bp, Homo sapiens
gactataacacacacacacacacacacacacacagaacatatgccagaaagagagattgtatgctctgcaatgggcagcaaatagagggaagaaaggggaatctacgacgacctttttatttgagaggcagagtcttgctgtgtcgcccagagtggagtgcagtggcgtgatctcggctcagtgcaatctctgcctcccgggtacaagtgattctcctgcctcaggctcccaaatatgtggcactacaggagtgcaccaacacacccagctaatttgtgtatttacagtaaagacaaggttgtgccgtgtatggtcgggctgag

SEQ ID NO: 534258 - DNA, 346 bp, Homo sapiens
aaggctctgaaagaggggagacagggaggaggctgtggacagagtcgggaaaagatgatggtggccgatgaccgagagccctggctgtagcaacagggagacaaatactagaatcccgtggtaccagtgctatgtgttgatgggatggagatgaataatccaaggaccccctggtcctgggctgatcgcgtgctgtgtgatggcgcagtccttcgccaaaacagggtgcaacgagcatggtcgagaggagagcaagtgcctcctcccccacaaccatatgtccaaggctaagtgaaatactctagcggggagctcatacctccattgccccttttccagagtctct

SEQ ID NO: 534259 - DNA, 1731 bp, Homo sapiens
  misc_feature (1249)..(1249): n is a, c, g, or t
  misc_feature (1698)..(1698): n is a, c, g, or t
cctggcgggctggtgcatcattacagagtaggatgcggggtgttggacgacgactagcataggtagagtcgacagagaactggttgtggggggagccacaacacacatataggagtgtgttagcgcactcgcacacggatgggtgggggggtcgctccacacgcgtctgtgggtgtagcagccgcaggtcatgtggggtgggggacacacatcggatgatcgtcgcgtgtggtgtgtggggctggggtcgcaccgcggttgacgctccggagggagcccacacggtaggtcggtagctaacacaaggaagtgtggtggtaccctgcgggtgacgcagctgcgtgaggtagtgctgctgggattgtgtggcgcgccaccaaccagcgagtgtatgttggaaggacgcggggtgggggttcacaaaggggtgcgcatgtgtagaggtagtcgccgttgttcgacacacgacggcgggcgggggatatgacgacagcacactgtggggtgggggccgccccccaccagcgatgagtggaggggagatgtgcgcgccccgccgcggcgcaggctcgctgtgtggtggtggtgtggtagtggtgctgccgcagactgtgatcacagaagcaggtggtagtggtggtgcgcagtcggagggtggtgttgtggtggtggtgtgcgcgggtgtgtggcgacaccggggcgtgtctcggctgtgtgggaggcagcccctctcagaggagagttgagtagttgtggggtcacacccgactacactcaggtggcacgccacgcacgagaggagggagtgggctcaacagctggggtgacacacaacagagagatgtactgtgtgtgtgtgtgtgtgaagaggtgtcgacaacaacacacacagtgagggggtgtggctccgcgtggtgcacacacgtgggacaacacacagggggtgtggtgtgtgtgtgtgtccacacggacactacagtgggtgtcgcacacacatagagtgagacactactggggcggacacaacagtgtgtgggtcgtcgacggcgctcccgctcacaagcagctgtgtgttgggcgctctacagtgatgctcgctgtgcggctctgtgtgtgacacctggggtgccccacacatatggagaggccacagctgtgcgcaccacaggccaccacatgagagcctctcacccgagagagaacatgtgtgtgtgtgtgagtgtggcccgacagaacacacacagagagngggtgtgcgcacacactctcacccaccgctgtgtggtcgcgctgctcggcaccgaggaggtgtgtgcgtacacaagacacacgcacgtcgcacgcaccctcgggtgtgtgtgtgcgcggacacgcgtgagagtgtgtggccggtgtgtggagacgtataccaggacacacacacggtggtgagacacacacagagttgtgtggtgtcctaccgtggccgcccaccagcgggcgccgtgccacagccgcgtgctggtgcacacaggtctccgacacccagggggcgggcttggggcaccaggccccccaccccctagagtgggcgcgcccacaccgtgccccccgattggaaaggggggcccggagagagaggaagaaaataaaaaataagaaaataagtaggtgaaatgaaagcagcgaggatgtgaaatcgcaggcgtctgatgatanatgtaggtaggtctccctccatcgttcccccgc

SEQ ID NO: 534260 - DNA, 1456 bp, Homo sapiens
ggtctcagcaggtcaatctgggccagtcttgtgcaaaaccgcaaccacaactcagcacaacttggaatcgttttttttaaaaatgcctctgcagcaaccccatcatcaagtccacaaaagtctgtgtgttcagcagctataatgccattagttattacatagcagcagaattcttacatcaacatttcaattacatattagctaagtccaagcaatcatcagccatcattcagactgttattcagcacagggcatggggcttgcaaagggacagagagcacttggcacaacacacacttctagagacagcaatcaccacatggtcaccaaggcccattcagtgtcaaggcaccggcttaacccgagcctcagcaggcaccatcaactcatcacgtcacaatccatctttgcatagcattcatatctcttcatatcatgcgctcttagggtcaattataaatgtcacacaggtggacaattggggatcacaacagcatcatgtcagtaacgatcatatttcaaaacagttaataatcatatcaaaattgggatttcaaaaagtattttatcaaacaagctttagggttatttaaaaaggagggtacaaacatacgagttaatccttacacaaccataatacattccatggtatggaacattgccttttaagtgcgaaagtgcatagaataggcagtgtggtgtcatccatcaggtcattatataaaaaaccgtggttataaagtgttaataaaaggaactttggttttcaaacacactatgcgtggtactcaaggtggttaacaattctaaaggcttacaaaacggtggtgggatctaaatactaaaaagccggatttcaacactaacaggaccacacgcattgaacttgtgggacaaattctacattggacacccatatatccttgacagccaagaaatatgacccctcattcatctatcttccacacacattacacatagcacatcgtgattgcgaccagagagctacaacacgaaatggatggaatggaagaggcaaaggctatacaccatggaaaacaggtggtgccacacacaatattaggggcagggcaacatcactacaagaccacagaccactgtgcagggagacgacaaactaatgggaaactgccaggaaaaacaaaggaacagcgggaccacaagtaaagacgggtagaccacgatcaggactcacaaatacacacacataaccagacaatcccacacggaagacaacactgacaatcacaaaacacgggagaacagacgaaagaagaaagcaaacaaagagtagcggagcaagtagcagaaaacaacatacgggaggagcaccgaacgaacgacgacagaacagaaaaaagatagacaaacacaagacagggaacaacgtactagatgatatcaacacgacaaccaaacgaccaaacgcagatag

SEQ ID NO: 534261 - DNA, 430 bp, Homo sapiens
tgtagggaaggctgcccagattcctatctctcagcatataaatagacagtcttcccatcacatcatttattgaatatcaggagccttaatccccgatgactggtttaccgtcagcttatgttcgaaaatcatgatcgtcatcgctgtctcgctgatataccggggctgactatactaggtccattgatctatgtgcctgtatgagtaccagtactatgctgttttgggcactgtagacttgcaggaattattttctacccttgcttgaattttacaaaatagctctcaagggagctgatccataaagatttgcatctataaatctatagagttggagcagaataatcatttgataaacatgaaagatgtccccatttttagttactctaacgttcaagtaatcttaaagctaagaacagagtataaattg

SEQ ID NO: 534262 - DNA, 155 bp, Homo sapiens
acgctagaggatccccccattttgaagactgatacgttggagtttatcctagaggataaaggaaatctttgggatagtcagtattttatatacgcacaaatatgaacctcaaactgagtcctctaaaggccccatactatgaagtagacattggt

SEQ ID NO: 534263 - DNA, 146 bp, Homo sapiens
gacgcctctcgtttcaacggcaagacctcggtgcagatcaatgcgatgtcgtaccgcctgggcaccgtcgaaaatgccatgaagctgctgcgcgcgcaaactcagtggatccaggacaaaggggccgtgctgtcggtattttgcag

SEQ ID NO: 534264 - DNA, 174 bp, Homo sapiens
cagcggctgcttcacgtctcacgggtgcaggaccacgctccgtgcttgggctctaagctctgtgtctagtgtagaacctggggaaggagcctcttaggaactgctgcagtaacttcttactgctctcacaattctaaggaagcgggagaacggcctcctaccaacagtggccac

SEQ ID NO: 534265 - DNA, 389 bp, Homo sapiens
tcgtgtcatcccccttcgtacaccattgttttactcactaaacttcagccttactgcaccttttttctttctcaatatgctaagccagtttcctttgagaggcctttgcagtgcatgtacacttttccctggaatactatttcttcagtttttcatgtggatgccctttcttctccttcaggcctctgtctaaatgccttttgttcagagaggcctttcctgatcaaccaatttaaattggtcttctccagtggtttatgatcggatcaccctttcttaataactctcactattatctaaaatcatgttacttatgtatttctttctttacttgttttgtgtttacttctctcaatgagaaggcaatctccacgaagggggatggacca

SEQ ID NO: 534266 - DNA, 250 bp, Homo sapiens
gaattgggatgaggaacgtgatttccagtggccttcccaaattccccattctcactggggactgtgaatttgctgagagaactctctagggagccctgcagaaaatctcaaatgcatagcaactcacaactccagagccacctcctgttggatcttttattttgccactgacttcttcaacctttccttacctgtatcacacacttattagttattgccctctgctttgcaagtattacttatacagttt

SEQ ID NO: 534267 - DNA, 794 bp, Homo sapiens
  misc_feature (54)..(54): n is a, c, g, or t
  misc_feature (89)..(89): n is a, c, g, or t
  misc_feature (109)..(109): n is a, c, g, or t
  misc_feature (114)..(114): n is a, c, g, or t
  misc_feature (139)..(140): n is a, c, g, or t
  misc_feature (153)..(153): n is a, c, g, or t
  misc_feature (179)..(179): n is a, c, g, or t
  misc_feature (296)..(296): n is a, c, g, or t
  misc_feature (416)..(416): n is a, c, g, or t
  misc_feature (490)..(490): n is a, c, g, or t
  misc_feature (504)..(504): n is a, c, g, or t
  misc_feature (510)..(510): n is a, c, g, or t
  misc_feature (594)..(594): n is a, c, g, or t
  misc_feature (785)..(785): n is a, c, g, or t
tgttccagcccggacaggcagatttcacttccagaagagcacattccagaaaancagccagctggggtagaggcccagggacagctgtnggaagagcagggcgccgtangtttngtgctccagcacaccctgggctagnnctgccaggtagtnctgccagccctcggccagtgacagtngcgcctcctgcagctcccgccacaggaacaggctgccaaggagcgtggctgccgggctggtcagcaccagcagggcagcatagagggtccggggcccatgaggcttggcaagcgcanagtgggcaccatggtggtggccagcaggaagcccagtgagaagttggtgagggcgatgcagcccagctgcagtgctaggtagatcagggctaccagcttcagtgccatccagcccctgtntggggcctgtgtgcttaccacccggtgggtattgtggggcagggccaggccagctgcataaatcgccagctgtnttagcaccacagcntcagcntctgccactgggaagtgctgggtggcaacgtgttggcccagcactggcaggacatagagggcacagttccatggcctgtgagancagcagaggtgccacgagcgaggccagccccacaccctgtgatgggggaaggggtacactggggccaggggcaccccgggctcctcaaggcccattccagcctcatgcagctgcatccacagttccagagccttgagaccaaggaccaggagcaagaagccgacagcgggcatgtagaggccgatggagangaagcggga

SEQ ID NO: 534268 - DNA, 805 bp, Homo sapiens
gggggtttatgatatcgtcgacccaggcgtcgccacagatgctgggggctgtgcaccttgatttgcgctcatgagtcagcacctgcatcctgcccaacatcgaggcggtgagcaacggtgcacaatctcaactcggtcaaggagtccccccatgagcgcatgcaccggcacatcgagctggcctgggccttcatccacgcgtcatcggcacgcgtgctcattccgtagctgaggtgggtgctgcttacgtgcatgggtcaagattcgttgccccatcaagaagcagcacaggccagaccaaggcgccaccagacaaagccccacacgacagatggcggcaagcagccaacggtccagcgagccaggagggcaattccacccacacggggacccaggggcaagacctgccacacaatcagacacgtcagaaagcagccgagtcaatgggctggccgcgttcgcgcccctgcaatcatctaaatcagcacctccggaagatcgcagctagacgataccccgccaaacacgtggggtagagaccaagtacagcactggaccggaacagggcacccagggaaggccgtcaacaagacggcatcgggcccggaaggttcttggcccggcctctcaccaggggacgccgacgcactcgcgacccaaccacggacggggggaaccaacacacccgcgagaaacagcacccagagccagcacacactatactggccataagagaccccccactggcagcgcacgcagggagcacccaatagccacgcatgaccgcacgagcccctaccacgcc

SEQ ID NO: 534269 - DNA, 909 bp, Homo sapiens
  misc_feature (5)..(5): n is a, c, g, or t
  misc_feature (71)..(71): n is a, c, g, or t
  misc_feature (75)..(75): n is a, c, g, or t
  misc_feature (82)..(82): n is a, c, g, or t
  misc_feature (89)..(89): n is a, c, g, or t
  misc_feature (95)..(95): n is a, c, g, or t
  misc_feature (123)..(123): n is a, c, g, or t
  misc_feature (137)..(137): n is a, c, g, or t
  misc_feature (143)..(143): n is a, c, g, or t
  misc_feature (145)..(146): n is a, c, g, or t
  misc_feature (155)..(155): n is a, c, g, or t
  misc_feature (167)..(167): n is a, c, g, or t
  misc_feature (170)..(170): n is a, c, g, or t
  misc_feature (174)..(174): n is a, c, g, or t
  misc_feature (202)..(202): n is a, c, g, or t
  misc_feature (213)..(213): n is a, c, g, or t
  misc_feature (219)..(219): n is a, c, g, or t
  misc_feature (233)..(233): n is a, c, g, or t
  misc_feature (242)..(242): n is a, c, g, or t
  misc_feature (255)..(255): n is a, c, g, or t
  misc_feature (261)..(261): n is a, c, g, or t
  misc_feature (266)..(266): n is a, c, g, or t
  misc_feature (286)..(286): n is a, c, g, or t
  misc_feature (332)..(333): n is a, c, g, or t
  misc_feature (337)..(337): n is a, c, g, or t
  misc_feature (424)..(424): n is a, c, g, or t
  misc_feature (453)..(453): n is a, c, g, or t
  misc_feature (458)..(458): n is a, c, g, or t
  misc_feature (480)..(480): n is a, c, g, or t
  misc_feature (492)..(492): n is a, c, g, or t
  misc_feature (506)..(506): n is a, c, g, or t
  misc_feature (794)..(794): n is a, c, g, or t
  misc_feature (830)..(830): n is a, c, g, or t
  misc_feature (840)..(840): n is a, c, g, or t
  misc_feature (880)..(880): n is a, c, g, or t
actgnagcttttcaaaacgttcacacatttcaatgtatcgtcgacgcttttctaaatagacttacaggganggtngcacacnccaaagncccgcngccctcgtagcaccgcagtccaggctangatgctgggcggangggggngnntgggggggntctatttacgantgnctgngctttcactcccactaactgtgcgcgtnttgttttcgtnccttanacgcttttccttcncgtctgganccgcgtccggagncgccgnctcgnccttaaaggcaaggattccntgtttgcgaccacgcagacaaacgtcaaaccccccccccacccccnncccnaggcgccgggcccagaagcccccggccatccagccccgactctttcatgcctctgcccctgatgaggggacccagggtaccctcaangggacacagaagcggaggctgcatcctantccantgtcaaagtcaggggcggcgcngcacgagcctgnacaggaccacctancccagccaggcgacaggcagggtgagaccacctggaacaaaggcacagaggctggagagaaggcggcatgttcccagactgcatgggctcggggtagggggatgcgaggtcagaactggcatagtggccaggatctcgggctctactccatgggcaggggggaagcccctggggctgcatggggccatgggggaggcgggcgcaggagacaccggctgctgtgccaaaggccccagtccagctgctcctctgccagcagaaggcagaggacaaggggctggccactangcccaccaccacccccacccccacccccaccctggnccccaaaatntggcgctcctgacatcatgaggaacaggacgacgggaatnatgtacatccagtatttggcgaagaagga

SEQ ID NO: 534270 - DNA, 704 bp, Homo sapiens
gggaccgtccgagaggtcagagtatcctctggcctggagtcagctcgccggtacttccggccaggctgcctaattctgaggaccgggtagtcgccagtccccggtctcgtcccttcctgtcccaccatacggcacctcagccgacagaagctctactcttcctattcaggttacctgtgtgcttggtctgttgacttacgccatctcagacacttccgtagactgtttagtcccctgtcaatatcgttaccactggtcccagtttgtgccccagaagggatgtatattctgggggctcccaggaagggtaagctgatcagacctgtggagccagccctactgtgtgaagcctggggcctgactgctcagaacttgctgctgtcttgttgcggatggatggaaggttggatgggatgggtggatggaccgtggatggccgtggatgcgcagtgccttgcatacccaaaccaggtgggagcgttttagttgagcatgacagcctgcagcaggaatatatgtgtgcctatttgtgtggacaaaaatatttacacttagggctttggagctattcaagaggaaatgtcacagaagcagctaaaccaaggactgagcaccctctggattctgaatctcaagatgggggcagggctgggcttgaaggcctgctgatcatgtgtcccgccttgttcaataaagccgagccc

SEQ ID NO: 534271 - DNA, 854 bp, Homo sapiens
  misc_feature (106)..(106): n is a, c, g, or t
  misc_feature (286)..(286): n is a, c, g, or t
  misc_feature (420)..(420): n is a, c, g, or t
  misc_feature (617)..(617): n is a, c, g, or t
  misc_feature (619)..(619): n is a, c, g, or t
  misc_feature (632)..(632): n is a, c, g, or t
  misc_feature (651)..(651): n is a, c, g, or t
  misc_feature (693)..(693): n is a, c, g, or t
  misc_feature (695)..(695): n is a, c, g, or t
  misc_feature (700)..(700): n is a, c, g, or t
  misc_feature (712)..(712): n is a, c, g, or t
ttccgcttttggggcctttgctaagaccattggaaaagcgtagtattagggtgggaattacccaattttccaggtgccgtctgtcacccctttctttgactagganagggaattccctgacccgttgtgcttcccgggtgaggcaatgcctcgccctgcttcagctcaagcttggtgcgctgcacccactgtcttgcacccactttccaacactccctagtgagatgaacccggtacctcagttggaaatgcagaaatcacacgtcttctgcgtcgctcacgctgngagctgtagactggagctgttcctattcggccatctggctccacctgtcgagatattttacattaactttctatgacatacttatagcaaaacttatttttgtcatgcagaatagtctatattctatatttatngtaaagcatataccgtacatggtgactagtcaccatgctgtacaataaattttctgaacttagtcaactgtatttacgtattattttacagagatctctccaaatgcctcttttttctgaataaacaagcatccagtaaccagcatttgccgtctggcttatttcacttggcataatgtactctaaatttatccatntngtttcaaatgacnagatttttctcttttattnccaagtagtatttcattgtgtgtaaacacatttttaaaaatntnatatntagtcatctatnggttgaaaaactcatgtaatgaaaatacatttgtgttaaagcatgtattaatgtaattcagcatgtaagattttattaatcatagctaatttgtgccaaacactaaaactctatgtgtgttaataaatttaattctcacagt

SEQ ID NO: 534272 - DNA, 971 bp, Homo sapiens
tactcaagcttactccacgtctgttcatagcttgacagctcatttcttcttagcactgaataatattccatcatctggatgtaccacagtttatccattcacctactgaaggacatcttggttgcctccaagtttgacaattatgaataaagctctgtaaacatctgtgtgtagctttttacgtggacatacgttttcatctcatttggataagtaccaaggagtgtgattgctggtaaatgtcgttttgtaagaaaccaccatactgtcttccatagtgacactaccatttcacattcccatcagcaatgaatcagagttcctgtggctccacatccttgctagcatttggtggtatcagtgttatggattttgccattctaatagtatgttgtggtattccattattttaacttgcatttcttggatgacacgtgatgtggaacatctttttatatgcttattggtcatctatatcttattcggtgaggtgtcaagatcttggctcatttttgatctggttattcattttcttattgttgaacttcaagtaattctttgcatattttggataaacagtccctttaatcaggtaatgttttctgtcatcctgtgggcttgtcttctcattctcttggacaggcgccttttcatggcagccagaagtttcttattctcaactgagcgtccaggcttaattcaggttcttttcttctatggatccatgcccttgggaggtcgctattcttaaccaaaggtccatggatatggcacaggggaatcctctctaagacttgctacccatctttaatctgggagggaaattatggtgagcttggcacattttacacaacggccaatatgcaatctctgctgacgggagcgtaacggcctaaaatcagtacttttttacacagcatctctatcttaagcacacatttgggtcacccgaaacactcgacgtggcaaca

SEQ ID NO: 534273 - DNA, 351 bp, Homo sapiens
cccagaggtgcgactctcttttcggtgggaggcagcccgatgcaggcatttaaaagttcgaggcaagccagcagaagggagacttgctgtctcccaatagttcctatggaaggctagtagttgagtatcattcttgggacatgtccatccatcagccaatcagtgttgctggcagagcagaactcactgattggtcagacttgggttatggctccaccctctggagctgagagatgcatcagcctcctgtgaaccattaggactgagagtggagaatgggcgtttccccaaaagaaaaatcaggctagtgtcatcagagaaaggggagcatggatgttgggcagacaaaaa

SEQ ID NO: 534274 - DNA, 821 bp, Homo sapiens
gacgcaactcttactcgcgggccgattgtggtttatccgtcactcgccgaggttgccttgggtcatggtgccagcctgacctgagaagaggactgctccctgagggagaacgagagtgagtgagaccaaactctctcctactgtatcacagtgactagcggcggcctgtgttccgtcacagagggtaagagtagagcgaaagaccgatacttgtctgacaattacgtgatcgcgcccagaccattgaactgtgcgactgcagtgacatagtgtgtgttgatcacggagctggtatgtatgactacttggtacaaccatgtagtctaatgctgatgagaaggatctgctagacatatggtattcggagagcgcccctttgtacctactgctctggattgcatgacgtgccgtaaagagcacgtggatgtccggaaggacacagccatggttggttaagcgcaatgtactagttggatccttatgacccgtgtggttggccaacggtatggtctctcgcggacggctttcgggctgaggtgctggatttcagggctttgggcatcggactccgggagcttcttgggggaatttctataggccgagggtttgcccactgcgggtgtctgctgggcatgcaaagtgatgaagcttccttgggttggctcgccctgggattggtgcgcatggccattcgggttttcttatccccctaggggaggtggctttcgtgatcgtgtgccggggaaccacggttggggcggggttcggatccgcccgggggtacttggcggaagtggctctgagcgttggggtgcgctttc

SEQ ID NO: 534275 - DNA, 704 bp, Homo sapiens
gaggacacgattcttcaatcgagagcgtccagcgattgtggaagaggaggaaactaaaacatataaagacctgggtgtgaaagatgtgtgtgtagaagctagtgagcagtgggatggacaaaacccaccaagatacagatgaagctattccttggccttacaaggtcgtgatatcatgggcttgcaagaaactggctcaggaaagacaggacgcctatgcttgaccatactaaacagcactgatgggagaaccccgcagcgctaagtaagcccgtaagtatctatcaccaccgaactcgggaagactggacccacacagaacacttcaacagccagaacagaagaccccaaggggagtccctcatcaaaacaggcaggacgccggcagatgcacggaagcacacgcgtaagagaagcgacaatcagactaccaaatagacacatcacaaccataaaaagagacccactcagccaacaaacaaaacccaacactaattaaataaaataaacacgacacatccacctagagaacagacactcgaataccgcgaccaacaactagagaacaacacaaaaccgaacacaaagcggagaaaacaacaccactaagaacgacagccccgctcccaaacaaccaaacgacacgcgcaacaaaccgcgacaaagacacaagccgagacacagaaaataaacaaggacactac

SEQ ID NO: 534276 - DNA, 1188 bp, Homo sapiens
  misc_feature (419)..(421): n is a, c, g, or t
  misc_feature (423)..(425): n is a, c, g, or t
  misc_feature (448)..(448): n is a, c, g, or t
  misc_feature (725)..(725): n is a, c, g, or t
  misc_feature (767)..(767): n is a, c, g, or t
  misc_feature (826)..(826): n is a, c, g, or t
  misc_feature (830)..(830): n is a, c, g, or t
  misc_feature (901)..(901): n is a, c, g, or t
  misc_feature (997)..(997): n is a, c, g, or t
  misc_feature (1099)..(1099): n is a, c, g, or t
ctatgacgggtttttggacccggattttgtcctcgtgtgtcctatattcctgtatagcctcgcaatcacgcggggcacacataatgggcccccttttgtgaatattaattgtattctgaacagactttccgttattacgccatccaaaagtcctgtagccgtccttactttaagaaagtctgggttcttggatctataatccgcactggaagtgcttgaatgcatcatagccgttgcagactccttactagatgaattcaaccacacatctcagaacacgtagtatgcaaagggaaagcttaacactcgggggcctaggtactctaacatacttgtatctcatggtcatcctaaacatagccacacaagctagacataattatcccatttttccaggagaaactgaagttcagagcatnnngnnncttcctcaaatttatacacctcnataagtggtagagccagaatttggacccctgtctgtttcaaaacctttgtcccagaacaccagtggtcttcaattccagataaaattgcttgcagagaccacacctatggaatcaggatctccaggaatcaggggtttttgtttgttttgtggttgttgttgttgttgttgttgttgtttgagacagagtctcactctctcacccaggctggagtgcagtggctattcacaggcataatctgagctcactgcagcctcaaactcctgggctcaagcnatccccctgcctcagcctcctgagtagctggggctgtttcanaattttaacattggtgctgtaacatacgcactgtttattgattagttgtgactgtgagnaaanttgtagagtctctaaaaaacttaactttaggagcataagtgcattcaaaactaaatccctattgactagcncagcgttaaaaaaaatagtcgtggcactttgggaggctgaggcaggcagatcatttgaggtcaggagttcaagaccagactggccaacatggtganaccatctctactaaaaaaaaaaaaaaaaaaaaattagtggagtatggtggcgggtgcctgtaatccctgctacttgggagactgacatggagaattgcttgngccctggaggcagtggttgtagtgagctgagatcacaccactgtactccagcctgggcgacagagagactccgtctcaaaaaaaaaaaa

SEQ ID NO: 534277 - DNA, 856 bp, Homo sapiens
  misc_feature (419)..(421): n is a, c, g, or t
  misc_feature (423)..(425): n is a, c, g, or t
  misc_feature (448)..(448): n is a, c, g, or t
ctatgacgggtttttggacccggattttgtcctcgtgtgtcctatattcctgtatagcctcgcaatcacgcggggcacacataatgggcccccttttgtgaatattaattgtattctgaacagactttccgttattacgccatccaaaagtcctgtagccgtccttactttaagaaagtctgggttcttggatctataatccgcactggaagtgcttgaatgcatcatagccgttgcagactccttactagatgaattcaaccacacatctcagaacacgtagtatgcaaagggaaagcttaacactcgggggcctaggtactctaacatacttgtatctcatggtcatcctaaacatagccacacaagctagacataattatcccatttttccaggagaaactgaagttcagagcatnnngnnncttcctcaaatttatacacctcnataagtggtagagccagaatttggacccctgtctgtttcaaaacctttgtcccagaacaccagtggtcttcaattccagataaaattgcttgcagagaccacacctatggaatcaggatctccaggaatcaggggtttttgtttgttttgtggttgttgttgttgttgttgttgttgtttgagacagagtctcactctctcacccaggctggagtgtagcagtgtgatcttcactcaccgcaacctctatctcccaggctcaagcgattctcgtgcttcagcctccccagtagctgggattacagacatgtgccatcacgcctggctaatttttgtatttttagtagagacaggatttcactgtgttccagactggtctcgaactcctggccttaagtgatctgccca

SEQ ID NO: 534278 - DNA, 336 bp, Homo sapiens
  misc_feature (80)..(80): n is a, c, g, or t
taccagagtttcccttttcgatggaatatgaccaacgtcatcattggtgcctgttcgcttttgtcgcccttttctacctnatcaaccggatgcttttttgggaggtcgataaccgaagggatgtgcggctcttccatcaactcgggtggaagcggaagcacatcatcggatggttcaggcaagaaatggcggttctcctcctgctttcggcgtcgatttccctgccgggggcatgggctttgcaaaaatggggaagattcggggccgatttttacctttggtttttgatcgttcttcttgccgccgcgttcatcctgctcataagcttccggtcag

SEQ ID NO: 534279 - DNA, 518 bp, Homo sapiens
tggtccgatcgtgaaataggtaggtgtctgtctggaggacctctaggagcaggtcgtaattataatgggtatagaaacacgggtatgactaatagggagttgaggagatgcagcacactacaagggatgtgccacttcttttttttgagatggagtttcattctggttgcctaggctggagtgcaaactccgtctcaaaaaaaaaaaaagagagagagagaaaacctagctgtctgccaggtacggtgtctcatgcctgtaatcccagcactttgggaggccgaggcaggtgaatcacctgaggtcaggagttcgagaccagcctggccgacatggtgaaacctcgtctctactaaaaaaacaaaaaaattagccgagcgttgtggcgcgtgcccgcaatcccagctactcaggaggctgagacaggagaatcacttgaacctgggaggcagaggttgcagtgagctgaggttgtgccattgcacttcagcctgggtgacagagtgagactccatgtc

SEQ ID NO: 534280 - DNA, 2490 bp, Homo sapiens
cggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagacagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagatctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcacctctgtgcctcaattcctcattctctgggcccttctcctcctcagggcctcctgttctcagggcctcccccctccccgctccctccctctctcaaggtctcctccttccctcccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcgggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcactggcctttgcagcacagtaaaacatggtccagacaacctgtggccccggcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 534281 - DNA, 160 bp, Homo sapiens
atcgtccagctgataggaacacgcaagcaagctgcaaatacttgcttaccgacttgagctaaatggtgatgggcgaccgcttgacttgggaagcgactcctcgatctattcttgaaggaattgcaacggccattatgaatagcgactgcctagtctttga

SEQ ID NO: 534282 - DNA, 349 bp, Homo sapiens
tcaagaagaaacaggcaggaagatcaacactgttggcactggtgattgaggagaaggaaggggtccttcaaaaaaaagagggtggaagggttggattctgacttgatataaaaatgaaaaacccaaacaccttttttttttttggaaacagttttcccctcttattgcccaggctagagtgcaagggcgtgactccgtggctcactgcaacctctgcctcccgggtttcaagggatcccccttatctcagcttcgtgagttagctgggactacaggttcccgccaccacgcccggcataattttggtatttgtagtagagatgggtttcaccatgttggccaagctgtc

SEQ ID NO: 534283 - DNA, 3278 bp, Homo sapiens
cggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagacagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagatctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcacctctgtgcctcaattcctcattctctgggcccttctcctcctcagggcctcctgttctcagggcctcccccctccccgctccctccctctctcaaggtctcctccttccctcccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcgggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcactggcctttgcagcacagtaaaacatggtccagacaacctgtggccccggcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagtaaaaaaaaaaaaaaaaaaaaaacctcggagtttttttttttttttttttttttttgggggagaaatgtgggaaagggggaaaacaagagagggggggccgggggaaagagtgtgtgggtttagtgtggtgtggagggtgtgcaaaaaagaaaaattttatgaaaagagaaaaggagtgggaaaatgtgcgaaaggtggggatttgtgtgtactttataaaagggggtatggcgagcccgcggaaaaaagaaccccttgggggacacgaggggagaacaaaggggatgtaaacccggggtggaaaaggccaacaaaagggcggcaaaaggggcgagggggagggaacacccccgtggcacagagagcaaggggagaacacaatagaaccggcgagacaggtaacgctgggtaaaacacaacgaaggaggggaaacacaagggcgtcgggaccactatttgtcggcgcaaatctctggtacgcgtgtgtggcccttcccacacaagcggcggaagaggggggcacagaagacactacctcgcacacgaattaaaaactgcgacgggtactacaagacgccacagagggggggatataaaaaccaacagcggtgtccgcggcgggcgacgcacaacacaagaagggcaaaaagtcgaggatagacaggggaaaaagtgcacgcgggaaaccacatgagagcccccagaaaacaacaaagttacagggtcgagccaaccaacgagggggggagccccctacccccggggggcggaccgccgatcgagtaaacg

SEQ ID NO: 534284 - DNA, 2123 bp, Homo sapiens
cggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagacagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagatctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcacctctgtgcctcaattcctcattctctgggcccttctcctcctcagggcctcctgttctcagggggcactggcctttgcagcacagtaaaacatggtccagacaacctgtggccccggcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 534285 - DNA, 98 bp, Homo sapiens
aacttttatctaagctgcgctaaatgttttcttcaagggaaccagatttagttctttacagattttccagtgaaataaaacatgttgtaatagctgga

SEQ ID NO: 534286 - DNA, 114 bp, Homo sapiens
  misc_feature (38)..(38): n is a, c, g, or t
ccggtaccgtctgagcagctgggaaaaatatgataccnctgtccttgatactttttacaaaacttaaaaactatttttatttatgtatttatgagacagagtcttgctctgttg

SEQ ID NO: 534287 - DNA, 169 bp, Homo sapiens
tggtcggtccaaataggtctctaccgtcacggaggacgaggagtagtaagagctcacaggcctttccagagactgaaccattcaccctcttctttggtccgaagttacgtaaacattagtgttacagtttttccagacattttagtaagggttcttatataagcgtctc

SEQ ID NO: 534288 - DNA, 680 bp, Homo sapiens
ttttaggtttgagggggaatgctggaaattgtaatggggtatggagacatatcatataagtaatgctagggtgagtggtaggaagttttttcataggaggtgtatgagtgggtcgtagcggaatcgggggtatgctgttcgaattcataaaaacagggaggttagaagtagggtctgggtgacaaaatatgttgtgtagagttcaggggagagtgcgtcatatgtggtccctaggaagatggtagtggtgagggtgtttattataataatgttggggtatccggctatgaagaatagggcgaaggggccgtggcgggcgtatccgagtgttgaagccgtgtagaactagttcggaccccccttcggcaaggctcgaagggggtccggtgggctctcgtgctaggtggggagataaatcatattagggccaagggctcatgagggcaggagtaatcagaggggtcctgggtgtggggaaaaggggggagaggttaaaggagccccttattagcacgggtgacacgtcagaactgagggcagggggactcccacatgaaaaaggtggcgcgcacctggtccccagtgggcccaaaaggggtacttgagttgggggccccccggtcgagggactgggaacacggcaggccaaggggcggcgaaaaaaaggggcacagggaggg

SEQ ID NO: 534289 - DNA, 204 bp, Homo sapiens
gagatctttgagcatcactgctccattgatttaggtctcgggggaatactcaatgatgagcagatgggcctgcccgtctacgtttgcaactggcagtccaggagcactgggtttctgataccaggatctcctttgggcgcttgaggttggggagaaacattaggattaacaccagaggagctacatgggacttaacacaggaac

SEQ ID NO: 534290 - DNA, 2522 bp, Homo sapiens
cggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagacagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagatctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcacctctgtgcctcaattcctcattctctgggcccttctcctcctcagggcctcctgttctcagggcctcccccctccccgctccctccctctctcaaggtctcctccttccctcccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcgggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcactggcctttgcagcacagtaaaacatggtccagacaacctgtggccccggcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttcacggtcttaacttccctcatttcccttaagcagacaaaagtccaggtctcgggtccacagcttcagacatgacagggaagaggc

SEQ ID NO: 534291 - DNA, 148 bp, Homo sapiens
  misc_feature (127)..(127): n is a, c, g, or t
tgtgcttgggacggcgctgtgcttgggacggcgcacaagtgtctttcagccattcccggaagaggtcttcatctttctttagcaccagaaactggcaagggacaacataggccttgtcaaaaacccnctttcctccatgcttcttgcc

SEQ ID NO: 534292 - DNA, 101 bp, Homo sapiens
  misc_feature (26)..(26): n is a, c, g, or t
atcgcccccctctctgaataaggcancatgacatttgcttcatccaacatctatgtactgagctctcccactgttgacccgttattgaactaggtctgccc

SEQ ID NO: 534293 - DNA, 611 bp, Homo sapiens
tatttcttgttccaaaaagttccttttcggcgccttcctgttaatacccttgaaaaccactcttctgtttctgaagtgttgagttggcccacatagttggtggggataacctttctttttttgtaaaaagggacttgcttcccaccattctccatgctcctccaggactttcatcttctctcctttcttgaaagacaagtcgtccgggtggatcccatcataggggtacaaggctaccacaatgtctccttgttcctttggatctttagtttgaaccctctgtccaggtaaaagctgagattctggaactggcctttgctgtttattggacgttggatctctcacataaatagttctttcagtattacgtactggttgagtcttcaaatctactccatcgtcactcaagctgtctttcccttttgattttatacatcccatatttccgctcgcggtgaaagtttcggggcggcggagctccacggtgacttgagttcagagtgggggcgcgacggggcggcccagcaggacctgcgtatggggaggctgctgaccgggaagcctggaccgcggcgaggggcttggcgcggggccgggggtggcgcggccgc

SEQ ID NO: 534294 - DNA, 2168 bp, Homo sapiens
cggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagacagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagatctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcacctctgtgcctcaattcctcattctctgggcccttctcctcctcagggcctcctgttctcagggcctcccccctccccgctccctccctctctcaaggtctcctccttccctcccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcgggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcactggcctttgcagcacagtaaaacatggtccagacaacctgtggccccggcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 534295 - DNA, 165 bp, Homo sapiens
  misc_feature (125)..(125): n is a, c, g, or t
ggaagaaccatttgcgtttgtggggagtccttgcggttgtgattaaggcttttcatgtgaaagcccaagaagatgaaaggattgttgcttgttgacaacaaatgtaagtgttcccccattacttncaagggtcatcctttcttcccaagatcctaatgagagaca

SEQ ID NO: 534296 - DNA, 782 bp, Homo sapiens
gctcagaatgacacatttgggcaccacgtgtgtagaaagcccccactgttagatgatagcctcatgagcaccccctgcacaggcccagcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccaccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 534297 - DNA, 317 bp, Homo sapiens
cggaggcgttgaatggccatcggaggcgttgaatggccatcggaggcgttgaatggccatcggaggcgttgaatggccatcggaggcgttgaatggccatcggaggcgttgaatggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 534298 - DNA, 131 bp, Homo sapiens
aatgactggtgtgccttctgtggcctggacacaaccagcacagagctgtcagtggtgaagagtgtatacaaggatacagagcaaaaatacataatcatggtacataaatattacatgtcacaaaaacacag

SEQ ID NO: 534299 - DNA, 164 bp, Homo sapiens
  misc_feature (6)..(6): n is a, c, g, or t
gagtantgctgaactggacaggagctgagggaagaaatcggaaaggcgggacaaggagattgagctggtcattcaccggctggaggcgacatgggctgccaaggaggagagtgagacaggctgccgacgagccgcatacaagcgctatacggcgacaagtacga

SEQ ID NO: 534300 - DNA, 277 bp, Homo sapiens
caagcatgtaatcccagcacatccagctaattaatagtattttaaatgaggacggagtctcgcatctgttgaccaggctggagtgcaatggcacgatcccggctcactgcaaactccgcttcccgggttcaagcgattcgcctgccttgctgggatgacagacgtgcaccacaatgtccggccaattttgtatttttagtagagacatggcctcaccatactggccaggccggtctcgaacttccgacctcaggcgatcccaccccgtcaggtggag

SEQ ID NO: 534301 - DNA, 668 bp, Homo sapiens
gttcaacagtttgctgacagatgggaacaatcttttttttttttccaatctgccatctatacaattttctaacagatgtcaaaagcagtctagttgatataagcattctgttaccggtgatattgtttcagagctgaagctgctccatgcctagtcttaattaccatattgcagggttacggaactggtagggctgtgttgtgtcagcttctgaattgggcaacttggaggcggtacgtggctcgtgcctggtgtgtagtcagaagggataggggatcttgcctccttttctcttcaggcggttgcaaactcacccgtgttggaaacaccgagtggacaggaaggagtggtacacagctgcttaccctgatttattcaggggtttggtgttcattctggagccatactatcaatggggcgacagacggttccgttccacccccgtgaagtattcatgcaccgtgtgaatagtatcaagcaggatggcttccatggtatggagcatgaccagcgtgtgactcattctgacatttcagatcctaagaattctaagaacactactagaagcatttgttccctcctagtcaagcttcatacttttctgggatcttttagcccttgacattctggtcccccaaacctgtagtaggtgaattcctaggataagg

SEQ ID NO: 534302 - DNA, 222 bp, Homo sapiens
  misc_feature (154)..(154): n is a, c, g, or t
tttactaaggtatatttgttatagcagtacaacctagcctattatattaagaagtaatagcaactttacaatggagaaacctgaaagctactaaccttaaccaaggttaacatcaccagtaatatgacacatcgacatcaagtatctcctgatnaaatgcaccgagacgggcatatcattgccgtggttttcttgccaaaaatgcataacctcaatctgatc

SEQ ID NO: 534303 - DNA, 391 bp, Homo sapiens
  misc_feature (23)..(23): n is a, c, g, or t
  misc_feature (39)..(39): n is a, c, g, or t
  misc_feature (78)..(78): n is a, c, g, or t
  misc_feature (106)..(106): n is a, c, g, or t
  misc_feature (390)..(391): n is a, c, g, or t
tgcagtggtgcaaatctcagctnactgtaacctctggcntccctgggctaaagccatcctcccaacctcaggctcccnaagtagctgggactacaggcacacaccnacccacgtctagctaatttttgtatttttatagagatgaggtttcacccatgttgccccaggatacttttgaacccctgggctcaagcgatgagcccacctcagccttccaaagtgctgggattaaaggcatgggccaccatgcccagccagatttttttctaatataaaaataaagatgggatctcattacgttgtccaggctagtctcgaactcccggcctcaagcaatccttccccctcagcctcccaaagtgctaggattacagatgtgagtcatctaann

SEQ ID NO: 534304 - DNA, 394 bp, Homo sapiens
tgaggaactcaaatctgcatcaaggaaacaccctggacccagaatctgagccccctgatccccctgacccctctgatccttaaacacccctcggaccccatgggcactttcacgccatgtagtaggaaccccaaacatcacccgtggggtgtccctcccacatcacatttgggacccccatggtggcactctgtattccaactgtgtccccaggtgccttccagtgacagcgagggactgacctacttggagctgcaagctgtgaccgccagcacacagccccccagcccccccgccgccccacagccctctgttatctacaccgaggtggccgttcgggggcgccactgatgcctccatacgtgtgcaaaaacacatgtgtgttgtatgcaca

SEQ ID NO: 534305 - DNA, 262 bp, Homo sapiens
tatcatcacctgtgatggttgttggctatttacccactcacctattgattcccctatagctgtatattgatggtcctttggctatcgcagatacgttgctaggaaccttcatgtatacaagtctgtgtgggcttgtaacactgggtcagtttcttggagtggaagttctggttaatatgttaagtctacatttaacttttaaacaaatctcacaaactgttttccatagttgttgtaacattttatattcctatcatcctcc

SEQ ID NO: 534306 - DNA, 130 bp, Homo sapiens
catataaaagacttgctaatatttactgtcgtctttactatagtctcttcatagtcagaaacaaatattgggtattttatgaggcttagccttgaggagagttctgcagatacaacctgaccggtgggga

SEQ ID NO: 534307 - DNA, 149 bp, Homo sapiens
gctagccgagcatcgcctggtgaagagtctgatgaacaaacacacagctgtacacacatggcttcccgatgggatggtggctgcaggcagcttatcatacacaactggcatgtaatccggcacgatgtaattcggcttctcctagatcc

SEQ ID NO: 534308 - DNA, 350 bp, Homo sapiens
tagagagaacagaacagcgatcactaaaccgttcctgccgaccaccctctgctagacacagccaaggccaacgaggcaagcagaagcagcggctgaggaagtggcgtcatgtgttggaggcaaatgtggcaaaccaacccaggcccacccagagcgagcaaacgctgagacctgcaaggacctggatgagaagaggagcccgcttcctgtacatatatttaagtgacaaacacggtcaaaagcttcagggacaggttccatggttgcttgtgtaaataaagcatgtacttcgtatgtcacagtttggggcaacggcagtcttttagtgctggtcacatgggtcccggtct

SEQ ID NO: 534309 - DNA, 247 bp, Homo sapiens
accctctagaatttctactccatgtgcttctgtatgaaactttttgtctttttacctttattgaaacaacaaaaagtaagtattgacacatctcttcctgttttctgtctagtcaacatgatgctcactgtgcccatgatgttttgatatatatacattcagcaaaaagttttattcttttattcaacattctcattaacgattattatatgctctgccgtctggccatgctctgcaggacatgtat

SEQ ID NO: 534310 - DNA, 854 bp, Homo sapiens
gggcgcagcctggctggggcccggtcgagcccgcgccatggcgtgcctgaggcgacagctgtggtgccggaagcggggctgttggcggctgcctggccaaagactggcttgcagcagtctaagtgcccggacactaccccaaaactggctggcgctgcctctgtctgctgtctgctgtgactgcctgagtgctgcctgatgcctaccagatgggtggcctggggatgtactttgtggctggggccgtggctgccgagtgcatgccctgaggcagcttgatgtgttggtttacccctggtgaggcggatgggcctcatgcaacctgcctcttcctgcgtgctcgcctccctggaccaccttgcccaggcgttggcgagggacgcccccggtgacgcgttgcttcttgcgtgcttgtactgtgacgccagtcttgccacggtgggctgttgcgacctccccttgcgtgcttagaacaaggcgtgcattgttcgcccatacctttgcctggatcgcggggtcgcttgtggtggccccaatggccttgtacggaggttcctttcccacggcaggtgtcccctgcgcttggaacagcagtgtacaattctcacagaaggtcctggggccacgtttgagatacagcttcagctgcacgacttttccgacggaaagcccaaatggttggttcggctccacggcaaggcccatttatggcccacacgacacgaatttgcgtgcgccaacatttttccattgggcacattgggaaggacttgcccttttttcaacccaaagggggaagcccgccagcgttggccttgctatttgggggaacccacttgtgagcacgggttacc

SEQ ID NO: 534311 - DNA, 918 bp, Homo sapiens
tcacctctgtatgaataagccagtcatgtgtttctgcctgatgcctaggagtgtcagtacttggatgtgcagcactaatgtggaaatgcgcataccaacctagatatatgcgatacgaaacgtgaacgatcagatccaaagtgtcaattgtttgccctcgatctacttccagagatcgatcactgcacttgcctgcatagtatccgaaaggttgacgtcaattaccgttgcgggaagaaacatccagggacaatatgaaccatcatagtaggggggtacggcaagtatactcatatctaggaaagccaaatcgtcgtaatattgtagtaaacaaaaacatctagagtacgcagatctgttgtgactccttttgtaaaaagacctagatgccttacctttacagttggggtcgaggaatagatcgtgataagtaaatcgtgtttaacactaaaaggcatatagtcttgggattggaattagaagttgcaataggggagcctcatgtatatgacattgtagattagcaaaacagcgttgttatttcagtgttagtgcaacaccacattcgtaaattggtaggtgactatcaaagagagattggtaaggcaatccgtaataggcaggagtagggtagttaaactctgatttattgaactgttggctgcccaacgagacatgatcgtcacattccacatggtgcaacgatacgtcctggtgatgcaatcagggacagttaggcaaattctaacatacatatgaacaaggcaaacagtccacgtcgaacttctgcgtaaatggttgaaacattccaccttgttgccaccccataacaacaagcccatgccgcatcagccatcaggaagcgtacaagaagtggcaacacttgcaacattggcgaggaaggccataatattccgc

SEQ ID NO: 534312 - DNA, 120 bp, Homo sapiens
aggatccctccaaagcgtagtaccagctcagtgtgggaccgggcacggtggctaatgcctgtaattccaggactttgggagaccgaggtgggtggatcacttgggtactacgctttggca

SEQ ID NO: 534313 - DNA, 309 bp, Homo sapiens
cccccccccccccatatatatacccccccatagggatacccccccatacataataaataaaaaaacctgaggccagatttttttcataaaaaatccgcccccccgaaaaaaggggttcctctgaggtgttttaaaaaattagggcaatgtattaaaatcaagggttaggaaatttcatggttttacccccaaaaacttttattttggaattgaactattattaaattggatttaatcctggattacagtttaattaattatttttaggggttaagggttcaaaaaggaatttttcccccctttttttta

SEQ ID NO: 534314 - DNA, 241 bp, Homo sapiens
aaaggattgaagctacagtgagctacgatcgtaccattccactccagcctgggtgacaaagtggagaccctgtctcaataaaaaataaaaactacaattaaggaccaaaaaataggctgggcacagtggctcatgccttgtaatcccaacactttaggggacttaggtgggtggatcacttgaagtcaggagttcaagaccagccttgccaacatggtgagcaccatttcttcttaaatac

SEQ ID NO: 534315 - DNA, 301 bp, Homo sapiens
  misc_feature (76)..(76): n is a, c, g, or t
  misc_feature (138)..(138): n is a, c, g, or t
  misc_feature (262)..(262): n is a, c, g, or t
atcgcttgagcccaggagttcgagaccagcctgggcaatgtgacaaaacccaatctctacaaaaaatacaaaaganttagtcaggtatggtggcgcatgactgcagtctcagctacttggtaggctgaggtaaaaggntcacctgagcccgggaagtagaggcacagtgagccatcattgtgtgccactggactccagcatagggaaggggactgagaccgtctcaaaaaaattaaatagaaagtcttctttttttaaaatnctgcaattcatgagaaaactgcactcacacatagtgtgt

SEQ ID NO: 534316 - DNA, 1095 bp, Homo sapiens
acagtggagccttctcaccattattatgcctctttcgtaatcgagtgcgctgtacttagatatgtatcatctgtgtggtctccatatttttatctccaatggctcattcccgttttaacactttctatcacatgtttctagcaaatcgggtgacacaaattgtgaaacagcgtgtgaatttcccctggtacaatgggtgtcccttgttaccttccgctttcctggtcctctagccatcttccaggtcccccatggataacctgtggatggctctcacggagtggctgccattcgtcatgtatggctgctagttatctagctaggcaactgttcattttgtcatttacgaaataatcccctaggattgtctgctctcagcgctgcttcccctggaacaagtttgcgtgtccagcacattcagacctgtccaaaacgctcttagcctccctgataagttgtctgtctccttgacggagcttcacagagatataattgaaccacaagtagagcgaatctcataccactagaggtgaactttctccacgcaccctagggtgacacgaaactagcctttgtgcaccaggtacttaggtacttggagcgagtggacgagcacgcatcgaccgataaagtatgcctcggcgtcccgtctaaaggtgttctgcaagatccattggaaagcttcctgggaaacgtatgctagcagagcttcgtccccgtgaatcatatggtcaaagatcccactcttagatggtaaatgaatttgaatcgacatagtagccccataagcatcagacctgtagagtgaggagccatctctagacgggccccttcattcctctaccatgctgcaatcactgtcctgggcttaatggtgctatggattaggaggtcctttgagaaagagcaagatggagcaatggagagaagacctcttcctgaatcactggactccagaaatgtgcatgcagatccagtctagttgcctgtcaagatccagataaactttcctgtcactgtgcttagaactttattattaattaataattgttaaacttctgtgctggttcataccgatctggaaattttggagct

SEQ ID NO: 534317 - DNA, 401 bp, Homo sapiens
  misc_feature (52)..(52): n is a, c, g, or t
  misc_feature (171)..(171): n is a, c, g, or t
  misc_feature (264)..(264): n is a, c, g, or t
gcgccgagcatctctgctctgtcttttgccaatttctccttggcccctccanttgttcgtggggatcgtgcagttctttccactcaaacttcttccactcactctaaaatgtgactctgagctgggtgcggtggctcatgcctctaatcccagcactttgggaggccaagntgggcagatcacttgaggtcaggagatcgagaccagcctggccagcatgacgaaaccccgtctctactaacaatacaaaaaattagccaggtntggtggcaggcacctgtagtaccagctactcagaaggctgatgcaggagaattgtttgaatccaggaggcggaggttgcagtagccaagatcacgcctctgcacttcatcctcggtgacagagtgggactccatcac

SEQ ID NO: 534318 - DNA, 842 bp, Homo sapiens
agagctggacccttcacacacgctgatatcgaaccgagcactgaatctctccagttcttgttagatacatgtaaagttctattcattgcgcagcgtgcgcggtcgtatacgatgtgagcctcctggaaagaatctggccgttgatctgggttctagacatgattcatagtatagtagataatggacactataccatgtttccaatctaaactaggcagtctatagatctagagcctaacagatattgcgaacgaccctacagggctagtacacgtatggctcgcaggacatttctacaagtgacatggagttccataattggcacagtcgtacttgcacagctatttcgagacacatgattcaaagacttttacagcggatcgagctttactgatgcgacaattttcagtaataacttggtatggtggatcatgggcatctatcatcgaccagataacagtgagataacataggcattgcatgaatagtctcattctagaacttatgacagatggcctgctcattatgactccaagactccattgtgctcccctttgagtagtactgggcgggaccagaacggctttgtacagggacattgcccggggtgatctctgacctggaatatgactgcgttgtactccgaatgcgacgctggaacctttattcgatcaccaggctataatgtttccacactgtgcactcattgcatcatatgcccacgtgctatcagaagcgactgtatcgacgtctgttcaggatgttgccagtggactaatcgagcagcctatgaggagaaccggggcttccattgcatggactatgatcgtgaacatatactg

SEQ ID NO: 534319 - DNA, 291 bp, Homo sapiens
  misc_feature (208)..(208): n is a, c, g, or t
  misc_feature (222)..(222): n is a, c, g, or t
  misc_feature (243)..(243): n is a, c, g, or t
  misc_feature (268)..(268): n is a, c, g, or t
ggtttcaggaattcatctgggtcatttaggggaaatttctgcagttccatggtgattttaatcactaaatatcaactaaaaatcaacatccctaaaaatgtggttacataataacagaactcacagaaagtgagaaagagtagcttaggtaggtcgtgacatgcagcaacaaggagtcaggcagtcctagagccaaatcacttaattntaatgagcttgagntgacctcatctataaagtggngaaaatcatgcctggttgataagantagtgataatgcagcaaagagct

SEQ ID NO: 534320 - DNA, 316 bp, Homo sapiens
actgtgaggacgatcatataagcaggacacattccatcattgcgtaaatctgtctagtgtaggcgccgcatccactgcggacatcatcattcatgcttacaacctcacactgtgctacgaacaaacagtaagagactgcatgctgtggacaaagataaggaatgacaactcacagactttgcctccatgggcttgaccacaaacttctcagcttgtaacaaccctgcctctgccacaggcaccagaaacactgcagagatgccgcacatttctcactcattccgagccagctatgtcatgaaggttttcttgcggc

SEQ ID NO: 534321 - DNA, 235 bp, Homo sapiens
aggagacacgagcatatgaagaagtacagaatatcaaactccaacaacatgccagcgattaaccaacaagagatagggagcatggctagaataagaggaaacagccgacaaccaacataagacaatatgctctagaggaggggcagatgccaacatggaagcagtcaaaggttccagaccttgtacatgaacagcaggctgtcgcatagtaacttgtggctgtgcattaagatgt

SEQ ID NO: 534322 - DNA, 393 bp, Homo sapiens
agagagcccataccctttgtgatagtatatccaaatatttgataaaacttgcaggcaaaccatgtgtcacagtgcttgtagcacacaagaaagcaggtataaaaggggagagtaaggctggtgcgtggtaggcttacatctgtaatcccaacattttgggaggctgatgtgggcagaccacctgaggttggacagttcgagaccagcctgactcacatggagaaacgccatccttactaaaaatacaaaattagctgggtgtggtggcgcatgcctgtgatcccagctacttgggaggttgagtcaggagaatcacttgaacccggaaggtagaggttgcagtgagccgacattgcacctttgcactccagcctgggtgacagagtgagactc

SEQ ID NO: 534323 - DNA, 194 bp, Homo sapiens
ctagttctagaagtttcaactagcatcctagttttagaagtttcaatagcaagcatccccgttccagtgagttcaccctcttaatcaccacgatcaaaagggacaagcatcaagcacgcagcactgcagctcaaaacgcttagcctagacacacccccaggcagcaatgtgctattgaaacttctaaaactagg

SEQ ID NO: 534324 - DNA, 363 bp, Homo sapiens
ccgaaggtaccccgtttcgtaagcgccaaagcgccgattacagtaccgccagccacggaatatcggcgtcaacagtaactggccatgagagccaacccacgcaaggagctgcgcaagtggacgatacatccggccaagaaccctcaaggagcgactttaccgatctcaacgccgacatgctgcacgccatcatggagctggtcagcgacgggatctgggactggaacgccaacaccggtttcgtctaccgcaaccccggctgatacgaaatgctcgggtacgcccatcactccctggaaaaacagtgtatacacctgggaaaacgtgattcatccggatgaatacccataaaaccacacaatt

SEQ ID NO: 534325 - DNA, 199 bp, Homo sapiens
cacaaaggtacagatggtcccagcatgtgtccagtgcttcagggagtgggacatcccagcaactaatcagacttccggccagtgtcctaacccccaggcacccggtcaaccatatttaaaaatgggaattggtataaagtggcttccaagttttataatgcatcattttacatctttggtaattaaaagcatcacaagg

SEQ ID NO: 534326 - DNA, 670 bp, Homo sapiens
gctctcagctctcggcgcacggtccaggtatatacttgtagcatagcaacttcggatttcactctaccctggagagtttccctgcttggttgaacacattggcctcaggaagcttccttcaaaatgtctactgttcacgacatcctgtgcaagctcagcttggacgggtgatcactactacacctcccaagtgcatatagggtctgtcaaagccctatactaactaaagatgctagagcgggatgcttcgaacactcgaaacagccatcaagaccaaaggtgtggctgaggtcaccattgtcaacattcttgaccaaccgcagcaatgcacagagacaggactattgccttcgcctaccagagaaggaccacacaggcacttgcatcagcactgcatcgtcagccttatctggccacctggagacggcgcatcccgggcctatcgaatgacacctgctcagcatgacgcttctgagctaaccgcttccatgaaggggctgggaaccggcgaggactctctccttgcgatcttctgctctcgctcccttcctggctcctctcgcttctttccgtgtccgccgcgccttgcttcccccccgccccgcccccggccttctccggcccctctgccctccgcacccctcgttgccgtcacgggcgcccccggctc

SEQ ID NO: 534327 - DNA, 360 bp, Homo sapiens
ggctgccaagaggtggaccggtggacggctgtacccagactatgatcaccagctggaatacagtgcgtcacatcgaggaaacgtggaccttacatccgtcagtaattgaatacagtgaaaatgatatccatcatctgagaaaacttggaagctttctttcaggctctgtcagggtgtaagtgaatctcattacaaaacgaggaagtgtgtacaggtatgaaataggacacactaaaaaaggcatggttctcacatgaggtgtgtgtgaagtcactggcgacctgtgtgtgtctgacagacaccaccacccgtcccctgatttcggcatctggcaaatcccaccctccctggaactggtag

SEQ ID NO: 534328 - DNA, 529 bp, Homo sapiens
atggctgtcccacttgaatagggtctgtagcccctttgttttggccaatttctaccatttggaatggactgtatttacccaatgcctgtacccctattgtatctaggaagtaactaacttgcttttcattttacaggctcataggcagaaggaacttgccctagtcttggatgagactttgaactgtggacttttgagttaacgctgaaatgagttgagactttcagggactgtagggaaggcatgattgattttgaaatgtgaagatatgagattacggaggggctaggggtggaaatgatatggtttggctgtgtccccacccaaatctcattctgaattcccacatgttgtgggagggacccagcaggaagtaattgaatcatgggggcagatctttcccatgctgtcctcatgaataagtctcacatgacctgatggttttaaaaatgggagtctccctgcacaagctgtcttctctatgtctgctcctatccagatgtgctttcacttcaacacaatcgtaagc

SEQ ID NO: 534329 - DNA, 522 bp, Homo sapiens
tctctcagagtatccccataaatcggaaatcgagttgtgagatgttgtagtgcccgcaccagtgagctacacaggctctcgtccaggaatctgaagccactttgcagtcgacatactcggataccagcgctcagcccacctgtgattctggatatggaacttggaactctgggacaaatagaggctacgagggctatggctatggctatggctatggccaggataacaccagcaagtatggaattaaccagcgcttagatatggtgccgcatttggagacagacatgatgcaaggaggcgtgtgcggctcaggtggagaaaggtatgactcttatgagtcctgcgactcgagggccgtcctgagtgagcgcgacctgtaccggtcaggctatgactacggcgagcttgaccttgagatggaaatgggctatgagggccaatacgatgcctaacgctgaccagttccgcatgcgtggcaccgaccccttcggtcccagggcacagggctgggcccggaatgcc

SEQ ID NO: 534330 - DNA, 2613 bp, Homo sapiens
taggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactacttttttttttttttaagtatttggctgggtgtggtggctcgtgcctgtaatccctagactttgggaggccaaggcaggaggatcacctaaggccaagagtttgagaccagcttaggcaatacagcgagaccttatctctatttttaaaataatataaaaagcttaatattacagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctc

SEQ ID NO: 534331 - DNA, 444 bp, Homo sapiens
gtacgcaccaccatgcttagcttaattttattttcttgtagagacaaggtctccctttggtctttaactactaagctcaagcgatcctcccacctccgcctcccaaagtactaggagtacaggcgtgagccaccgtacccagcccaatctttcacatgaattacatgctgaaagataatattttggatatactggaccaaagaaaacattaatgaagttgatctcatttttttttcttaatgtggatgctgaaaaatcttaacttatagttcgctttttccactgaacagtgctagtttaaagttggttagggccgggcgcagtggctcacacttgtaatcccagcactttgggaggccaaggtgggcggatcacctgaggtcaggagttcaagaccagcctggtcaacatgatgaaaccctgtctgtactaaacaaaaaaata

SEQ ID NO: 534332 - DNA, 197 bp, Homo sapiens
  misc_feature (98)..(98): n is a, c, g, or t
tgtagtgtggggcatcagtgccttcctgcagttgtcatctgccacacggaagggcacggcacggccaggggtctatgatcttctgcatgcccagttgnattggccccacgtagagtgggggtggcgtctcggtactggtcagcggacacggtttggtcctggctgggcaggtccagctcccgggaggaccttggggc

SEQ ID NO: 534333 - DNA, 182 bp, Homo sapiens
agtttcggcctgaccggcggtttccgtaattatggttatcactacgttgatgaaccgggtaaagacacggcgaatatgcagcgctggaaaatcgcgccagactgggatgtgaaactgactgacgatttacgtttcaacggttggttgtcgatgtataaatttgccaacgatctgaacactac

SEQ ID NO: 534334 - DNA, 666 bp, Homo sapiens
  misc_feature (28)..(28): n is a, c, g, or t
  misc_feature (113)..(113): n is a, c, g, or t
  misc_feature (129)..(129): n is a, c, g, or t
  misc_feature (140)..(141): n is a, c, g, or t
  misc_feature (148)..(148): n is a, c, g, or t
  misc_feature (194)..(195): n is a, c, g, or t
  misc_feature (197)..(197): n is a, c, g, or t
  misc_feature (253)..(253): n is a, c, g, or t
  misc_feature (284)..(284): n is a, c, g, or t
  misc_feature (301)..(301): n is a, c, g, or t
  misc_feature (314)..(314): n is a, c, g, or t
  misc_feature (346)..(346): n is a, c, g, or t
  misc_feature (414)..(414): n is a, c, g, or t
  misc_feature (454)..(454): n is a, c, g, or t
  misc_feature (461)..(461): n is a, c, g, or t
  misc_feature (620)..(620): n is a, c, g, or t
ccagactatagatgcttgatctcgcatntagcactcgatctttagattatattttttttgaagggatctcagctgtgccagctgagtcagtggtacatcatagtcactcagcntgacttctgggctcanccatcctcacnntaactcnccagtagtggactacacatatgaccactacaccggcttttcttttnntnttctttaatagaaataaaggtctcactatgttgcccaggctgtatgtacccttttntattagttcgttcccttcaaatacaccattntttgtaccagaactganaatcatccatcanaaccttccaaaaaggtttgatttcttcatccntgtactaatcaatccaaacataacatgctgttttatatacacacaatagccaggaagaagtatgcctntgtgttgaaaccaataagtgaaacaaaaaaataaaaatanaataaanaatatatgcatacatacatatacacatacatgtagagaaagggacttaactcactggctccagtaagcatctagaggtctgcctccataggctcagcagaggatccagctagagaaaacttattttattttttttgagacagagtttcgttctgtcacncaggctggagtgcagtggcgtgatctcagctcactgcaacctcgtg

SEQ ID NO: 534335 - DNA, 102 bp, Homo sapiens
ggtacgacttttttcaatctaattatatccctgaatatcatcatttatttttggtaaatgccagtgaggaatatacacgtcattcctgcagaaaagtctata

SEQ ID NO: 534336 - DNA, 870 bp, Homo sapiens
acagtcacgggccaccactaattttgtatttatagtagagacagggttgccaggctggtcttgaactcccaacctcaggtgatccgcacatctggcctcccaaagtactgggatgcaggcataagccacacacccagctcagattactgtttactcaaattaatggggatgatgaggatgaaacagtgcagggattccccatgtttgttttcttcttgcatttctagtgtctgttttttttggtggggggggggggggtatggtggtggttttttttttaaaaaaagatctgagaggtatggggtccttgggttaaccaaagtccagtagcatcctggatttcaaagtctggtggggcatggatgggcatctggacctcagtcataactatctttaatacttcattataaaatctacaatatgggtcacgtggaagatattatcatggtacctggggagatatgactaattaatgagtatggggaaaattttcctagaaaaatgagtggttgtcgaagggctgaaggattttggagacaagagtctatgagaaaggtcttgataaacccaagaggggttatgaaattgtgcatatgaaacataagtaggtataacatatttatttgcatcacaaggtgtcggaaatagagggttcatttaggaacgggattattgggacgtattaacgtaagaggtatcgtttaaatagaagcccgggttccattaggggtagacctttccattctaaagggaggggaaaaatctacattgtctcgtgcacaatttgtggggggcagaaacaaaagaagaaaaagtgggggcgcaaatataatatatgcggcgcggaagaggaatgtcgatagaggggtc

SEQ ID NO: 534337 - DNA, 666 bp, Homo sapiens
  misc_feature (373)..(373): n is a, c, g, or t
cggacggtggtttcccctaccaaaaagagtgccccccgtttggcgcctcctcccccccggaagatggattttatcgtgtagagaaccccgttgtctcgcacggattactatgggtcccaaaacccacgagcttcttcaaatccctaggaggcgttgatattagaagaggcctccgtggggaacaataataagaatctcaaaaataaaaggacattcagaggatgcaaagttggtagtagttaatatgtgtgaggaaataacacaagtgggtgggcaaatctctataggtaacatctccgcctgtgtgcttgtcttctttaagatggcgctatcttcttgttacacacaaaaggtgtctaagacatcgccccangtcttgccttcaacaactgaatcgtgaatcgccctgccgaggtagtcccgcgcggagttcggtgctgggagtacagcgccgcaccttcacacgcgccaattagcggccgttgttttagcggacgctctgtagactctagtacagtactgactcaggtgatgaggtgctgtctttactcacctgcaagagacgcactgacccgccgcgccagtcgatcgttcaatagaggcgaggaccgccgtcccgcccgacttccgttactacgcatacacgtgagtgaacgaagtacactc

SEQ ID NO: 534338 - DNA, 1427 bp, Homo sapiens
tctggaggtaggaacttttattatcacaagtccaaaaagtgtaaagttacttgcccatggccccacagcaagcaagttggcctgtgttccaggagtgttgactcttaggtttggctctgacgtgcaggagcccccacccttcacttttccaggtggtgtgtgtgagggggctcaggaacagaagggaggacatatgtgtaagcggagccccaggcacgtgtgtagggtctcctgtgggagaaaattaaggggcgcaggtgggtgccaggaagcttcaacagggtgttgttccctgtggcccgtgggtgccgtggtgaaaaggtagccgaaatgtattagaggtggcaggtgtgcaagtgcgcaagacgtgggcacagcccgtggaagagaggggtctcaggtgttgaaagggcgttctgtgaagcgaagggtctctcataccaaaggaaccgtgatcattaggagggcctatgttgaggtctcttacagcgtggccaaaccaagaaaaactcgtgtggccccccgagagaacagtgttggcccaccagggaggcacagaagatcacagtgtgtggttctccccaaagtcaccagtgggtctacaacgctgttgttagtctaacaccagtgtgtgcacccgtgtatacgctgtgactgtggcaaacaaacaactgtggttcaaggtgcgccttgccaagcgtgtgggacccgagtgggacacatgctcagaaagcccttgtgtggcataacacaaacagatgaacagcgtgatcttggaaagagatcctctcttgtgaaaaaccccatttctcatggatatgctcccttttcgcgcgggaattggcgggccctattcacgtggcaaacctgtgttgcagacaatgagaccgcccacaattaacacaacatgtgttgctctccaagttattcaatggtgggccaagaccgttggaattcattcacccgttttagaaagaccagttgggggacgattccacataatacacggtgaccacggcacaaagcaaaggtgaggcgcattgatgagagccctttggtggtgatcctccgaaggcaccttggggttgaaaaagatcctctctgtgaggagcgaaaaataccttgtctgtgtaggaacaactttgtgatacggaacttaacaggcgcagagattttttaccccagtatgtctaggagaacacccgataaacccggtccccgtagcccctggtcatgggttcaccttgcgggcccgtgtaaaagctaaacccagaggatcgtagcacgggcaacccgtgggtgtaaaccataaagaacttcagtgacaaagatgatcaagaatacaaaccccaggaggttgagacccaagataacagagaaagtagaaagctacaactatagataccaacttgtgacaagcacctaca

SEQ ID NO: 534339 - DNA, 125 bp, Homo sapiens
cacgaggccgacgacaaccacgcccatgatgcggtgctctatgttctcgggctgatcggcacccactttcgattcggcggtcgcaactcggtcagcggggtggactgcagtggcatgcgtgagct

SEQ ID NO: 534340 - DNA, 351 bp, Homo sapiens
cccttttctcccaagaccagcttggcccagggaggggggattctgctttactgattcgccctgccccagaggaggcctttttttttttattagcttttgtttaccccgtggaattgaccccttcctcccggggttttgggggggggagcccaggggccctgtggcccctccttttttcctcccatcccccgtttgggtttagctgccaaataagattccccttggccccctgtgtttttttgggggggcagggggctgtcccctcccctttgttttcctttccccttttcccccctggtttgcattttggtgggttttttttttttgccaaattaagtggtgggaacccca

SEQ ID NO: 534341 - DNA, 118 bp, Homo sapiens
taatataatataataacttaaaatacacatactacacttatacacacactctcacacgtcacttcttatagaactgttgctatgagggtaaacttaccattatgtttgatatgccact

SEQ ID NO: 534342 - DNA, 518 bp, Homo sapiens
  misc_feature (226)..(226): n is a, c, g, or t
ctggcacatagtaggcacaactgtgtgttgcatggctgtgttcatttctatcatggctcttatgacattgcaccttgtgtattgattgaatggtggcttccccctttagcctgctggtcctgcgagggcatggacagtgtcttagtcacctctggagccctggtgcccactgcaggcctggatggtggctgggactcagtacaagtttactggtgaataatcaaangaatcacaaagtgacattgatggcaaaaactggttacggacagagcccacctatgttcttgactcattttggccacatccaatgttctcttgctaaagaaacatggacattctcaaatctcttctgagagccatgcaaaagccacatggcatggcaggcttgagcttaatggcatttgtggtgtcttttcccatttattgtgtgtgggatgaatatttggatctcagtttacctatcctaaaggcctgtttggtaataaaaatgaaataaaagcctcacagagttaccaaaa

SEQ ID NO: 534343 - DNA, 295 bp, Homo sapiens
agagcctccttgaagggctaccagtggttgaaggacaagatcctcagtgaggagggccggcgccagcaagccaagttgaaggagttgcaggccatcgccgagcgcttgggttgcaccctgccccagctggccatagcctggtgcctgaggaatgagggagtcagctccgtgttcctgggggcctccaatgcggaccagttcatggagaacattggggcaatacaggtccttccgaaactgttgttttccattatccacgagattgatagtattttgggcaataaaccctccagca

SEQ ID NO: 534344 - DNA, 395 bp, Homo sapiens
ctcctagaggatccccgatggccgaattccgcttaatagctgcgtaccatatctaaatcaagagtattattttgtaaaaacatgtactgctgactaagaacatccggatcttgtacgagaatgttaggaaacaaagacagtcgattcatattcatatcaacttgactttgaaaaaaaaacaactggtctaaacttgatttatttaactcatctgtgataatatttgtgctgacgtggttggaacatgcgtataataataaaatcggaataagcataaacaaaattaataaagttgttttcgtaaaaatattaagtgttttccacaataaagatccccccaaaataacaattactcaaacttgcattctttgtgttaaaactaataataaaagaga

SEQ ID NO: 534345 - DNA, 354 bp, Homo sapiens
  misc_feature (72)..(72): n is a, c, g, or t
  misc_feature (96)..(96): n is a, c, g, or t
agactctagcaggatcccccctacatttgcaggatgattctaaactacaactggttggtttctcctacgacntttcactaagctgtttagaactanaagggaaaagccgctaagttctgatggaatcttttgaaagcctacgtctgcttaatccaaatgtttcactggatcatcttacaggttttgccttttctctttatcactattctattgctatgtttgctctttcttcttggaggttcttggtatctatcatacatccaacttttactcttccacagacaatactatctacttttaaaatgttcgatttcaggtactatactgtagtagaaaatgtctgctttatggtaa

SEQ ID NO: 534346 - DNA, 719 bp, Homo sapiens
agcggagaggtttcagcaacaccagtggcctacaaagaaggagccttcctcctctccccagactccagactctaaagggcgacctcctcctgctcctgctcctggagcgcagcatagcgcacagcgtttccgcaggaatcttgagaatggcaaggcccgcatacccgtcggtggttcccaggcccgcccccatctcgcagactgcagccacagctgccagtgcgtgccgcctccgagcgacttccgggagccgggcggacaccgcggtgcaggcgcgcgcccaacggactttgcgaggctcactcggtctgagaggtcggaggctgacgagtgtcgctgctgaaggctgtggtggaccgggctggatcgcggatataggattagataatagatatgggatcgaccgataggagggcttggattgcggatatggggataggataggggatatggggctgggatcgagcgggggacaggggacggggcaggtgaaaaggtgaccagggacgctgcctcctcatcaagagcagattggtatgggagtctcgagaagtcaccaacatgacagtgtacggcttcaggagccacaggggccagacgggtccatgggcaaccatagaccacctgtacacgggttccgggtacccgaatcccggtaatcggaacttgcagaagatccacaaggcagactgtacaacgggcgaagcccgcgcgaatgc

SEQ ID NO: 534347 - DNA, 900 bp, Homo sapiens
ggggagcccccctttccaggggcggtccacaatatcaaccactggggcctaaacgacccattgggagacagtccttaacagggggtgctccgcacgcagacagctgtgctgccgaaaaggaaaccagtccgtgaaattgtctggaacgaccggcagacatgtgggagacacacaccgtgggactgcccgtggataaccccccataaggctagacagacacggcggtgtgcgcgcgtcctagcagcacacacaaggggtgcgacccccacacaaggtgctgtggaaaagcgcatgggacactctccgtcgggcagaacacacgccgtgtgacaaaagaaccgccgctcgacgcggggtatacccacgggcgagtgtttcagtcacaggcgtagtagtgactcaagggaagccgggtgggtcgctcgccaatataatcgtttgcggggaccgcgcaggtcatatgcttaacagtgcctttgggtcatgaaaatcatgaagtgttcccaaacagaatcgtgaaaggttgacaaactctgtagaagtactactaaggcgcatatttgccatcgttgtgaccacaaggagaacagcgcttgtctggggttctctcttcccgacaataatagagtttcagctttgctcagaatgaaactgactgtcgaattggtgtcagagacaaggatagtttgcaagcagcagagatctggcgatgggtggatgcatgcaccagctcactcttttaatgtggcgtgtggagacatactggtgggcggggtggcacacagacaggcaacgctctccctatccatgtgtgagatgaagaggcacgaggtgacgaagctgatgcgaccaccgtgaaagaagggttcttctaaagagaaaaccagcagacaaagacaa

SEQ ID NO: 534348 - DNA, 292 bp, Homo sapiens
  misc_feature (63)..(63): n is a, c, g, or t
tctcagaggatcccctcgaattcgacggtttctcgtctctctcacatcttgccttccaaaatngcgacactggactgtcagctatattacacacaaatgttaaaaaaaaaaaaaaaaaaaccggccttaaccaagaaattcccaaaggtccaaaactttcataaaacatttcatttttaccctacttgacccactttttggcaagggttacaacaaagggggcaaggcagacaggcgtagctggtgcattgtaaaaccctccttctcctttagaatggaaaccttccccttc

SEQ ID NO: 534349 - DNA, 186 bp, Homo sapiens
gaggcatccaggctcctccctgtgtctttgctgtacttcagactccatttatagagactgagggctgataacaggaatacagtggcaaagcactagactgtggaaagggtccagaaacctttttttttttttttttttttttttttttttttttttttttttttttttttttttttttttttttga

SEQ ID NO: 534350 - DNA, 582 bp, Homo sapiens
ctcctcacttgccctgcccctttgcactggtttgaattttgacctggtcccccacacgtgtgaagtgtagtggcaaccacatttctaaagtaatgcacattcaatcccacacgagttaatttaattggctggaagatggagaaatcaccacccaccctgacacggccttttgggcctcccaagcccacttccttggggttccccctccctgtgtgaaaatgtattattcacccacgcacgacacctgccgggcctccctcccgcggggcacctgcctgaaaggcgagtgtgggcactagcattagactgcttcctcccctcctggcaccccctgtggcctggcatcgcatcgtggtgtgtcaatagccaccaaaatcgtgtgtccgtgggacccagtcctagccgcgtgtgacagtcttgcattctgtttgtctcgtggggggaggtggaccagtcctgcggaaatgtgtcttgtctccctttggataaaaggagacccacccaccaaccatgccatcactgggatttccccccgctttgtgagccgtgtcgtatgacctagtaaactttgtacccattcca

SEQ ID NO: 534351 - DNA, 124 bp, Homo sapiens
ttgggagaggatgtgccattctccttagagagaagtgtggtggcttttaggatggcatgggacttcctgtaagaacgcatctcatattgggaatgactattaggaaaaacaacaattgtgcaat

SEQ ID NO: 534352 - DNA, 244 bp, Homo sapiens
cgatgccgttgctgtcgggaaccatgatcggcgccggcacgatcgccttcttgttgcggtcgagatatttgacgaattcctcgacaccgccggaatagtgcatctcctcgcgcttctcgaccgcgtggcgcatgtctgacagcacgatgtggacgccggaattgaggaaggcgagctcgcgcagccggtgctcgagcgtcgcgaaatcatattcgacgttcttgaaggtctcggtcgaggccaa

SEQ ID NO: 534353 - DNA, 1112 bp, Homo sapiens
agccgcgcgcgagtcagactcgggtgggggtcccgccgcctttgccgcccgtgcagcccggtggccgagtggcggcgtgtggaccgcgggttgggagacctggcctggcgcccaatggacaaatttgagcaacttctgaccccaccgtgcctggagcgcgcctccaagggctggcagcgcagatcttggagcagtcgcgttattgccaaggacgccctgaatctggcacagatgcagtagcagacgctgcagttggagcaacagtccaggctcataagagtatgcagtgcctgccgtggtagcgagctcatagagctgatcgagatccgggcgcaggttgaggagaggaggatgaccctgagcgaggagacccgggcatgcaccaggccaggtgcccaggtattcaagagcaatgctggcccgggcagcgctaggaggaccaactgaatctggagcaagttctcaatgaggagaattcaccggaagcaggaggagtccgtgcagaatccaggaagcctatgctgggagccaccggtgagcggtgagattgggcttgggtccaagacttgcgatgctgcgctttgtagtgccgtaggccgggcgcgcgtccaggccgagcggggagaattgctgacatcatccgggagcagatccggctgaaggcggtcgagccccggcagaccgtcttggacgtcccatcagggaacggctggcaccttggtttggggccagggttccggcctttgttggcgatttggccagtgtgaccagcacggtggctgggctgaacgcctgttggctcggtgggggctaccttcgggccaggaatgcgcggctttgttacaggcacggtccatcgaggggtccgcctgtgtggaagaaccggagcccataaatgagggaggggagaatcaccgcagattaacagagggtctttagagagccttgagaggcccccacccacaggttaacagaggggactcccatatagaagtacacaatagaccgtcgcacgtgagtagataggataacacaccacaacgagaaataaagagatcgctcggatatatacactaactaaaatgaacgcaacgacaaagagaacgaccata

SEQ ID NO: 534354 - DNA, 830 bp, Homo sapiens
atctcaatttgaattgtatctcccagaattcccacgtattgtgggagggcaccagagggaggtaattgaatcatggtgggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaagcatgtggaacctgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgtcatgaagcttccaaattttcccatatcttggccaggaattaataatggcctggcataggatggtagcctttcttagtgggtgtgcagtggtatcccattgtggtttcgattgcatttccctagtaatcaacggtatggataatcacttttcatgaaccttatttgacacttgtatgttcttgggataatgtctttccggtcctttgcctatttaaaaatggtagcaatttgtcctttaattgacatcatcatagtatcatggatccgggatagtagatccttatatatctataattgcacagtattgctctccatctgggtatggcttcactttcttgaccggcggccctgtacgacagcaaacagggtcgaactgtccacacacacacgacgccaacagcaaccacacaagcacc

SEQ ID NO: 534355 - DNA, 1250 bp, Homo sapiens
taggaagagctcttagagtgttattttatagccctcatttgagagggtgtgggcaggagcacagcctctgggtccaatccacaaactgccatctactagtccatttgtgagctggctggtaaattcaccttcctgggcctcagtttcttcatcagtaaaatgggataatgatggtgccttcctagttgggttgtggtgaaggttaaatgagatgccatgtggaagtgcagaggagaagggctgctataaggggctccaggtgggtgctgctgttatgattgggcacctactgcatgctgtgtccctgcatacaggagtcgacctttgagacctgcttattcatggctgtttcacggatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttcttgacaaggccttggaaacttggtctctgcagcagcaaccggatttcagcctgggcctcggacacctcggcctgggtacggatgcgacttggatgcagtccttccctggcagtggaggggatgcccaggctggcacaggagtctcgggtcctctccggctctaccccaatctgctgtgtgattttgggcccaggcagggacccctctgggctctgttactggagaaaaggcaaatggctggtacgggtgggtccccagccctccttgcctggaggtctgcgagttggagggctctggggtaaagccagagccgggcccggggagagcctgggctcatctctggtgaacagggtaccctctagccaaagcaggggcaaggcgaggcacatgcccctcatatgggagctggggctgaccccctctcctagccctgcacaccttgagcacgtggccttggcccatctgccctgtgggtggacactttccagccctgggtcctgaactctaccaatcagcaggaacctagactcctgaggggtgcagcctggatgggaggtcagggaactgggttcctgagcgcatctctgtgccattcatctctccattggtttcccaaatgtggactgagcacacactgtgagtcaggcctgagctaggttctagggatgctactgtcaacaagacagatgaaggttcctgccctcatggaggggagggaggcaataagcaaagaaataaatgcatgatgtaatgtc

SEQ ID NO: 534356 - DNA, 231 bp, Homo sapiens
gcaaaggggatgtaaatcacctgtctccgtcaaacccacgcctggggttgctgagggacccccctcgacccgtgcacgccgccgcatgagcggctgccagtgccgcacgacagacacaggccggaccagggcacacgccgacgtcaccgcgcacacacacacaccgcacgcacagccgcccaacacacaagcagagctgcagcgtcaacacccgacgaacccagcgtcttc

SEQ ID NO: 534357 - DNA, 369 bp, Homo sapiens
  misc_feature (97)..(97): n is a, c, g, or t
tttttgagacagggtgttgctccattgcccaggctgaagtgcagtggtgggatgataactcactgcagcctcaacttcctgggcttaacagatcctnccacctcagcctctcaagtagctgagattacaggtgcacaccaatacgcctggctaattaaaaaacaacaaacaaacaaacaaacaaacaaaaatatgttttttttgtagagtttcagaccagcctgggcaacccagtgagaccacatcgttgtagtggtcgggaagactgctccgagaggcagactgagggaaggaggatggacatctagatgtctgagggaagggccatttgggcagaggaaagagcacagggctcagtgtgtgtggggg

SEQ ID NO: 534358 - DNA, 640 bp, Homo sapiens
gataatggcagccctaggaaacaattcaattagaaaatgggcaaaagagatatttcaccaaagggaatatacagatggtaaataagtacataaacgtatgttcaaaatcattagctattagggaaatagaaattaaagccacaatgagaaattactaaattaaacctatcagaattgctaaaataaaaaattgtaacaacaccaaatgctggcaaggaatgcagagaaactagagcactttatcttgttggtgggaatataatatggtatagccactctggaaaatagtttgtcagtttcttgtaaaattaaacatgcaactgccatacaactcagcagttgcactcctgggcatttattccagggaaatgaaaacctatgttcacatacaaacctcaacacaaatgttcatagcagctttatctgtaatggtctaaaattagaaacaacccaaatatcattcaatgggtgaacgattaaacaaacttgaggtatgcacatcgtcaaatgccactcagcaataaaaagaaacaaactattgatagatgcaataatcagagtcactttccagataattatggtgaatgaaaaaagccaatccaggttcatactgtatagtaccttatctgagtctgtagaa

SEQ ID NO: 534359 - DNA, 1442 bp, Homo sapiens
taggaagagctcttagagtgttattttatagccctcatttgagagggtgtgggcaggagcacagcctctgggtccaatccacaaactgccatctactagtccatttgtgagctggctggtaaattcaccttcctgggcctcagtttcttcatcagtaaaatgggataatgatggtgccttcctagttgggttgtggtgaaggttaaatgagatgccatgtggaagtgcagaggagaagggctgctataaggggctccaggtgggtgctgctgttatgattgggcacctactgcatgctgtgtccctgcatacaggagtcgacctttgagacctgcttattcatggctgtttcacggatgtcgaagtggaggctcagcagggttggaggttcccggagtctcccagctgaaatggaagtgcttggtgaggtttggtgtgtccgagccgaagagcagccaatgacaggcctggggatcgtctggcacagcccacttcttgacaaggccttggaaacttggtctctgcagcagcaaccggatttcagcctgggcctcggacacctcggcctgggtacggatgcgacttggatgcagtccttccctggcagtggaggggatgcccaggctggcacaggagtctcgggtcctctccggctctaccccaatctgctgtgtgattttgggcccaggcagggacccctctgggctctgttactggagaaaaggcaaatggctggtacgggtgggtccccagccctccttgcctggaggtctgcgagttggagggctctggggtaaagccagagccgggcccggggagagcctgggctcatctctggtgaacagggtaccctctagccaaagcaggggcaaggcgaggcacatgcccctcatatgggagctggggctgaccccctctcctagccctgcacaccttgagcacgtggccttggcccatctgccctgtgggtggacactttccagccctgggtcctgaactctaccaatcagcaggaacctagactcctgaggggtgcagcctggatgggaggtcagggaactgggttcctgagcgcatctctgtgccattcatctctccattggtttcccaaatgtggactgagcacacactgtgagtcaggcctgagctaggttctagggatgctactgtcaacaagacagatgaaggttcctgccctcatggaggggagggaggcaataagcaaagaaataaatgcatgatgtaatgtcagccagggagcgatgctgcaaagcagggtgggcgtggggagtgacgcaggccggggttggggaggcatcgttgtagtggtcgggaagactgctccgagaggcagactgagggaaggaggatggacatctagatgtctgagggaagggccatttgggcagaggaaagagcacagggctcagtgtgtgtggggg

SEQ ID NO: 534360 - DNA, 805 bp, Homo sapiens
  misc_feature (97)..(97): n is a, c, g, or t
tttttgagacagggtgttgctccattgcccaggctgaagtgcagtggtgggatgataactcactgcagcctcaacttcctgggcttaacagatcctnccaccgggtgggtccccagccctccttgcctggaggtctgcgagttggagggctctggggtaaagccagagccgggcccggggagagcctgggctcatctctggtgaacagggtaccctctagccaaagcaggggcaaggcgaggcacatgcccctcatatgggagctggggctgaccccctctcctagccctgcacaccttgagcacgtggccttggcccatctgccctgtgggtggacactttccagccctgggtcctgaactctaccaatcagcaggaacctagactcctgaggggtgcagcctggatgggaggtcagggaactgggttcctgagcgcatctctgtgccattcatctctccattggtttcccaaatgtggactgagcacacactgtgagtcaggcctgagctaggttctagggatgctactgtcaacaagacagatgaaggttcctgccctcatggaggggagggaggcaataagcaaagaaataaatgcatgatgtaatgtcagccagggagcgatgctgcaaagcagggtgggcgtggggagtgacgcaggccggggttggggaggcatcgttgtagtggtcgggaagactgctccgagaggcagactgagggaaggaggatggacatctagatgtctgagggaagggccatttgggcagaggaaagagcacagggctcagtgtgtgtggggg

SEQ ID NO: 534361 - DNA, 349 bp, Homo sapiens
  misc_feature (3)..(3): n is a, c, g, or t
agnattctagagtacccttccggtgtcttaacacacaaaagaggaatgagggatacttataagggcaggtgaaaatgacagcagtcattcgaaactatggaggcggggaggaagtagcaaatttttccaatcaccaacaaaaaaagaccggtgtcacagcacattttggctatctgggtacaaaccatccttctcaaacaatgcaaagggaaattcaagaatgttccttacatgcacagaagggtaggagaacgatgttagcaacacctgtcctaatggggagaagagttgctatacaatatcctaacacagaaataatagattagggacaccggaaaataggggggtc

SEQ ID NO: 534362 - DNA, 222 bp, Homo sapiens
  misc_feature (219)..(219): n is a, c, g, or t
catggaggacaagactagttgaggccatcgactggaggtaaggctggctgcgagcacgggatgcatgctggccgcctgggacgccgcatggcgttccgtctacagtcaactgggcagccgtccaagagaacttaagtcaatcaacagacgtggactgaggcgaagagactgatgcacccacctggatggcccaagtcgacgcgacgcgcacgttgacancga

SEQ ID NO: 534363 - DNA, 633 bp, Homo sapiens
cgctctagagggggtagagggggtgctatagttttagaacagtgcattttatgacttccaaatccaagctaatcttatggctggggtctctgagcatgctggattacagccccacaccaccatatctggttaatttccggatattaattaatagagcctgggtttaaccatgttcgccaggctgatcttgaagtccagacctcaagtgatctgcccgccttgacctcccaaagtacctgcattacaagaatgagccaccgtggccagcctattctgttaaattaaagggcttttactctccagtctaaaaagcacaccacgtcctgctaaatcttagaccgtatcatcagtcagatgctcatcttcagacccacgaaaagatgattatcataataacctgcattaatgagacccaatgtcagaaattaagacttgtgaactcttctaaacccagagactgtcatagaagacattcgtttgcgaaattataagggccaactttgagagataacttacataagagtttccatataattaccccataatactataggttgctgaatagaccacatcacgccccctgttttaattaaacacgctcttattgcctcacccgactttttattaaaaacg

SEQ ID NO: 534364 - DNA, 349 bp, Homo sapiens
tgcatgattattgtgaatatttctaagtacctgtttaattcaccattacaactgaaagtcacatcggaaaagatcagctgggcgcggtggctcacgcctgtggtctcagcactttgggaggccgaggtgggcgggtcgcttgagcccaggcgttcaagaccagcctgggcagcacggtcaaacccccatctctacaaaaaaatacaatagttagccgggtgtggcggtgctcacctgtagtcccagctagtcgggaagagcccaggaggcggaggttgcagtgagccgagatcgcgccgccgtcgcattccagcctgggtgacagagcgagactcgtctcaaaaaaaaa

SEQ ID NO: 534365 - DNA, 246 bp, Homo sapiens
ccagaaacattttcccattattctttcatactataggagctaaacttgcgggctatttatgtaaaaaattttaggataaacaaattttttctttataacatttgtcacagtgacatattcttatgcacacataaagagtacccagataatacactgtatgttctggaggaaactgttatggaagacctaggcttaaaactcacttaataatgaaggtggggaaatagattacagttcttcttaaga

SEQ ID NO: 534366 - DNA, 999 bp, Homo sapiens
  misc_feature (177)..(177): n is a, c, g, or t
  misc_feature (304)..(304): n is a, c, g, or t
  misc_feature (532)..(532): n is a, c, g, or t
  misc_feature (581)..(581): n is a, c, g, or t
  misc_feature (990)..(990): n is a, c, g, or t
gaggaggctcattttgttgggcaccccgggacctcccgccactttaagggcccggcgcacgcaccagtccgttcctatgggcgggcgctgacgctgccgccgcacaacccaagagaagcagggagaagagcgcgggcaggagctaggctcgggtgccatgtcgaggacaaaggcggnctaatgggtataatactcaacttatctgattggttgatgtgatttagtcgatagagcgctccatacaaaacgaaaaaataatatgaggcactggaaaacggtccataaagagtccgagaggagaggnaggtaatcgaaagttggataaagaaataagtaataaaaaaccacttatgacaaaaccggcgcggtgggggagcagacacaggaggccgcgcagtaagccgcgcgcgacacaaaacaccacacataacaacgtgcagaccgaggagcagaacgacagaaagaaacgatcacgagaaggataatccgtaatgattaaattctcacaaactgtcacaagcaaccactcatnatatacatttatatttgcattattcactaggtccagcaacgccaacgangcttgcaacatataaccacttcaaccatcgacactcataacgtagtgatcggataggtgttagacgttattgttggttattagcgggtgtgagtgagtatgtaggtcgggtggagatcagaaagaacacaaataaaggtgctgatataaaacctacttatcgtagtgtgatcagtctgcggtcacggtgattggcgttgaggttatatcgatgtatcagtaacaagtaatgtctatacacccacacttctctcgtcattcctatactacctactcatcgaccgacagcacgatcgataaggctcatacactaattatctttaactcctactcatcatccacatatgaactgtatgagagattgctagttagaatatcgaaaatagagatgaattaaatgataatatcantgtatctct

SEQ ID NO: 534367 - DNA, 285 bp, Homo sapiens
  misc_feature (6)..(6): n is a, c, g, or t
  misc_feature (33)..(33): n is a, c, g, or t
  misc_feature (91)..(91): n is a, c, g, or t
  misc_feature (153)..(153): n is a, c, g, or t
  misc_feature (180)..(180): n is a, c, g, or t
  misc_feature (221)..(221): n is a, c, g, or t
aaaaanttggctgggcgtggtggtgggcacctntggtcccagctgctcgggaggctgaggcaggagaaaggcatgattccaggaggcgganttgcagtgagctgagatcacgccattgcactccagcctgggcaacagtgttaagactctgtntcaaatataaataaataaataaataantaaaaataaagcggagatgttgccctcaaacttcacctggncccggtcctggtttgctaatggctgtggggtgggggttactgtggggtgatgactgacttggtt

SEQ ID NO: 534368 - DNA, 209 bp, Homo sapiens
  misc_feature (1)..(1): n is a, c, g, or t
nagctgacaccctgctgtgcctgagggggttaattaaaatggaataatttttcagatggataaggcttttgtaaaagaagggtagagccaggtgtgttggcacactcctttaatcccagcacttgggaggcaaaaggctggagggttgctgtgagcttaggcagccttatgtacacagtgagactttctctcctccccaaccccagaag

SEQ ID NO: 534369 - DNA, 485 bp, Homo sapiens
  misc_feature (235)..(235): n is a, c, g, or t
  misc_feature (402)..(402): n is a, c, g, or t
tctctcggcttagcgcattttttgggaaacctctgcgccatgagagccaagtggaggaagaagcgaatgcgcaggtgaaggcaaaagaagaacagatgaggcagagggtccaatgtaaacccgctagcttgtggcaccggtggagggccacagggagcagaaacatggaatgccagacgctgggggaatgcctgggtaacaaatgtggttggggacctggcaattgctaatggtnctaaagaagcctttgtcctccaaagtggacttctaagaaaccttacatcggcccttctgaatcggccagatcaactttctgtgaggaccccaacctttgcttcattaagacaaatatggccccattgttgtggtccctcttgcccttggagaccttggtggacattntcgtggaccaatttcgtcgtggtaaatttgtggtggcgccggaggttgtaacaacccattattagataaattcaccttctttc

SEQ ID NO: 534370 - DNA, 531 bp, Homo sapiens
aaatggatacgctagctaaaactaaaagttatttaaaagaacgggggtcaggacatagattatcgtgcatcaccaaaatcatctaattctggccgggcacggtggttcacacctacaatcccagcacttgggaggctgaggcgggtgggtcatttgaggtcaggaatttgagaccagcctggccaacatggtgaaaccccatctctactaaaaacacaaaattagctgggcatgttggcgcacgtctgttgtcccagctaatcaggaggctgaggcagaagaattgcttcaacctgggaggtggaggttgcagtgagccaagattgtgccacttccagcctaggtgacagagtgagactccgtctcaaaaaaaaaaaaaaaaaaagaaaaaagaatttctatggtgtaaaaggcaaagttccctcttcaaggctcccccttaaactcataaatgtaatggatatcttttctcagaactaccttcctccaagtccctaagttcatagtaatacctctcggtaaagccttatg

SEQ ID NO: 534371 - DNA, 292 bp, Homo sapiens
aaaaaaaaaaaaacccccaaaaaaaggggttttttttctccgggtttttttttttctttggggggcccctttcgggggaaaaacggccccctttttcccccccggggggggtttttttttttttttgggggggggggggaaaaaggccccccccaaaaaaatgggggcccggccttttttgcccccttaaaaatttttttgggggggggggggggccccccttggggggttttttttttcccccccccccccccttttttgggtaaaattttgggaagggggagggggggga

SEQ ID NO: 534372 - DNA, 385 bp, Homo sapiens
gagctctgaatacgcggtaggtgcctccgagatcgttgtggcccatgccttgacagaaataatccaaggttcatgacttggtgagaaccaatgggcatacagggctgttgcccaggccctagatgtcattcctcgtaccctgatccagaactgtggggccagcaccatccgtctacttacctctcttcggtgccaagcacacccaggatgaactgtgatgacctccggtctccctggtgagacgggtatcttcggtggacatgaatgaactgtgcatatgggagccactctggcttgtacgctgcagacttatcagacagcagtggagacggcagttctgctactgcgaattgatgacatcgtttcaggccacaaaaagacaggc

SEQ ID NO: 534373 - DNA, 242 bp, Homo sapiens
aagaggcctcctgttgcgctcagcagggaaaaaggaaaacccttcaaaggagagacttggataatgcaataaaagctgtggatgaatttgcttttttgcaaggtcttcccctgtttctgtctgttttccatatcaagcctggatgcagctgctgctgcttagagcaaagatgaagaaagtgttttgcataagtggcttcctgaatgatgagggccagaataaaggtttttcgtcccccccca

SEQ ID NO: 534374 - DNA, 256 bp, Homo sapiens
  misc_feature (137)..(137): n is a, c, g, or t
ttggttctttcctctctttctttctttcttttcttcctttcctgcctttccctttcccggcctttccctttccctttcccttgcctttcctttcttttcttttctttttgaggcagggtcttgctcctgttgcccanggctggagtgcagtggcacaatcttggctcactgcgacctctgcctcctgggttcaagccattcggatgcctcagcctcccgagtagctgagattacaggcatgcaccaccgtgcctgg

SEQ ID NO: 534375 - DNA, 357 bp, Homo sapiens
  misc_feature (79)..(79): n is a, c, g, or t
  misc_feature (87)..(87): n is a, c, g, or t
  misc_feature (90)..(90): n is a, c, g, or t
  misc_feature (95)..(95): n is a, c, g, or t
  misc_feature (132)..(132): n is a, c, g, or t
  misc_feature (136)..(136): n is a, c, g, or t
  misc_feature (164)..(164): n is a, c, g, or t
  misc_feature (190)..(190): n is a, c, g, or t
  misc_feature (212)..(212): n is a, c, g, or t
  misc_feature (242)..(242): n is a, c, g, or t
  misc_feature (279)..(279): n is a, c, g, or t
  misc_feature (301)..(301): n is a, c, g, or t
tggttttttggatggttcccaaagggtttccatggggtaggaggatgggctcgccccccagtgactttttttaaaagcncccggggnggnggaanaggggacaggtccctccccccccccaatcctattttngggntgaaaaccctgggtggggacagggctcncctcaggaatgggctgtttttggccnaaccctcaaaaaccctgggggnggcccaaacttttggttttttcaacagganaattttactgggttttttttggttccattgtttgganacattcctgggcccagtttggnccgttaaaattaaaagttgaattttttttttttttaaatttttttttttcccccca

SEQ ID NO: 534376 - DNA, 178 bp, Homo sapiens
ccagaatatggtgagtcgcagtgggcaaagtagtcaggatcacgacattaccgtgctgcctaataagttgcttttaatccaatccagtaacactttagttatatgcactggttttacacagagaagtacaaaataaagatcacacatcaagactatctacaaaaatttactatatata

SEQ ID NO: 534377 - DNA, 145 bp, Homo sapiens
tctagggtgttgtgcgtgtagtttagtgcgatgagttggggaaggggtcggtactagtggtgtcgcactaggaagtatgtgcctgcgttcaggcgtcatgctggttgacctcatcgggctgcatgatacccaggagccgtggcat

SEQ ID NO: 534378 - DNA, 452 bp, Homo sapiens
tcctagctcgcccgtactccaacagcatgtgatactcgtctccatggagtcgatccaccgacataggagtctgcaagcgcttccgctggagcatgtttggtgaattccatgttggataggcttcatgcgccccgtgtagggcatgatccaatgtttgtccggattggacgcgtaatttgtagctcggcgtgatgtgctgagatgcgtttgtaatgagtgcgttacatattgtggggctgaatcctcagtgcgccgatgtcggaggctgcatggttgatgaccatgacgactggcctttgtacaacaatcttcttggacgtgcggaagaagctcacgctgtcattggtgatgaggtctgtgaggtaatccttggagtagtcggagccgtgcttctctttcaccccgttccgacacagcgtgtagttataaaagcgggagtccctaaggagtcc

SEQ ID NO: 534379 - DNA, 248 bp, Homo sapiens
cacgaggtgctggtccagaggaggggaaggggaccacggtcccggtgtgattggggaccatttggcaggacacacggttcatagaggcttcatttgttagtctcttgacataatacatggcttcaggacgtgggaatgttttgtcttaattcatcctaaaaaggggtttaatatgtttcaggcttaggaatatccatactgcttaacattttttattctggtggacttatgctttaagttgcaaacca

SEQ ID NO: 534380 - DNA, 339 bp, Homo sapiens
  misc_feature (33)..(33): n is a, c, g, or t
  misc_feature (76)..(76): n is a, c, g, or t
  misc_feature (86)..(86): n is a, c, g, or t
  misc_feature (157)..(157): n is a, c, g, or t
  misc_feature (175)..(175): n is a, c, g, or t
  misc_feature (244)..(244): n is a, c, g, or t
ctttgcataacagccaaaactggaagggatctnaagggccctggctggccacagcagcatcagccatggagaaaanaaagggcaanaaggggctgggtgcagtggctcatgcctgtaaacccaggtgtgagtttgagaccagcctagctaacatggnaaaaccccgtccctattnaaaatacagaacattggccaagtgtggtggtgcatgcctgtagtcccagctacttgggaggctgaggcnggagaattgcttgaactcaggaggtggaggttgcagtgagccgagattgtgccaccacactcccacctgggtgacagagagagactccatctcgg

SEQ ID NO: 534381 - DNA, 254 bp, Homo sapiens
atcctcgtgaaaaaagctgacattgaaagattttgaagagcttagttaaaaagttaaaaacagcccagcgcagtggctgacgcctgtgatcccagcactttgagaggctgaggtgggcggatcacttgaggtcaggagttcgagaccagcctggccaacatggcgaggccccgtctctgctaaaaatacaaaaagaaatagccaggcgtggtgatgcatgcctgtaatcccagctactcgggagactgaggcag

SEQ ID NO: 534382 - DNA, 928 bp, Homo sapiens
  misc_feature (71)..(71): n is a, c, g, or t
  misc_feature (90)..(90): n is a, c, g, or t
  misc_feature (133)..(133): n is a, c, g, or t
  misc_feature (152)..(152): n is a, c, g, or t
  misc_feature (155)..(155): n is a, c, g, or t
  misc_feature (176)..(176): n is a, c, g, or t
  misc_feature (194)..(194): n is a, c, g, or t
  misc_feature (198)..(198): n is a, c, g, or t
  misc_feature (209)..(210): n is a, c, g, or t
  misc_feature (213)..(213): n is a, c, g, or t
  misc_feature (227)..(227): n is a, c, g, or t
  misc_feature (229)..(232): n is a, c, g, or t
  misc_feature (235)..(235): n is a, c, g, or t
  misc_feature (270)..(271): n is a, c, g, or t
  misc_feature (276)..(276): n is a, c, g, or t
  misc_feature (285)..(285): n is a, c, g, or t
  misc_feature (294)..(294): n is a, c, g, or t
  misc_feature (299)..(299): n is a, c, g, or t
  misc_feature (322)..(322): n is a, c, g, or t
  misc_feature (338)..(338): n is a, c, g, or t
  misc_feature (353)..(354): n is a, c, g, or t
  misc_feature (356)..(356): n is a, c, g, or t
  misc_feature (375)..(376): n is a, c, g, or t
  misc_feature (388)..(388): n is a, c, g, or t
  misc_feature (399)..(399): n is a, c, g, or t
  misc_feature (404)..(405): n is a, c, g, or t
  misc_feature (410)..(410): n is a, c, g, or t
  misc_feature (447)..(447): n is a, c, g, or t
  misc_feature (459)..(459): n is a, c, g, or t
  misc_feature (465)..(465): n is a, c, g, or t
  misc_feature (469)..(469): n is a, c, g, or t
  misc_feature (473)..(474): n is a, c, g, or t
  misc_feature (741)..(741): n is a, c, g, or t
tccgtacagccaagatgcagcagcatgtgtgtgaaaccatcatccgcatctttaaaagacatggagctgtncagttgtgtactccactantgcttccccgaaacagacaaatatatgagcacaacgaagctgncctattcatggaccacagnggnatgctggtgatgcttcctttngacctgcggatccctttngcangatatgtggcnnganataatatattgaantnnnnaancgatactgcgtagtaacgtgtgttcaggccgcgcnnagttnagatcgatntcatcccanagaanttctggagtgtgcatttgatatngtctactgctaccacnctaacagctttctgnncnactgctgaaattatctacnnctatctatgaanatcatccaagnagttnnccagncacttcaggaatagaagattacagtattgtatttganccataccatgtnattganagcnatanncttacactgtgggatcccagaagataaactcagtcaagtctacattattctgtaatgatgctgtgacagagaagctgacgaggagagaagtggaagctaaagtttgtaatctgtctttgtcttctaatagtctgtgtcgactcaccccgggttttatggaccagaagggagatttgccagatcttatgccaacaataaattcattaataaaacagaaaacaggtattgcacagtttggtgaagtatggcttaaaaagatctagaggnaggttgttggactgttgaagaaactcgggcttcaagtttacggtcttgtatccactttggggtctgggttaccaggggggcggcgccccaagggatctcttccagttggggggtttcactacaaacgaaggcaaaggggtgtccggaaaactcgccggtggaggggatttaccgctgttcccccggt

SEQ ID NO: 534383 - DNA, 1178 bp, Homo sapiens
  misc_feature (628)..(628): n is a, c, g, or t
  misc_feature (1103)..(1103): n is a, c, g, or t
ggcttccggtagcgtggctgacgcctcgctcaatttctcacagggctgcgcaggtttcccccgtctgcgaatggaccactggaggggttcaaaggttcgcgtcccagtacgggaatgagcctctttgatctcttccggggctttttcgggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagacgatatgggggcctggaccttggccttcccatccttcctgaacttccaggtcctgagtcagagaccacctggtgagagactacgggagggacagacacttcgggactcaatggcttaagtatccagatagtcaccagcccaggatctttgggggggtcttggagagtgatgcaagaaggtgaatccccccaagcagcaccagactggggctcccagaggccatttcatagcttngatgatgtatggctatggaccccatcctagaaccagagaggacaatgatcttgatgcccaggtttcccaggagggtcttggccggttctacagcccagccaaatctatttcaagagcatctctgtgaccaagatcactaaagcagatggactagtggaggaagcgcggactgtggtgggacagcgaggggcgggccagagaactacaggaaagcgacacgaaggagatagcacgccttagggtgatcccggaatcacgaagaactccagtctgggagaaagcgtctccacctggaagatcctggggcgtgggtaccggggccggaggctggttaaccctaaagagccaaaaggtcattaagactcttacctgtggccattaaaaggatgttccttggccccaggggggagctactgagtaaaactggggcgcgagtagtggtgtcccagcgggaagtctttttgagaaacaaaanacgcctctcgtgggcggagaggcggctgacgtagaggctcatcgtcaaagatagagaaggcaagtagcacattgc

SEQ ID NO: 534384 - DNA, 214 bp, Homo sapiens
gaaagcccagttacctttcacaagccatcattctttcccattatgacacacgatagccaacctcatgcacaccatgattcacgaggctgagtacaggacgagacatagtagacaccacttctgagagcaagaaagaaggatgacgcgcatactacaccagcagacactgacactttatagcccacagcttctttcaacacatattctctgacat

SEQ ID NO: 534385 - DNA, 952 bp, Homo sapiens
gttcacatgtccgtcgccgttttttcccgcccccctttgtgtattattggcacacccacctggtgcatcgcccccccccccttgagaaatttttaacgggccgccgccccgtttaacgctctgttaaagaagggcccggctttgctccacggccttcctctatgtaaaacccccccttggtgaaatactgattctcgccttcatcgccgggatcaaaaagcagttctctccacataaaatattgtcgtgtcaatggaggaccactctttcctttaaaaacgagagtttgttacaaagatccggacccccaaacttgtcgtttctagaaagtaacgccatccattatttgaccccgacaacgctgcttctttcccgcgagacgctattctgtcctgtagaaggtctccaatcgggccaagcgatttattctacgaatgaggcacactccttggggaagacagcagattccctggggccacccaccctcgttattgatagttattaaatggaccagagaagggagctcctcttgctggcggaaccacacaagaaggtagtgtctcccccccctccaccatagtgggtggacaattataccaaggaaccccctctgcgtttcgcacactggagactctccttggttaaacaaaattatttattattcaagaggaattccccctcacctatgctagagtcacttctctcttagaggtcttcttcttattaataaggagataaaatccccccaaacacttgttatttaatagtcccaccgatacatcggagaccacgccatcttataaatgcgcccccaaaattccccaagtggtgcccgcgatgtcacggtgcgaagcctacacaccccaggttattagctatttaatatgttaattatactatgctctcgcacaaaagggataaaaatttcttttggcgaacacaacaaaacaca

SEQ ID NO: 534386 - DNA, 1211 bp, Homo sapiens
  misc_feature (661)..(661): n is a, c, g, or t
  misc_feature (1136)..(1136): n is a, c, g, or t
gaggaggaaggcggtcagtaggaaactgagagtgctgtcacgcccactcccgtcacggaagactggtctctgaaagggctgcgcaggtttcccccgtctgcgaatggaccactggaggggttcaaaggttcgcgtcccagtacgggaatgagcctctttgatctcttccggggctttttcgggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagacgatatgggggcctggaccttggccttcccatccttcctgaacttccaggtcctgagtcagagaccacctggtgagagactacgggagggacagacacttcgggactcaatggcttaagtatccagatagtcaccagcccaggatctttgggggggtcttggagagtgatgcaagaaggtgaatccccccaagcagcaccagactggggctcccagaggccatttcatagcttngatgatgtatggctatggaccccatcctagaaccagagaggacaatgatcttgatgcccaggtttcccaggagggtcttggccggttctacagcccagccaaatctatttcaagagcatctctgtgaccaagatcactaaagcagatggactagtggaggaagcgcggactgtggtgggacagcgaggggcgggccagagaactacaggaaagcgacacgaaggagatagcacgccttagggtgatcccggaatcacgaagaactccagtctgggagaaagcgtctccacctggaagatcctggggcgtgggtaccggggccggaggctggttaaccctaaagagccaaaaggtcattaagactcttacctgtggccattaaaaggatgttccttggccccaggggggagctactgagtaaaactggggcgcgagtagtggtgtcccagcgggaagtctttttgagaaacaaaanacgcctctcgtgggcggagaggcggctgacgtagaggctcatcgtcaaagatagagaaggcaagtagcacattgc

SEQ ID NO: 534387 - DNA, 393 bp, Homo sapiens
  misc_feature (317)..(317): n is a, c, g, or t
  misc_feature (372)..(372): n is a, c, g, or t
ctttttttcccctcccagttaaactcaggcaaagcatgtcttcaaaactatgtagggagctgatatacatgggtacttattaaaatggacagtaacaagtaaatatccttattatacaactacctgatttatgtgaaatgcatttgacaagccaaaaatctgggatgaagaaatctgaggggaataaaatcatacccctgggattcacttcccaaggtatatatattttttaagttaatttgggaaattaacagcatttcacttttcctgcaagtcctttgccacatccgaccttatccaagcctggttggttaatncatttggaagccacctggttggttgggctgtgttgacaggtgccgtgtggttatnggaaggcacaactggggtttt

SEQ ID NO: 534388 - DNA, 271 bp, Homo sapiens
  misc_feature (10)..(10): n is a, c, g, or t
  misc_feature (13)..(13): n is a, c, g, or t
gggtttcccnccnccccccaattcccccccccctccccttatttccccgggcccccttgagaaggagccttttattcccaagggggggcactttatttttaaaaagggtgccagggttcatgcttgttgcccaaaccgtttagggccctcttggttcaggttttttttttcttcccaggggcccttagctgttgggggcggggtcccccccatattgttatgccgaggggttctttaggaaaaacttttttatttttttaaaaatttttta

SEQ ID NO: 534389 - DNA, 714 bp, Homo sapiens
  misc_feature (705)..(705): n is a, c, g, or t
ctctagagatcccccctaaccagtgagctgtatcctgccctgcgagttgcagtggaggtgaggcctgcagtccctcattgctcagccttgtagattcaggccctttcctgggagtctgcaaaggagcctggcctcccccattgccagaactgcagctactggtgttggggtgctggagaatccaaggctccttcgactctgcttgtgcctgtgtggcttggtctgctcagactccccacagcacttcatgtgggtgtggaggctcctgtgttgggaaatcacagggaatgtcctgagcccagggatgcaaaggctgtagcagaagtatgagtccctgcagactatcactcagtcactcatcatttccccacagtataggggtctcctctatctccatgccagttccaggtaggcagtcgtcctatcttgctcttctctgttctctgtgggtaacattgtttccttgatgaatcccaatgtgtccacctggatgttctagttgaagagctagtgttacttgttacttttccttctttccacgagagcagcacacactagctgcttctagtcagccatcttggccccagaacctggttttctcatatttttgacttgtgatttatgatgcaaaagaagtgtcagtttgtggacacatcagaaattacattaattgtttctgatatttcatctccaaataaaaatcanacctgtaaa

SEQ ID NO: 534390 - DNA, 795 bp, Homo sapiens
ggctgcagcccgggtagggccaggagagcctggtccacgtttgcaaacgcagctgaacgcccagtgccgaccctgtgcgcgccgagcgcctgctgctgcgtcctgtgccactcttctcgccgcccgatggcgtcctggggctggatggccccctgtcgccacctgctgctcctgctgctgctctgggtgacctgggcatggcatgcgccctgtggcggtgcctgggctccgactgcggagctgcagatctgagcggcgcttcgtgcccgacgagtgcccgcgcaccgttgctgcatctggcgacttcgtgctgctaccactacgtggggacgttccccgacggccagaagttcgacctccagctatgacatcacactccactttcaattgtgctcgtgggaaaaggacatgctgatcacagggatgcaccatggctcttgttgggatgtgcgtaaacgatcagacgttttcgtgaacattcccccaaagcttgcctacgcgacactgcacggagtctcttgttgtgatccccctcccaattcatctcgcttcatttttgatgtaccttctgcatgggcatcatctcgtgcaacttcttgacgcgatcaggttcagcattcacacctatttcaagccccccgatcgttgcccttcggaacccatccagggtgttctggattcatcggtgacgggtacccactttaacactggtcacgttccttgggactggtacctctgctcgagttccgagtctccattcgcctttatactcattattaaccggtatgtccgaac

SEQ ID NO: 534391 - DNA, 137 bp, Homo sapiens
atattgaattattgtcataagccacgcttgtagattatattcatgtactgacttcaaattggggtaccccctattcaatattttgctctactaatcctcagtctgttaatcgatgccttgggtactacgctttggca

SEQ ID NO: 534392 - DNA, 149 bp, Homo sapiens
ggtgactctagcggatcttcaacacgcatctacatcttgacttcttaggatcaaactaacattgtgagagacctttactgcataacttgttagttttcacatcactgtacaagtgtggctttcatgataagaaagaggagctgagacat

SEQ ID NO: 534393 - DNA, 1001 bp, Homo sapiens
  misc_feature (56)..(56): n is a, c, g, or t
caaaaatttttttggggaacaaacaaccagagaaggagatgtgaacgtgtacaagntcgcacaaggagaggagccccaccacggagaaatataaggtccttcgccccatataagcgggggcacaaccaggcggtcaagaaaaggtgtgctggtcgccagacgccccgcggccgcagggtgaatgttccccccccacaccacctggcgaagccccaccgggagacctccttgtgtttgtctctgaatgagagggtggcaacagacacccgcaggaggggatcacacacctcgaatacctctggggggtttggacatacaagcccccccccggggggagactcctgttgggcccccccacaggggttaagcgaccgcccccagtcttttcacccaagttttctccctttgtgtgaaaagatattctatttcccccctccttctcgttgctcgttagtgtgaacccgtggtaaccaagtttgtagtttttatagtacaccgcacccatagtgcctcgatgacgacacccatttgcgaacaccactggagcgacaggcgttaaggtgcgtggggttcgtgagcgccacccagggcacagaggggagagtgagggcccttccctcccacttcatggatgactacttagcactcgccctcttctgtgtggcaagtacacaatttcgaggactgcacaccacgcacagcactgctcctctttggaaaatatcttttgcctcccgagattgttttaaagtccattagaatacaaggtcctgaagtcccccgacctgttcaagaagagcctttacaagggccacgctccctcacaccaagagaggcctggcacaccccccctggtggcacccttatgagagaggaaagaagaggtccctttggtttttatttccattttttttttccgagggcccccgagctttttccaatttaaaccctgggtgttgatcaattgggggaaaccaaataatccctttgtcaaatttata

SEQ ID NO: 534394 - DNA, 612 bp, Homo sapiens
  misc_feature (47)..(47): n is a, c, g, or t
taccatgttttttctctccccccccacccccccgaggaggaaaaaanaaaaaaaacccccccccccccccccccaaggaaaaaaaacccccccccaaaaaggggggggcgcgcgcgttttttaaaaaaaaaaaaaaagacccccccccccccttttttttttctctttggagagggggggagaaatttttttttttttttcccaaaaaagaaagggggtgttttttttttttcctggggggccccaagaaaaaaaaaaaggtttccccccccccaggtccccccctcttaaaaaaaaaaaaaaggagcgcctctccttttttttttttcccaaaaaagattttttccccccacaaaaaataaaaaaaaaagtttttttgtccccaattttcccccccaatattcccaccggggggcctggggaacaccaaaaaacccccctttttttaaagggcccaaaattttccgaattttaaaaatttttttcaaaaattacccccagtcaacccggaccccccgggtgcactcattttcccccggtcaataaaaaagggagctgggcttccctgccatgaaagcagtctcctggagtttctctaagcttgtaaacgct

SEQ ID NO: 534395 - DNA, 394 bp, Homo sapiens
cgtcatccgcatcaacaagatgttgtcctgtgctggggcgtattatgaagtgttggatcactgctcctccatcctcaacaagtatgatgacaatgtcaaggcttacttcaagaggggtaaggcccatgctgccgtgtggaatgcccaggaggcccaggctgactttgccaaggtgttggagctagaccctgccctggcgcctgtggtaagcagagagctgcgggccctggagacacggatccggcagaaggatgaggaggacaaagctcgcttccggggcatcttttcccactgacagggccccagttctgccctgccttgccatgccctgccctgccctgccaagcccactgctgccaccacctgtcaatcccccactgtcactttgcgcttc

SEQ ID NO: 534396 - DNA, 719 bp, Homo sapiens
  misc_feature (511)..(511): n is a, c, g, or t
  misc_feature (552)..(552): n is a, c, g, or t
  misc_feature (574)..(574): n is a, c, g, or t
  misc_feature (589)..(589): n is a, c, g, or t
  misc_feature (613)..(613): n is a, c, g, or t
  misc_feature (624)..(624): n is a, c, g, or t
  misc_feature (699)..(699): n is a, c, g, or t
gaatgctggaccagcgatacgtaacgatagtgttcagactcaccacctaccccgtcacccgaaacaagcgcatgaatgtcttcatcatttcagctttgcgatctgccagatctttgaagcgctggaatacatcattgagggcctgctcgctctccatttcaatgccgagagcctctaatcgttgcttgaaggcgtttcgacccgatagcttgcccagcacaattttgtttgctgaccaacccacgtcttcggcagtcatgatttcgtaggtctggcgagccttgagcacaccgtcctggtgaataccagacgcatgggcaaaggcattggcacccacaattgctttgttgggctgcaccacgaaaccggtaatattgctgaccaggcggctggcggacacgatctgggtggtgtcgatgcccacatccagatcgaagaaatcccgacgggttttgacggccatcacaatctcttcaagcgagcagttgccagcgcgttcgcccaatccgtngattgtgcactcgacctgacgttgctcaccaatggcaacanctgccagtgagttggccaccgncatgcccaagtcgtngtggcagtgaaccgaccacactgncttgtcgctgntgggcgtcaatgtgcgctcacgcatgaatttcgcgtacagcgagggcacagcatagccctacggtgtccggtgtngattgttttgcacctgcttg

SEQ ID NO: 534397 - DNA, 167 bp, Homo sapiens
  misc_feature (116)..(116): n is a, c, g, or t
cttaaacttcagacttcctgtcctgctggtatcatggagaaagtccaatacctcactcgcaagcctaagaagagctcaaccattgaatgctcaacaagcgtaaaagcccagatctnattataatttctgtctcatcttaatatgtctcttgctgatctgtatcatcg

SEQ ID NO: 534398 - DNA, 112 bp, Homo sapiens
ggctcccacttctacgctgccctgtctgggtgacagagtgacgactctgcttaaaatttttttacaagtctagaaataaacccatacatttatggtcacttgcttttttttt

SEQ ID NO: 534399 - DNA, 239 bp, Homo sapiens
  misc_feature (2)..(2): n is a, c, g, or t
  misc_feature (27)..(28): n is a, c, g, or t
  misc_feature (44)..(44): n is a, c, g, or t
  misc_feature (46)..(46): n is a, c, g, or t
  misc_feature (50)..(52): n is a, c, g, or t
  misc_feature (57)..(57): n is a, c, g, or t
  misc_feature (61)..(61): n is a, c, g, or t
  misc_feature (188)..(188): n is a, c, g, or t
  misc_feature (218)..(219): n is a, c, g, or t
  misc_feature (222)..(222): n is a, c, g, or t
tnaaaagctacctttattgtatattanntttcttaatacttaantntttnnnacttnagancaccgtggaatactatgcagccataataaaggatgagttcatgtcctttgtagggacatggatgaacctggaaaccatcattctcagcaaactatcgcaaggacagaaaaccaaagaccgcatgttnttactcacaggtgggaattgaacatgagannccntggacacaggaaaggga

SEQ ID NO: 534400 - DNA, 103 bp, Homo sapiens
catccctacgcggcggcgcgggtactctgatgttccccatgaacgagatccagcgttagcttgcgttgattaagtccctgccctttgtacacaccgcccgccc

SEQ ID NO: 534401 - DNA, 760 bp, Homo sapiens
  misc_feature (89)..(89): n is a, c, g, or t
  misc_feature (98)..(98): n is a, c, g, or t
  misc_feature (327)..(327): n is a, c, g, or t
  misc_feature (362)..(362): n is a, c, g, or t
ctgcattctgttacactgtctaaaattaataattgtgtaaacctcgttctacaaggagattaactccctttgtggggccaaggtgtggnacaacaaanttgggaatttaaaattggccccttaaatttttccccaatttttttgttctttgtaaatttaaagggtttttgttatttaaataattaacttcatatgatttctcatttacttaaaaaaaaggtcgggccccgccctatatttttataacgcatcctttccccagcccaaccccttcttttttgtgttggggcgggggaccacaaaattctaaaatgtttcatacaggtnattcaaacaaccaacaaatatttctttccccaaancggtcggcttgtgggcaaacacagggactctagcggggctgttttcatcatctgcgtagcggggagcaagaaattttagttctgcctttctacctcaccgacaagacgggagaatttttcatcttaatgagtggaggagccgcaaaatcttttcatttcatagaacggagggcgagggtattgtcaaaaactgttttgtcttttcgacttctaaaaacgaacaagcttcgtctgacgaggagacaagacggggttttttcacggggaaaaacgatgggggcgagtgggtaaaaacagccctgacaccaggaaaaaaagaaagagaaaaatttattctggtgtgttgagggggcttttcgaaggggaaaaaccacacgcgggaaacacaccaacaggcg

SEQ ID NO: 534402 - DNA, 365 bp, Homo sapiens
agtgccccaaccattgcaatgggaggaggagggccagctgttttgaaaattttgcctaaaaaaaggtattttaggcgggcgcggtggctcacgcctgtaggcccagccctttgggaggccgaggcaggcggatcacgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagagagccgagatcccgccactgcactccagcctgggcgacagagcaagactccgtctcaaaaaaaaaaaa

SEQ ID NO: 534403 - DNA, 462 bp, Homo sapiens
tgcgccatccgttcacgtctctgcatccattccttcatgtctttatttagttgtttatttatttagttatttatcttatttattgagaggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcaggtgtccttcctgtcgtcgtctgccgtgtgccatctttcctggatcttgtagcgggtgcacacgcgtgcactgggaccccacacagcaatacgagtccaacttaataaacacatttctggggttaaaaaaaaaa

SEQ ID NO: 534404 - DNA, 351 bp, Homo sapiens
cctcaggagtaatggaaaataacttggacccagacacaaaaggccacatgttgtatgattccatttattccattaccagactgggtaaacccaaagagacagaacacagattggtggctgtccggggctaggaagagggcgaaaagcgacactggctgcttaacagggatggggtttctctttggagtgatgagagtgttggaactagataaaagtggtagctgcacagcgtcgtgaatgtgctaaatgccactgaattgttcactttaaaatggtcaatttcgttgttttttatttattttgtggagatgggctttctccatgttggccaggctggtctcgaactcctgg

SEQ ID NO: 534405 - DNA, 160 bp, Homo sapiens
cgcaggtagagtacgctgagtgtgatcctcgccacgttgagcctcccaagtacctgggtctaaaggatgcaataccacaccgggctgtctgtttgtttggttttcgtttttttgtagagatggagtcccactatgttgcccaggcttgtctcaaactccg

SEQ ID NO: 534406 - DNA, 863 bp, Homo sapiens
gaaagaatggcagacttggaggacttcttcggagaccctggtgaaccctcctgaatttaatcccgtctgggaagtaaatgcatgtgcacataatacgaatcttttaacctacagcaaatgaagttattgtgtgaatgagattacgagatctatactgaccaatagagtgacataaagggtcaacatacagaaactttgctggcaggatccctggcctaacatgccctttgctacattcatatgaatgtaacaagggaagttaaagacaatcatggacaatggaacatctaaggatatcggtgcattacggctgcagaatgacagtgcgtatgcacgtattatagaactttcagtgaagtgtcatctattgctagctagcagaaatcagaatacttattgattgatgcctgtgttattagaacgtccgactcatgggcatcctccaatcaggcattgtgacattcactgggtgggactgtatactgaacgggtagcctcaagatgccattctacatatctagcaagtactcttgacatgctgcgcgatgttatcattacccgatacaagaatcagagatctcggattaaatcctcgccacgcccacaagttcaatgttgaactaccagggcatgctttgcttactgtcatcgaaatctcatttgaaattggttatgtctggttctgtgtgtttgtcaatattctgcaaatttcagccccattttgtactacgtgcgagacaggctttaaaattctctgcctccagtgctgaaggccaagaagaaagaaactgaaagtgtctgcctgaggataaaagtatttccccatctctaagagctgttaatagaaattcatatagcagatc

SEQ ID NO: 534407 - DNA, 202 bp, Homo sapiens
tcgcggattccctggctgtcattcagtttgatccagcaccggctttggtcgcatggcacttgcctccagttaggagacaggccatgcctttccagtgcatgcgctcactgatttcatcctgcagtttccgcacagtgcccaccagacgtatgtccgacacgcctggccgaaggcagacatcaatactcactgtccagcccgg

SEQ ID NO: 534408 - DNA, 350 bp, Homo sapiens
tggctctcctagcctacctccagtattaaatttaagtatttatgtcaattgtactatgtcttcatttacttcgaagttcacttaaaaatacgactggttgggagttcccctcgtggctcagtggttaatgaatctcactaagaaccatgaggttgtgcgttcgatccctggccttgctcagtgggttaaggatccggcattgctttgagctgtggtgtgggtcacagacactgcttggatcccccgttgcctgtggctctcgtgttcgccggtggctacagctcctatttgacccctatcctgtgaacctccatatactgtgggagctgcgtgctaagacagccaagttc

SEQ ID NO: 534409 - DNA, 885 bp, Homo sapiens
ggggtttgcatatgttccccagttatgcgccccgccgactccatgtggtgtgcacacttgcgaggagtccatgtgtaattgaatttagtccccaatgtcaggtgggccctgttgttcatgccttgttcctttcccttttcggggtcttgaggtcggccaattcacttgaggttaagggttccaaccagcctgtcgcacattgttgaacccgttcccgtccgtaattgaatcattctttaatagcccggtttgtgcttggcccctgtgatctcagctacctgggaggctgaggccgtgagaatctcgttggacctatggagccagaggttccagtgatcccagattgtgcccgcctgggcgaaccgggtgaggctcttgtctccagataaaaagtccccatcttcatggaccctccgactctggaattgggtgtcggcttttttagcccgcttttgtgggaattgcctcttgacctattaaagaaggaaagtgggtatatggagtcccagcccctccagagactggatatcccccgcagaatggcttgggttacccgctattggacccctggaagatgaatctaatccttctcacctggtttttctttgccaattcactttgcttttaatttttctaataacccattaactctaattttccacatgttctccgggcccctgggtagacacagacaccacgcttgagtttcacgagcacgagcactatgagcgaaagaaaaaccactggcacttgagtgtgctgagtccacgaccaatgttactttatatacaccactcccaaatttgaacgaagaaaaatgtaatttctttaaggtttcaaaccctgtaatagatataaagccaaaataaaaacctgttgccaaca

SEQ ID NO: 534410 - DNA, 355 bp, Homo sapiens
gctttcattcgtctcccgtctttggttctccagttcaaattattgcaagcaactcaaaatatttaaaataaagtttacattgtagttattttcaaatctttgcttgataagtattaagacatattggacttgctgccgtaatttaaagctctgttgattccgtttccgtttcgatttttgggcgaggggagcactgtgtttatgctggaatatgaagtctgagaccttccagtgctgggaacacacaagagttgttgaaagttgacacccagactccgcatgtaaaccctgcttctgtatcattaaagagcaatcgctcggtccctggacaataaacagtcccatcaaagagaaa

SEQ ID NO: 534411 - DNA, 928 bp, Homo sapiens
  misc_feature (11)..(11): n is a, c, g, or t
  misc_feature (62)..(62): n is a, c, g, or t
  misc_feature (78)..(79): n is a, c, g, or t
  misc_feature (82)..(82): n is a, c, g, or t
  misc_feature (106)..(106): n is a, c, g, or t
  misc_feature (135)..(135): n is a, c, g, or t
  misc_feature (141)..(143): n is a, c, g, or t
  misc_feature (152)..(152): n is a, c, g, or t
  misc_feature (180)..(180): n is a, c, g, or t
  misc_feature (183)..(183): n is a, c, g, or t
  misc_feature (197)..(197): n is a, c, g, or t
  misc_feature (199)..(199): n is a, c, g, or t
  misc_feature (202)..(202): n is a, c, g, or t
  misc_feature (206)..(208): n is a, c, g, or t
  misc_feature (210)..(211): n is a, c, g, or t
  misc_feature (217)..(217): n is a, c, g, or t
  misc_feature (222)..(222): n is a, c, g, or t
  misc_feature (224)..(224): n is a, c, g, or t
  misc_feature (237)..(239): n is a, c, g, or t
  misc_feature (245)..(245): n is a, c, g, or t
  misc_feature (266)..(266): n is a, c, g, or t
  misc_feature (268)..(268): n is a, c, g, or t
  misc_feature (278)..(278): n is a, c, g, or t
  misc_feature (285)..(286): n is a, c, g, or t
  misc_feature (304)..(304): n is a, c, g, or t
  misc_feature (306)..(306): n is a, c, g, or t
  misc_feature (314)..(314): n is a, c, g, or t
  misc_feature (318)..(318): n is a, c, g, or t
  misc_feature (342)..(342): n is a, c, g, or t
  misc_feature (363)..(363): n is a, c, g, or t
  misc_feature (418)..(418): n is a, c, g, or t
  misc_feature (478)..(478): n is a, c, g, or t
  misc_feature (524)..(524): n is a, c, g, or t
  misc_feature (887)..(887): n is a, c, g, or t
aaaaaatgttnaattaaatatcaaaacaaaattagtctaggctaaaatgtaaaaaggttgtnactcaactgcatctcnnganggaggtgtctgtatgatgaaatgnggcaaccacgtttggagttgaattaatgngaaaannnagctttgancaatgaatgaatagtaagctatgcagtnggnctccaacctggggntnggngagnnngnngggtgnaggtngngaggcagggtttnnnccaggnagccaaggtaaagggaaccananaggggccatntttttgnntacggtggccagctggancntctgggcntctntcctgctgaggggcttgttttgcntggtacccaggcatccttctnctctcctggcaaggtcttactgaagggctaggacagggctggtgtcttggcccanagctaccttgtgccttcctggccagaaccacccacacctgggcaggggccggggccacanagagaggagcagcttgtggagtactaggagagtgaaacccgaagantggacaatgataacaacactgacagggctgggctgttctagcagcctgtgagagaaagtggagagtggctccggacgggacgcaccaccatgacagaaacgagacagtcactacccacagggacatgggatgggaacagtggccaggatccccagtcttggggcgagggtggtgtctttcccctgcccccgctttgtcctgggcagcccctgcacctgatcgtagagggcagctggacccccaaccccagagtgagcaggtgtggcccaagaggggaaagccttccccaggccagtccattccaggctagggacacacgtcctgggcagtgctatccccttctcaggacctcagtcctggggncaaggtgctgagggactgggggaacttggcaggggagccca

SEQ ID NO: 534412 - DNA, 384 bp, Homo sapiens
attctatgatggtatccctgtaaacccactccgaggacacgcccctttattcggtactcgagtcatctcagggttttagcagggagaggtctacttactctagagcgaaccacaatcagtagtcggtagcgctgggattccagcccggtccatccaaagcgttcaggccctatgtctctcctctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggcccca

SEQ ID NO: 534413 - DNA, 355 bp, Homo sapiens
atacgcaaccatgccgatgttttctaacactgtgaaaatattgagatgatactaaaaagtggtagctaggtcatctattacccatgttttacaaatgaggaagctgatgggataatttgtgatttggttgtgataaggctggaattggaattgtgccttctgtatctggattcagcattctttttcatggatcctgctgattttaatgttggggcttgccatgactgtggctccagtgtctgtagtgcccatcaaggatgacagatgcctagttctgtgttgacaagagttgcaaatgcatattactctgggtttttttttttgtttttaagacaagagtgactctctgtctcaa

SEQ ID NO: 534414 - DNA, 122 bp, Homo sapiens
cctcccgagctcgacgctcacgctctggctggtcgggcgggatgccttccttgtctgggctctttgccttgtccttctcactggtgtcactcgggtccacttccgttagtgattggtcttag

SEQ ID NO: 534415 - DNA, 224 bp, Homo sapiens
gtccccagacctcctaactacatagcacccaaaatacccaaacccctatggtgaagtggaactcttccccacttagtggatccccccgggaccctgctgtccccctgccctgaccactattatcggaatctgggaagtggggcatctatatctccagtgcactcataactctaacatttgcatccactcttgcattaatgacacaaaagtgattgttccccgcg

SEQ ID NO: 534416 - DNA, 100 bp, Homo sapiens
cagattatacagagccgtgagaacaaaatgaacgaaaatctgtcgcgttcattcattgcccccacaatcctaggcctacccgccgttaggccgatcatga

SEQ ID NO: 534417 - DNA, 116 bp, Homo sapiens
atttttttaaaacaactttttaaaaatggttatcaaagcccaaaatgctccttatataaaatttagaagccaaaagaagggaataaaaattttccataattttccccggtagggga

SEQ ID NO: 534418 - DNA, 322 bp, Homo sapiens
tttaccgccatcatcgctaactgagctggcagctcttcaagtcgtccgccgtcctcggtcgtcaatgtctgactggcagaaccccttgcgggctacatgctggccatgctggagttcatgatcctcccagtcggtgcagcaaacgtctctcgtggaagccatgcgcattggagcagaggtttaccacatacctgaagaatgtcatcgaggagaaatatcggaaatgatgccaccaatgtgggggatgaaggcgcgtttgctcccaacatcctggagaataaagaaggcctggagctgctgaagactgctattgggaaagctg

SEQ ID NO: 534419 - DNA, 395 bp, Homo sapiens
cccagtagtcattgatcatttcaagttgactttttgttcgtgactgatgaggaaggaaacagattaagccaggaagacatccgagaggaagttgacaccttcatgtttgaggtaacttttgtcgccaggtaattttccttactgtatttcacaactcagaatgtactcatggcagcaacacctgcttagtgcaagaactaggttccattcccagcaccacagcaacaagcaagcaaaaggggcagggtgctgggcagatggcttagtaattaatagcactggctgctcttctaaaggacctgggttcaagtcccagtatctacctggcagctcacagctgtctgtaactctacttccagtcgacccgcccgcgaatttagtagtagtagtcgacc

SEQ ID NO: 534420 - DNA, 338 bp, Homo sapiens
tgacggcgatagcatctgaatatggaaccatgataagcgccggatcactagatatctcgtgagcggcgattatattcattccattgcttcttgcagtctgcgcaagctcaactttctgttccagaagccgcagttctgtctgtttagcgacgcctctcttcaaacagtgtctctcctgttcattttcaacctgctttctctcttacttactgcctgaacttcaagtttatgtcaatttcactgtcgccgctttagcctttcaggttgcaacagtggattcttgtgtcaatttataaagggtacccatcaacaagccaaataatcgccggtcacgagat

SEQ ID NO: 534421 - DNA, 281 bp, Homo sapiens
tcggtaccgacgctctctctgtggggatcccaagtttatctccagctgactctttcatgaaacaaataatattgtttcctatggctgcataacaaattactacgcatttagcagcttaaagccactaagcaattattatgctcacagttccgcgtaagatcccagctgtatggagtgtgactgcggttcttaagctcaggtctcaaatagggcaacagtctaaggtgattggactgaggctgggcctctgtatccaggatgcctttgaaggaaggaactcc

SEQ ID NO: 534422 - DNA, 146 bp, Homo sapiens
aaaaaagaaaaacaaaaaaacctactttggcagattagtgttatgatgaaaagggatacatgtatgttcctgaaataaaggctgtgctcagttatagctgttaccattgattgggagatgttctttttattccagggtttgataat

SEQ ID NO: 534423 - DNA, 201 bp, Homo sapiens
  misc_feature (3)..(3): n is a, c, g, or t
  misc_feature (23)..(23): n is a, c, g, or t
aanggtaatcttaacctaaaatnggtttcaacatttcgtaagaacttctgaacttcttccccccgctccatttgtgctctcaagttaaggtaaatagaggctgggcacagtggctcatgtctgtaatcctagcactttaggagaccaaggcagacagatagcttgagaccagcctgggcaacatggcaagacctcatctct

SEQ ID NO: 534424 - DNA, 112 bp, Homo sapiens
ctcgaggatccccaaactcctgtactctgatctactcgctcggctcccaaagtgctaggattgcaggcatgagccacttggggctggccaagactccatctcttttttatag

SEQ ID NO: 534425 - DNA, 373 bp, Homo sapiens
atccccgtaaaaagacgagaatgtcatgtgggctgctctggccctgcgtgtgcacagctgtggcatctgcttgatgcctgtgattctctaaactcatgctgtccttgtgattatatcacctctactctccctttgtaataagcacatacaggctttagctctaagatagattagtgtgtttgtccttttaccatcgagctacttcccataataatccactttgcaatcctacactcttcacccacctcccatacgcaaggagatgtgtatacttcgcccagagtaactggtgttaagaatcttagaatcaagaccacttatactgtctgtctgaggcagaagatcacagcagcatctcctctcttctcttgta

SEQ ID NO: 534426 - DNA, 187 bp, Homo sapiens
ttcccgaaaaaaatttggggaaaaaaagggcgggggttttaaacccctaaaccggggggcgggctccccccccccggttttttaggagggggaggctttaaaggcaacccttgccgggccaaaaacccttgttttggggatttttccaaaaagggggccccccaggaaaaaaattttgtggccttta

SEQ ID NO: 534427 - DNA, 198 bp, Homo sapiens
cacatgctcactcacacacgagccaagaaacacggacacaatacaagccaccgagcacacaacacaccgacaaccagtacaaaccacgaacacacgacacacacacaccacaaacaacaacaccgcacgcacaacaagagcactacacaccactgcaaaccaaccaaccaaccaaccacacaacaacaaactaacaaa

SEQ ID NO: 534428 - DNA, 472 bp, Homo sapiens
ggtcgacgcctgagcctctggctggagggaagtggatgtggcacttgatgtctgcagagatgcctccagaaaggcccgagagccccagaatgcatgtgccaggaagcacgaagcaacatgagggtaaaattatgtttttaacagaagaaaagacctctgccttgcagcgtgtagacagatttctattcccacccccacgcagccccagggacctgaaagaatgtggttttctgagcacggccttccgttgctgaagggggcggattcactcctaaaaagttgctgtgaaatggatttttctatatccaatggtatttttccgttggttggtgtttaaggacatgggtttcatcccactcgggaattacccgcccttgtggttcccgattgaggcagccactaaagagataataattaaaaagtgtgatacaaaccatggtgtcccaggggacactggttgggcagacaagta

SEQ ID NO: 534429 - DNA, 1631 bp, Homo sapiens
ggagagtgcggggctgatgcatcgcagcagtcctgtgaccctgacttcggacttggagaagaaacgccgaggagtgaactgggagttagggggttatgcatgcttgtgctgcgctggtgatgccggcacccctggtctccggaccttcacttcccaggaggcctcgcgcgcgactggacgtgctgctgagcctataagacagtgcgagtgctggcaccctgcctgctcctgcatcttgagtgagctggcatttgccagcctgagcttgtacggcatttcatgtggcacgatgtctatctggccatctaccataaggacacctctggagatgctgtgccatgatccctgtgcatgccatgggattaaaccgagacagagacagggttcccagagaagcaatccccgggacacattcaaacttcagaacacccaacttgatgagggtccagggaggattgaagatcctttgtcccacacttgtatcaaggtggaactttaggatacaacagaggatgaacccaattatacggccagtgaacctttttggagacgcccccatggcacaatgtatcttcattgaacgccactaattcactttacgcgagcctaacacgtgcaggatcgcagttcgaagtccacgcacacttggagttcgtctggggaaccggggaacataaccttaggtcccttagacgcttggcatagcattggagtgagatcccacttgggggagcttccatacatctgttcggcattacccatcctttttccacccttaattcctcaacattggagacattgccacagatacacatgggagacggcttggtagttgaggactttttttggcccgttgagcaaaccttggtcgcaagggcaatacctacacactatgattgcacaaacgttggagccagcaccaaaggtgtcattcagtgtggctttggccttggcactttgggatcgagccacattccttactcggtccatcggctagcgacgtccaaaaaataggagtaggtacaccacaaggacttagacacaacacagatctagttggcagtatatcaaagacacccacaaatacttaggagcatatgaaaacaattactatacaatgtaaccaagacgcacagaacgccattgacatgggcaccattcaagtccatcaacctatagtatcggatacgatcagtacatcagatcgaaatgaacatacaaacaggattaacgcaacatacgcattagggaatatgactatgcgcaaagccattcatctccccattaaacacaagatgaggttatgcatgacttcacccaaattattggattctcatatcaacagtccaagacgacatcacggagcatcagcaagaaatcacacagagcatggagatcaccaatgaatggaaaaaacaatagaagaaccacagagacataatggcgcaagaacatatcggacaaacaatggcaaccgagatgagacagcgtcatatgcaaccatcagtgtaacacgagaaaaaggatcaaacagaatataggtgatggagaaaacccatacaagaacaaacgtcaacaaataggagaacctaagtcaacatggtctgctgtcctttaggaaaatagaagag

SEQ ID NO: 534430 - DNA, 1241 bp, Homo sapiens
aacaactacccctaaaagccaaaatgggacaaggaaaagactcatactcaacattgtcgctcattggacacgctacattcgggcaagtccaccactactggccatctgatctataaactgcgcgtggcatcgacaaaagaaccacttgaacaacatttgacgaaggacggctgctgacgatgggaaagggctccttcaacgatatgcctgggctcttgcgactaaacctgaacagctgacgcgctgaacgctggctatcaccacttgactatctaccttgctggcaaatttgcagaccacgcaacgtactactgctgactactcacttgactgccccaggacaccagagcacctttactcaacacacaccactgcacttacacgcggacactcctcacggcctgcacctgctggctgtcccttgactctgctctgcatcgcctgcgtgctcggtgcaacctcttgacacagccctcggtactcttccaaaccacactgcgcgccgcaccccgacgagccactgaccccctctcctgcgcctctaccagcacccctgcgcgctgtcgcacaaccaaccctacactccgctccgcgtgcctccacaccaccacaattggcactatcccaactagagcccacacgcataccagtccacgcaaacccacgcactacttgacgcgcaacaccactgcgcctccaccgggcaacgcgtccacgccaccttcatcccccctctccacgccacacaccaccgcgcccaccacaacccccccgacccaaccagcccacccccctccggctcgaccaacctccccctgcggccccgcacacactgcggacgcaacccacacccacatcgccctcgccgatcgcccaaaaagcacagcctacaacacactacgaccactagggaacaccacacggccgaccccgcgcgcacacgccgcaccccccgcccaacaccgaccactgccccaccctccgcccccactgtcccaccccccacccgcccctcccccctgcagccccctcccgccacaccttcgcctttccctaaaccaaactccaaatcattcccctctccaacatccgcaccccacgccgcacatctcgacacccattgcccctcatcccacacattctcatctaccaccaactcgacccgcactcctcagcccaacccacgccccccccgcacaagaccccaacacacccaacaaacgccccccccctccccccca

SEQ ID NO: 534431 - DNA, 207 bp, Homo sapiens
tctagacggactcgcccgggagccttaacctcaggagttcgagaccagcttgggcacaaagtgaaaccgatctctactataacaatacaaaatggcggggcatggtgatgcatgcttgtgatcccaggtacaagagaggctgaggcggagactcacttgaatccgtgaggcacaggttgcagtgaagctagattgtgcacttcactc

SEQ ID NO: 534432 - DNA, 659 bp, Homo sapiens
agttctcaagagatgtttcgcaagttgtgggcaacacgaaagttcgctgggtttgcctcccgatatttagggtgcttacccacttgaactggcacgccaccatttcaggggcgccaatcgaatcggcggggccccccaatgtgccacccatgaatcaaggggcttgggaacattcctgggatgtctggcatcaaaagccccaaccccgtgccgtttttgcacggcttaacctcctagttgtccaggattaggccagtctggtgcatcgaagacaaatcttgtgtcaaacacgccggggcactgtttcgtccgtccgtcgcttagcaaaatgacggaataacctgaggcctattggccgtgccctagtgttctgttcgacgataatgtcaagcaattgagctcgtctgtttgtcctctgagaccaccatgctcaagttctcagcccagttcctctctcgctgtcccgtgacgcccgcatcgcacagcatgttcgcctccttagagatccaggcacgggaatggaatgttcgttgtaaaattcaacacccagccaggctcataagcggcgatctgtgcataaagaggtcaggacccagccgaagtcctcggcgtttgacagcgcagctggggggacatgatcacactggacaaggccatcc

SEQ ID NO: 534433 - DNA, 134 bp, Homo sapiens
cgaattgtcaacttgtctgccctgatgctggtcagcaggctggacgggtggtggcggtggcggtggcaacattggggtgggaaggaatgggttgtgcaccttgccttggctgctcccgttgcagtgtgcttccg

SEQ ID NO: 534434 - DNA, 941 bp, Homo sapiens
  misc_feature (1)..(1): n is a, c, g, or t
  misc_feature (700)..(700): n is a, c, g, or t
nggtcctggagggtataagcattctagttggctgggcccggtgggccgatatccccacttggccgcgtcttcctgctggtgttctctggccctccgcgcattttcctccggtgtgcccgctttgtgggtcccgccgggtcctcgtcagcgcagttgtgttggtctgagggaaaggtgtgtcgccctctgttggtaatacctgtgagattggcccgcaatactttctgtagtccttgggtgctcgcgccccctttgttgtaattgggtgtccctggccaccgcaccacgtgtgtgtgtgaggacgttttctcaagagctaatcccacccacttgggggcgcccttgttcgggttccggtaatattgtgaagccacgacccgtgccgggtatggggggtctaatcacaaaacaccgatggggcaacaaaaaggcgcttcctttggtgatcctctgccaaggtggctccccccacatagtgtgcgccccccagaatgcctcctacaaggacccttataatgtgaatatttgtattccgcccttgatgtcacgtcgccccccccctcgttttactccactgtgtgtagacaaacacgctttcttccaaacactctgtttgtttgcccaatgtggccccacttttaaggattatatatattaataacaacctgtggtttattgatcacaccacagccgctttgtnttaaccctctctctctgacgggtataagaagaaattgttttttttggagcccacctctgggtttgttttgttttggcctggggcacactgtttaaagatatattattgtgtttttaaaaacacgcgcacgcttgtttaatgtggagaacccacacccgtgcccccaaaatttgttgcaccacgcgaagtttgtggggcccccccttatagaaaaaggttgtagaacccccacaaaaaaaaa

SEQ ID NO: 534435 - DNA, 376 bp, Homo sapiens
  misc_feature (148)..(148): n is a, c, g, or t
tcctttggggcattaaccccctgcctccccccccccaaccctttggggtgcaaaaagctaactcacagtccaggtggtcccttagcatcccccattggtgcatcagagaggttttaaaacaggaagctaaagttttggggcatgctcnaagtgaaccggggtcaccccaaaccagggtaaaattttcccgtttacttttccccagagctatggctggaatcaaaggtttaaaaaatgtgagcctggcccccaaaagctttttataagcccccgtaatatcctgttagactcttcgaaatttttttccccccttttttttaatcaaaacttcagtgtcccaaataaagttggcaaaagggttcccttggaaatttta

SEQ ID NO: 534436 - DNA, 150 bp, Homo sapiens
  misc_feature (41)..(41): n is a, c, g, or t
gaaaggcaaaggcaaaggcggctcgggaatccagccgtgangcagtgcagatagatggccttgtggtattagagatactcacacattatcaagaagagggacacggacctgaagttgtacaaggagtgctttgggctggttgagagacgg

SEQ ID NO: 534437 - DNA, 297 bp, Homo sapiens
actagcaacttagatctttgattaagaggaccgacaatatgccacaccctgtgacgttagtacttgagacatgagagcgatgacacaacggggacataactgctgcctgcacatagtttacaatccagcaagcaaggggcaccgaacagcagctcgggcagcctgtgctgtggcctgcagagaattccaggtgacgccccagagggcctaggagaggatacccttcttagaacagccgtggctcgcccggaatcaccccactcaagaggccagacggagtcccagctggggtgacac

SEQ ID NO: 534438 - DNA, 230 bp, Homo sapiens
accgttgttaaaagtacaaaattcagctggccatggtgtgtagcacgccactatagacccagactacttggtaggcttaggtgcgaggattgcttggatctgggaggtcgatgctgcagtgaactgtgattgtgccagtgcattccagcctgggcaacagagcaagaccctgtctcaaaaaacaaaacaaaacaaaacaaaaactgatgcttctgaaggctgtgccggag

SEQ ID NO: 534439 - DNA, 115 bp, Homo sapiens
aaaaattggtcaagaaaaactgcgcagaatgtccgggccttctatgtcaagagccccatgggcaagccccagcgcctttgttaaggcacttttgcctaatttatattaccagtta

SEQ ID NO: 534440 - DNA, 280 bp, Homo sapiens
  misc_feature (17)..(17): n is a, c, g, or t
  misc_feature (205)..(205): n is a, c, g, or t
  misc_feature (228)..(228): n is a, c, g, or t
accctgtaacccctttnttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactnttgggaaggaatgattggttttnaaatgtgaggattatgaaatttggaggagcccagggaggaatgatatggttt

SEQ ID NO: 534441 - DNA, 2547 bp, Homo sapiens
  misc_feature (108)..(108): n is a, c, g, or t
  misc_feature (118)..(119): n is a, c, g, or t
  misc_feature (121)..(122): n is a, c, g, or t
  misc_feature (135)..(136): n is a, c, g, or t
  misc_feature (143)..(143): n is a, c, g, or t
  misc_feature (148)..(149): n is a, c, g, or t
  misc_feature (161)..(161): n is a, c, g, or t
  misc_feature (167)..(168): n is a, c, g, or t
  misc_feature (177)..(178): n is a, c, g, or t
  misc_feature (233)..(233): n is a, c, g, or t
  misc_feature (250)..(250): n is a, c, g, or t
agcgggctgggggcctggggctcggcgtcggtccccgggggatgtggagagctggcagcatgtcggccgagctgggagtcgggtgctgcattgcgggcggtgaacgangcgcgtgcanncnnggctgtggcgcgnncggccgnagggnntctcccagccantccagnncccggctanntggcggtcagcaaaaccaaacctgcagacatggtgatcgaggcctatggacatgnggcagcagcacttttgngcgagaactacgttcagggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaaggagaggtaaacatggccttccaccttcagagaccatagccatcgtggagcacataaatcgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctctggggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttta

SEQ ID NO: 534442 - DNA, 466 bp, Homo sapiens
ctctatctctacttcataactatcattctctttttatacctattagaaccagagtaagaaagaagcagtctggctactatacaacattcatgtggattctgttagagtagttcagcttccttaaaataagcatatatccactaacaaactaaatataaaagctaaacaagtgaaattgaagcagttttattgtacagatttggaagagtgcaggatgtttatcatagcacattattaatatttattattcttcctatgtagatatagaagagtgcacttatggtgcactcttctatatctaccatcatggccatggtccaagctggaggtagccgccaggattgccatgagcacctcagcgtgctttctcagcaggcagcttctgtggttaagcaggaagggggtgaccaatgacctcatagagcgtatccaggttgctgcctacttccgtcccattcactctcag

SEQ ID NO: 534443 - DNA, 2507 bp, Homo sapiens
  misc_feature (108)..(108): n is a, c, g, or t
  misc_feature (118)..(119): n is a, c, g, or t
  misc_feature (121)..(122): n is a, c, g, or t
  misc_feature (135)..(136): n is a, c, g, or t
  misc_feature (143)..(143): n is a, c, g, or t
  misc_feature (148)..(149): n is a, c, g, or t
  misc_feature (161)..(161): n is a, c, g, or t
  misc_feature (167)..(168): n is a, c, g, or t
  misc_feature (177)..(178): n is a, c, g, or t
  misc_feature (233)..(233): n is a, c, g, or t
  misc_feature (250)..(250): n is a, c, g, or t
agcgggctgggggcctggggctcggcgtcggtccccgggggatgtggagagctggcagcatgtcggccgagctgggagtcgggtgctgcattgcgggcggtgaacgangcgcgtgcanncnnggctgtggcgcgnncggccgnagggnntctcccagccantccagnncccggctanntggcggtcagcaaaaccaaacctgcagacatggtgatcgaggcctatggacatgnggcagcagcacttttgngcgagaactacgttcagggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaaggagaggtaaacatggccttccaccttcagagaccatagccatcgtggagcacataaatcgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctctggggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacacca

SEQ ID NO: 534444 - DNA, 262 bp, Homo sapiens
  misc_feature (128)..(128): n is a, c, g, or t
ttagctgggcaaggtagtatgtgcctctaatcccagctactcaggaggctgaagtgggagaatcacttgaacccgggaggtggaggttgcagtgagctgagatcatgcaactacactccagcctgggntggcagagggagaccccatctcaaaaaaaaaaggtatgtgtataaaaaaaaggaaaagtgtgtgtgttaaaccaatctaatggatgtccttgggaatttgggccgagaggagtgatatttaagggttaagaaga

SEQ ID NO: 534445 - DNA, 678 bp, Homo sapiens
cgatcttggcttactgtaacctccgcctcccgggttcaagtggttctccttcctcagcctcccaagtagctggaactacaggtgcatgccaccatgcccagctaatttttatatttttagcagagacggagtttcaccatgttggccaggagggtctcaatctcttgacctcatgatctgcccaccttggcctcccaaaatgctgggattagaggcgtgagccaccacacctggttgaaaaatacctttctttctttctttcttttttttttttttttttaagatggagtcttgctctgtcgcccaggctggagtgctgtggtgagatctctgctgactgcagcctctgcttccgggattcaagcgattctcctgcctcagcctcctgagtagctgggattacaggcacatgccaccacgcccaattaacttttgtatttttagtagagatggggtttcaccatgttggtcaggctggtctcaaacttctgacctcgtgatcctcctgccttggcctcccaaaatgctgggattacagccgtgaaccaccgtgcccggctgaaaaataccatttcttattcagttttatatactttaaaatttagaaccactttgaacccttttcttttccttttgctctttttctttttcttttctggcagggttttactcttgtca

SEQ ID NO: 534446 - DNA, 2607 bp, Homo sapiens
  misc_feature (108)..(108): n is a, c, g, or t
  misc_feature (118)..(119): n is a, c, g, or t
  misc_feature (121)..(122): n is a, c, g, or t
  misc_feature (135)..(136): n is a, c, g, or t
  misc_feature (143)..(143): n is a, c, g, or t
  misc_feature (148)..(149): n is a, c, g, or t
  misc_feature (161)..(161): n is a, c, g, or t
  misc_feature (167)..(168): n is a, c, g, or t
  misc_feature (177)..(178): n is a, c, g, or t
  misc_feature (233)..(233): n is a, c, g, or t
  misc_feature (250)..(250): n is a, c, g, or t
agcgggctgggggcctggggctcggcgtcggtccccgggggatgtggagagctggcagcatgtcggccgagctgggagtcgggtgctgcattgcgggcggtgaacgangcgcgtgcanncnnggctgtggcgcgnncggccgnagggnntctcccagccantccagnncccggctanntggcggtcagcaaaaccaaacctgcagacatggtgatcgaggcctatggacatgnggcagcagcacttttgngcgagaactacgttcagggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaaggagaggtaaacatggccttccaccttcagagaccatagccatcgtggagcacataaatcgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctctggggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttattttttatgaaaaaaaaaaacacaaaacaacaaaaaattgtcggggcggccgtggcccaaagaatcc

SEQ ID NO: 534447 - DNA, 435 bp, Homo sapiens
gctcgacggctggagtgcagtgacaccatcttggctccctgaaacctccacctctcaggctcaagcgatcctcctgcctcagcatccctagtagctgggactacaggctaattttttgtagagaggttttgccatgctgcccaggctggtcttgaactcctgggctcaagcaatccttctgccttggcctcccaaagtgctgggattacaggcgtgacgaccgcacccggccccaagtgagatttacctgaagtatgcaaggctgattcaatgtttgaaaattaattaatataatccatcacatcagtaggctaaagaagaaaaatatgatcagattgatagaggccagttatttgacaaaattcaaaactcattcatgataaaaactctcagtaagctaggaatagacaacgtcctcaacctgataaaaaaaaa

SEQ ID NO: 534448 - DNA, 2578 bp, Homo sapiens
  misc_feature (108)..(108): n is a, c, g, or t
  misc_feature (118)..(119): n is a, c, g, or t
  misc_feature (121)..(122): n is a, c, g, or t
  misc_feature (135)..(136): n is a, c, g, or t
  misc_feature (143)..(143): n is a, c, g, or t
  misc_feature (148)..(149): n is a, c, g, or t
  misc_feature (161)..(161): n is a, c, g, or t
  misc_feature (167)..(168): n is a, c, g, or t
  misc_feature (177)..(178): n is a, c, g, or t
  misc_feature (233)..(233): n is a, c, g, or t
  misc_feature (250)..(250): n is a, c, g, or t
agcgggctgggggcctggggctcggcgtcggtccccgggggatgtggagagctggcagcatgtcggccgagctgggagtcgggtgctgcattgcgggcggtgaacgangcgcgtgcanncnnggctgtggcgcgnncggccgnagggnntctcccagccantccagnncccggctanntggcggtcagcaaaaccaaacctgcagacatggtgatcgaggcctatggacatgnggcagcagcacttttgngcgagaactacgttcagggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagatatacctgttttctgtttctcttcttgagagaggtaaacatggccttccaccttcagagaccatagccatcgtggagcacataaatcgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctctggggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttta

SEQ ID NO: 534449 - DNA, 106 bp, Homo sapiens
taaatgggaagacataccacgtagggagaacagtggcagaaggaatatctcgcgtgccatatatgctacctgcacatgcttatgtgaggccagcgtgcttgcggct

SEQ ID NO: 534450 - DNA, 2492 bp, Homo sapiens
  misc_feature (108)..(108): n is a, c, g, or t
  misc_feature (118)..(119): n is a, c, g, or t
  misc_feature (121)..(122): n is a, c, g, or t
  misc_feature (135)..(136): n is a, c, g, or t
  misc_feature (143)..(143): n is a, c, g, or t
  misc_feature (148)..(149): n is a, c, g, or t
  misc_feature (161)..(161): n is a, c, g, or t
  misc_feature (167)..(168): n is a, c, g, or t
  misc_feature (177)..(178): n is a, c, g, or t
  misc_feature (233)..(233): n is a, c, g, or t
  misc_feature (250)..(250): n is a, c, g, or t
agcgggctgggggcctggggctcggcgtcggtccccgggggatgtggagagctggcagcatgtcggccgagctgggagtcgggtgctgcattgcgggcggtgaacgangcgcgtgcanncnnggctgtggcgcgnncggccgnagggnntctcccagccantccagnncccggctanntggcggtcagcaaaaccaaacctgcagacatggtgatcgaggcctatggacatgnggcagcagcacttttgngcgagaactacgttcagggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaaggagaggtaaacatggccttccaccttcagagaccatagccatcgtggagcacataaatcgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaagctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttta

SEQ ID NO: 534451 - DNA, 362 bp, Homo sapiens
aaagggttttttttcctccaaaccccctggcctttcagtttttaaatatttccctccaggccaaaaagtttttttttaggaaggaaaggaaaggggggcaataaagcctttgatttggaattggacatttttttgtcaaagcacaaaggagggtcaaatcaccttttccctttcctaattggcccaggtggttggaggaccgaccccatggttgaaaatattacggcaaaaggaacaaagtttgctccaagtgggaaagggtcccaaacagtccaaaaaaaaagtttgtgggggtttccctccctgcctcccccagctcccccactggcctttgtaaaaaaaagggggggttttttttgtga

SEQ ID NO: 534452 - DNA, 1730 bp, Homo sapiens
actcttgagggaaaaactagggccagagcagcccgaagactcccctggggtggtcacatgggcacaaaagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctctggggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttta

SEQ ID NO: 534453 - DNA, 103 bp, Homo sapiens
ccttttatatgggtcttcactctgactagaatttagtctctgttgtcagcacagtttaatctctattggctagttccccttgacgactctcatcttgttgcgc

SEQ ID NO: 534454 - DNA, 150 bp, Homo sapiens
aaggaagttaagaaggagagaagaggaagtgaaaaggaagaaaggaccccaaaagaataagctccctaaagacgcaaagaaatcatctactcctctgtctgaagcaaaaaaaccagctgctttaaaaccaaaagtacccaagaaggaaga

SEQ ID NO: 534455 - DNA, 1293 bp, Homo sapiens
  misc_feature (108)..(108): n is a, c, g, or t
  misc_feature (118)..(119): n is a, c, g, or t
  misc_feature (121)..(122): n is a, c, g, or t
  misc_feature (135)..(136): n is a, c, g, or t
  misc_feature (143)..(143): n is a, c, g, or t
  misc_feature (148)..(149): n is a, c, g, or t
  misc_feature (161)..(161): n is a, c, g, or t
  misc_feature (167)..(168): n is a, c, g, or t
  misc_feature (177)..(178): n is a, c, g, or t
  misc_feature (233)..(233): n is a, c, g, or t
  misc_feature (250)..(250): n is a, c, g, or t
agcgggctgggggcctggggctcggcgtcggtccccgggggatgtggagagctggcagcatgtcggccgagctgggagtcgggtgctgcattgcgggcggtgaacgangcgcgtgcanncnnggctgtggcgcgnncggccgnagggnntctcccagccantccagnncccggctanntggcggtcagcaaaaccaaacctgcagacatggtgatcgaggcctatggacatgnggcagcagcacttttgngcgagaactacgttcagggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaaggagaggtaaacatggccttccaccttcagagaccatagccatcgtggagcacataaatcgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcaagcttcctatgtcagagactaagcacagatggtttccatcaacacacgtgatcattagtgctctccacaggtcacaggagagcagtactgcgctgggacacatgtcgacgcggccgctaatttagtagtagta

SEQ ID NO: 534456 - DNA, 989 bp, Homo sapiens
  misc_feature (243)..(243): n is a, c, g, or t
  misc_feature (608)..(608): n is a, c, g, or t
  misc_feature (664)..(664): n is a, c, g, or t
ggagagaactagtctcgagttttttattatttttttttggagtcatgtgcgcctttataagctgagccattacttgaaagggataaagcggaaggagtgggtggccccgaatgccgggccggcaatgcttaacgggcttgtaggtaatgagaaaactcgcccaggtatgtggccagatcatctcgggcttagatctccaccgggttagaagggtcttgcctgttgtaaacgcccaccatgctngcccaccatctcggtgtagagatagatcattgtcccagacaggtgcgtcttcaccatttccggttctccacagggagcggggcctccattttctggagctcttgcgccaggcgcttacagaaggaatgtagctagtttcccgccagaagggccccggttacaagccgagccagccgtttggtcacccgacatcttgtacagtttgactctcaagctagtctcgatagagactttgtccagccagtcttgtgtacagagggtccaagcacacacgtggataagggtcgaaattttgcgcggaaaaagggtacccgaattattacatatactggactcataatcttctgggcccttttcttgttganaaaaaccccaatgccctaggaaacccccctaaaacagtgggcgccccctttaaatnctctccgtaaaaaactctagaactctttatctagcaaaaagaggtctattatcacccttaaagagcacaaatttttcccacacgagacaccaccaaaatttctcaacccttccacattgatatcacctttcagaccgccaaaaagagggcgccacataatcttaaacaccttttaaaacctatcccactctactcgtatcactttctttccccccaacattcattctaaatagaacccataaatctcctataaattcacatataataccactattatttcccccccgaaagaaacactcctcaaactctacccaatatctttgtc

SEQ ID NO: 534457 - DNA, 1131 bp, Homo sapiens
acccccaatgagtctagcctactattcactgctttgtgtgcatgtaatttctccctctgttaagagacagaccctcttaacaagcaaaaaacaagacagtagcatagtgcataaactattgtcagcttcatgtaacactcgggtctaggatcgagctgggggtacaagtccccgaaatgaccttcgtggtaacaggtagccagggtacgttggaattctcggtcaacgcggttcactgttctacacggttcaggaatggcgtaccgggacaagaggtgatagccagcggatatttaagacctccttttatacccgtgtcgtccgcgtgtccactgttcgtgcagcatcgtcaacatttccaatcataatcacccagggggatttatatcaacaagcaccaactgctgcaacgtgttacaccaagggaaagctccaactgtgggccaacctcatgaacgactattcaatggcatatctcaacaggctcaataggacaggtggcctcaagagacttgtggacaggcgtcatagaaatgtgccaatgtcacgcagaaggagaaccaaaaggcacgaccaagagagtataattggacccgtgtaacaacttttgggcacgccgtcggtatagtttatacgccccctatggacgtggaatacaaggtgtggaacctatggaaaaaaggttcaccccggggacaaataatgtcaccccaacgtggtggctcccgatatccccccattccgacattgtacgtggatcacgttatcgcaatgtggatggttgggtagggacaaacccggggctggatcccgctgccggatataagcaaccctagggaggaaataccccaaacaggacggccccaggtacagtaatgcacgtccaccatttccaaccaatttactctcccaaaggtttgcccagagctaacaccatttattgtcagtgcaaagtgcccaagaggtttgggacaatgtcgatcttaggggggcaacatatcccataaggaagcaaaatagatgttatgacccaaagagtacttgtacagcattgtggaacgaaggggataagtaggcggaaaggatggtgtaataatcaaaagaaagattggaaaacaagcaatgagtagc

SEQ ID NO: 534458 - DNA, 1578 bp, Homo sapiens
aagggccacctggaaccttaatatcggtggtgtacatcgtgcgcagcgcgactactacaaggccactggcgccagcagtaaatcctgaacgggaaggagatctccgcgcaaataagggcgagactgaaaaatcaagtcactcagttgaatggagcaagctacctggcttctcacaccacgcctggcaactattacaggttggtcaacacgagaatgattccagatctgttactataaagtgtgaacgctgacaggctgctgcaaggagattgggatcaaagccacctcacacttaaggttaccaagaacaaccagcactgaatctgacggctgactgaaggctacagttacagtcttctgaactgacagacctcctacctgctacacgtgggatacccttacgtgcacgcctacccatcttagaaacttgcacgcacgcacactatcccagtgtaagccactgaacgacaagtgcactcagacctgccgtactctgccatccgcagcacaacacgcgacctgcgtgcgcactgcgcactctgcacctacggcactccaaatgcgctaggcgcaacaccatcgtggccttagcacgggatgtaccctctcaatacatgcacccctgatagtatcactctacccactttggcctaacctgccataaacgcgcgcacctgacctgtcgggcaaaccgatctaatcgacaaacgcaggaccacagagcagattgtccgcgaatttttgcacagcgaaaaggcgcacactggccacgctgagcaatggataagggacgcccgccaaggaatacgacacactaaggctacggcaggagccaaccgcaatagacaaatggaaccctaggaccatattcccagcatagccaaacccaaactgccacaaccacgctgcaaccccaaacacatagcgccagcactcacaaaactgcacgctggccccctcagttccattggggcacttgtcaacgcgacaggggttaatcacgcttaacacaggagggttagcaatccaattatcccatggtgctcgcgcctgttgcctcacaccccttgggcctctacaaggcacctttcgctacgacatctggcgtaataaaacgcagcgcccaagctctgtggacttctcacccacgccccttaggcccggcgcccacacgcaagcattcacatcccgaacactctggtcagagacacactccaacgctacacatggctcacccacagcaaccgtgaaatgtaccacaaaaacccgcacacacgggggcaccacaacaacacgcaccgcaccgacacgaaaacgaagggacacaatctaacggaaacgcccgcgggcgccaagcacgcaacacatcgggcgtgaagcacgcaaacgcaagccaccaccgcgcaacaaccagcgacacgcacacaaatcaacaaccacgaactcaacacacgcgcgcaacacgcggccgcccaccccgcaacaccgacaacaccaagcgacgaccgaagtagcaagcaccctaccaccagcgcacaacaaacaccaccgacataccgcacaccaggccacaagacc

SEQ ID NO: 534459 - DNA, 183 bp, Homo sapiens
atgcctagtgcgcgtgtccgggtggagccgccgcagtgtgcaggtcttggtgggtcgtacgcagatattcgacacgagaactttgaagggccgctgcgggtgagcctctgaatcctagatgcgcggtgcccgggttggagcgcgccgtcaggtgcagactcttggcgggtcgtagcaagatat

SEQ ID NO: 534460 - DNA, 347 bp, Homo sapiens
  misc_feature (30)..(30): n is a, c, g, or t
gtattctaaagaaggcattactatcacagnagatgacaacctccatgcgtgttattgcccctgaagacctttcagtgggatacagtgtggaggtggaagacagtgatactgatgatcctgaccctgtgtagacctatgctaatgtgtgcttgtgtcttagtttttcacaaaaaaggtttaaaaataaaaatacaaaagaataaaaaaggttatagaataaggatataaagaaagaaaatacttttgtacagctgtataagtgtttgtgttttaaattaagtgttattacaaaggagcaatagagttttcacaaattaaaaagttaataaatattaacagtcactgta

SEQ ID NO: 534461 - DNA, 855 bp, Homo sapiens
ccaacttcagtaatcggctggatagctctaaagtcgcaagaacgagtacgtagaatgtgaggccctactggttagcctttttgaagacaccaacctagtgtgccatccatgccaaacgtggtaacaattatgccaaaagacatgcagctagcacgccgcatacgtggagaacgtgcttaagaatacagtatgatagggaaacgtttcattctcaaaaaaaacaaagaacccctcttcttccggtaagtgggcgttatgaacgttagatattgtcttcccatggggttacatggtacctaaccctgtgattgcgagtggaagaatagtggacagaaatcaagtataggcagttttggccaatctcatttgtgtgtaaatcctgaaatcaagcgaggacacgttgaccattacggcattgaaaaatgttatatgggacttgttgggaggtgtaacctttaataaaggaattattaccacttgtaaggtgttcgcgctagcagcgcgctttgggatttttttataaattcaaccgatatactagtcgatgcgcatgatctggaagcatgtagcagtgttatacatccacgtcaccaacaagaatttaccattggtatataactgagatggagcacgtggatgttccttatggtagatgtataaagctagtgcggtggagagagaattttatattcgatgacgctcccactctacactatcgtgcgtgtgcgcttggtcgggttgtgggattcagtctttttatacagctcgcccgtgcggtggggcagcaagtggagctgaatacttgatgctttgactgcgcgacgagattagttactatttatatggttgagtggt

SEQ ID NO: 534462 - DNA, 149 bp, Homo sapiens
gccggcgctgaacccacggccctctgaacggagagagatgagtaatggggccggacagctattgggcccctccctgaagcaacagtgaagccaggaacatgccccaagcaggcagggagagccacatctgccctgtgcctatagccagc

SEQ ID NO: 534463 - DNA, 153 bp, Homo sapiens
aggtgacatattctctatatatcagaacttagcagagagccctttaccgagtcgccccgggcctcccaagcagctcagctcttcctactgaaagcactgacggagtggtagttagctacatccctgagtgtcggctgacggccgctggtgatc

SEQ ID NO: 534464 - DNA, 796 bp, Homo sapiens
ccgtggcccatgaccaactttttcagactctatcaacccagccatcaccacctcagtctgaaaccacactcctaaaaagggcagaagagatacacgatgaggaatcgatctacgaggagctcccaaccccaccattttgtcaggacctccagtgctgtagagagaaggcagaaccacgcccatggcctttctcgccaagaaagggtacccgcatgaccagctccacccaaccatggcccgccagcccccgaggccatgggcagaccgcgagacaacccaggacgcaggaagaaggaagcccacaaggcgaccagagcccacccccaccggagaaccctggccgaccgccagaggagccaaggcatgatccccatcctgagacctggtgcagggccccgtggggaggcagcggcacccagactcacccaggccgtgctcccactcgcctggggcctcctcacctaggggcccccagttcactcaacccctcacagcctcagctttgcacgcccctgagaaggccgcctctcactctaccacgccacgccactgagcgccttcctgcacgacaccacccgtgccttatgccccacgccgaagaatccgctggggccggcagcacggcacccttccccccgctgcgctagcgggaaagagatggggatggagtcccacaggcacagcgcccccaacctcgggccaccagacaccccttcccctttaccctggaccgccggaaacctgtatattccaaaaccccaaaagtcctgctaataaaatttttgacccctttcca

SEQ ID NO: 534465 - DNA, 358 bp, Homo sapiens
gaagccgggcgataaatgcacgtcagttaataggcggtggtagtactcctgctaaatattatagctcagtttatccgaatggtgtaactctgagttccgcatttagcaaaatttccagtacctttgtcacaatcctaagacattatcgggagcagtgtcttccataagtgtataaagaagcaaggtagttttgacctaccacagtgtctgtatcggagacagtgatctccatatgttacactaagggtgtaagtaattatcgggaacagtgtgtcccataattttcttcatgcaatgacatcttcaaagcttgcagatcgttagtatctaacatgtatcccaaacccgaacacggata

SEQ ID NO: 534466 - DNA, 184 bp, Homo sapiens
  misc_feature (5)..(5): n is a, c, g, or t
atatnatgagtctagatacagaagccctgctcaaaagatacaatttttctcataaaaataaaccaaattaggccgggtgcagtggctcacacctgtatccccaggggccactattggggaggcagaagtggggtggatcacccggagtgtcaggagtttgagaccaggctgccaacatggtgaa

SEQ ID NO: 534467 - DNA, 337 bp, Homo sapiens
ccagattcatgcttcttgaaaccggggtgtgtgtggctcagcttccacggcgtgtattggttcggtctatgtgtgtgcgtgtgtatacttcaatgagaactgtcgtgtctgataagcactattggaggaggactaaagttgcctgatcaactattatgtagttatgccatgaactctgagggacaactgctgacaaacaaagggtttcaggatgacatttctgaccatttgtgtgtaagttgttgtaactagtattgtgtagatacttttaatgtaaacccatacagctttggaaaggggaagtctcaaacaggtgataggtcttactctctctaga

SEQ ID NO: 534468 - DNA, 1179 bp, Homo sapiens
  misc_feature (383)..(383): n is a, c, g, or t
tgacaacgccgctcccagccggccctggttgcgtccacgtcctgaacaagagccgcttccggatggctcttcccaagggaggaggagctcaatgtgtcgggaactgtctaacttcaggttgtgtgagtgcgttaaagaaaagaaaaaaaaaaaaggaattcccttatagccgtcattgtggtattgtttctaaaagtggcggtgagtgtttgtactgaaatgggtgtccattttttgtaggcgtacttaggatattgggcagaaaaagaaccattttccactagtgcaaagtttcttttagcacgctcagtgtgagaacattccagacctcttcattacccttcgatgtggggtcctcgctctttatagattgtggacccaanaaacctgttcccagttttattcttctgtaaagcatcacagaagccgaaatcgtggtggtctcgtgagcaaaccttatttccccggaaacgaccaccaggccttctcagtgtgccaagacaacgctgtgaacccgtgagagtatattctcaccaagtgtgtgccgaggcacacaagcgtgctgtggggcccaacaaccgaaagggctacccaaagggctcccggggaccaacctgtgtccacgcggcaagcaagagggcccaagactgtgaaaggtgtgggtgagaaggggaaggccccctgtgaagggtctccagcgggaccgtctctttgcgggatctcgacgggggcgtggcccacgggtgttgttttcacaggcccactgtggggggcctagtgggccgtctccgcaaggggcttttccccatgtggaggggttggcgggtcaagtggccccagttcttttccactttccgtgagacgaagggccactggggcgcgcaccatttaacccatgtgtgcggcccatgtgatgattgactggaacttatgggggttgtaccaacaaaatcccctcgggtgtgtgtatttcaccaaatgggggtcgtagtaccaacagaattcacggttcgaccaaataagggtgaaagaaacccatccgccgaaagaaacgccgctttttctccacaagaggacacacgtggggcacccgggggcgcacaaaactgagttgctgcacttcggtctcgcccggttaactgtgcaccagcgcacacttctccacggcttggtcgtaag

SEQ ID NO: 534469 - DNA, 274 bp, Homo sapiens
tgcggggctgccgacctcgggggggtcctaggacagcagcatgttgacagcaggccagagccttcagtgcgctgaatgagagggtgagctgtatgaccgccctgagaggttccttcctggggcctcgtgtacatggtctctatctatatgtccccacatcccatctcagggtctgctcaccaagtgtggccagataccgccaaagtgcccgcaatcattgctgtgacccggtcccgggtcacatggcaagggtatgggccccgatacatgccag

SEQ ID NO: 534470 - DNA, 968 bp, Homo sapiens
  misc_feature (148)..(148): n is a, c, g, or t
gacagatcctgcggtgagactactggtatgccctaggaatcttggccaggcagggctcaagtatagtgtctatgctaaaccaatatatttacagaaaaggtgtctagctcgtacttatacgtaaataatcgcgctgcatagatctacngtgtatattatatactacttcactaggaaccccatgtacagtaaaatactagtatacagatgatacatgtacttcgaccactactttaatactcaatgtggggatcatacgccccgagtgagaggcaaatcgagacacggaatcgccttgaaaccgctaaggctaacatcactatgcgctagtatcttacggccctaattcaaggacttcccatatcacgcactgagtgctactcgtctactggaatgtatgacgtgacagcacacaatctgtactgactctatctaaaaggaattcattgctagaacgatctcgtgcagtggtggcgatagaatgttatctaggacttgcgcgtggacgcacaatcgcacatataatatagatcttagttgaaccaatacatgagacttattgatcgtgactggattgccgtgcttgacgagagacccaattgcattgaacgtgcccttaatggaacgcgcgtgcagaaggccccccatacagactagaggatcaccggatgaacgtccgtcggcaagggagtgcttaacatttaaggcagtgggaatggtaattatcatgggctcggcattgctcttaatctaacacacgataggacaacatgactattaggcgaaagcgggtttcaggtgggtatttagtgggtactgaaagcatgagatggatagaacaaggggtaatgtggactagggaatcattaagaccttgatatcgagtctggtggcatttgggcttgcaaatggggggtaggaaggggaaagggttgaagtaacagtcaatgggaaggggaaagaaaaag

SEQ ID NO: 534471 - DNA, 331 bp, Homo sapiens
atgttgcgcacgttctgttttctgtgccgcaggacgcgataactgccctgtctgtttcccgtgcggtcaacccttgtcccattgcgcccggacacctcgcctgtttcgtgcgctgctgctatcccgatgctctggtcatgttgcgccggcggtgtactggcccccgtttttgacgcaacggcggagccggtggcaaaaaccaccatggcgcaagccgcgccgatactcagggattggaaggacttcatgacgatgccgtgggagaaagggagaaaacaagggagagaacaggttcaaagccatgatctcaccagccccacgtggcgtctgt

SEQ ID NO: 534472 - DNA, 567 bp, Homo sapiens
ttctttctgtagatggggaaactgaggcaggcttgcccatggtgaagtggccagtcggacacagggccagattgaaacctgcagcctgggctcccggctacaacagcgccagcctccacaggcattagaaggggactcactgcgagggccccagccagggcagctttcagggtggggtctctggcctcaccctggggaaacagccggggcgctggctgcctcctgctgagcctggcgtgggaacaatgtggcctctatccctggagcgagccaggccgcctggacgcccagcccttcagagcagcccggccaggcaggcgcccacagcatggcgcccgggccgcgctgtccgtccacggggtgcgggcgccttggccaggcccaggcaagccgctccccgtgtcctccctggctggccactgagtggccagacgccggcttcctcctccctctcccgcccggccagcctcctccttttttggtggtgggtttgggggcccagcccacccgccactgccacgtctgccatcctcccgcacccacgagcatctttcaaaaattcccggt

SEQ ID NO: 534473 - DNA, 132 bp, Homo sapiens
tctcatatcgcaaggccagcagttgtgtaaggcagcggacatgtgcaagataagtgtggtgggaagactaaccacgctcacgaattattaaaaacgctacgtgcccctacttggccttcccatatgctaggc

SEQ ID NO: 534474 - DNA, 376 bp, Homo sapiens
  misc_feature (216)..(216): n is a, c, g, or t
attttaatatcttactaatctctataggggaggtgtgaaacctctgttctgtgtcgagttgcctattgttttgaggcctttatgaaaaatcagatgattcatatttaggatggtctaaagatacatttaaatccaaacaccacccacaaaaaaactcagcaggtaaaatacatagagtagccataaacttaaaaaaaaattatctcaccaagatancaaagtgcagaatttattggtttgtatcaacctccttgagggcagagcagtttttacagcctcctccttttttggtggtgggtttgggggcccagcccacccgccactgccacgtctgccatcctcccgcacccacgagcatctttcaaaaattcccggt

SEQ ID NO: 534475 - DNA, 1471 bp, Homo sapiens
tgcttcttatatgtgctgttgtcgcttatccatcctttgttctcttttctcacttgtgttggtgtttcgcaactattctttcactgtacattctggtactatctgcacccctcgctctggctatggctcttcgtatctcccattgccacctttggcttgtcttttccgtggttggtactgctccgctttttgtacttctctctgtgccttttgggtctctattcctctctttctggtttgcctgtcccttgtttcttttggttgcgcctttcctctaatgtatggtccgtcttttcttttccgcttattcgtatccattctcaatctgctttctatttactgtgtcatcccttttactttctgcccctgtccatccgagttttattgttcgtgtctttcttcttttgtgtgttgttatggttacaatcttgccgtttttttctttgcgctcggttttatgcccttccctaactatgtgtttagcttacgaaactttcctattatatcgttgatgtactttctccctctttccgtcaacttttcttggtctgcaatatctcacctgtcatgtctttttcatctgtttatacctattccttataccttttttctccactattttccagtatattccacattttttgggtacttgtaatacccttctcattttccatctggcctgtttaatttttctttgtctgtactttatctgccttatattatctcctatctatattttttccttgtaaatgtcaatatttgtccttgatagtttcctccttgagtgtattcccactaattatgttggaacttcttgacattcacccctcagggttcttccactatcgtccctactttaaggatatattataacttctctttgtcaatccctatgctattcttaccacctctagtatacattctctagttgaaataatgaaatttcaagtgcattctctctgtaaaaacatcatgaaaactttttcctatatcctatacaccatcttatctctgtcccctacccccttttacatgtgttgtcgattaatattggactaaaaaagagtggatgacccatgtttattcccagatatggacctagttgcttaagcttcgaaagagaagacaatagaacttactaaagaaaataagcttgctgcgtgtcctatagcacggtcacaactattcttaattagattgtcaaatggagagagaactcgcttacgtacacattgcgagatctacaattattctggaatgttaaatatggttacgtcttacaaatagcatggcgtgtatgtgtaactatctactctagccacttataagatttcagcacttgcacttcattgcattctagtgtacatcacttaatgacaaaaatgtggcaaactaactgaccgatcgtctccttcagtctgctctgtttaattccgcctgtgctgctcttctcttaactgctgcgtcccta

SEQ ID NO: 534476 - DNA, 249 bp, Homo sapiens
catctacgaggggtatgccctcccccatgccattctgcgtctggacctggctgggcgggaccgactggctaccttatgaagaatcttaccgaacgcggttccggtttaccaacaccggccaaccggaaaatgtgcgtgacattaaagaaaaactgggctaccttgccctggaatttcaaccaaaaaagggcaccggtggtttcaacttcttccttgaaaaaaactaccaacttgctggcgggccgggta

SEQ ID NO: 534477 - DNA, 319 bp, Homo sapiens
tgggcctattaattaccccacctcctttctagcctcccactgcccttcccagcctctggtaactaaccagtcatctactctctatgtccatgagttcagttgttttgtttttagcttctacaaataagaacataggaagtttgcctttctgtgcctggcttattccacttaacataactatctttagctccatccatgctgttgcaaataatgggatctcattattttttatagctgaatagtagtccattgtatatatgtaccacattttctttttccattcatctattgatggacacttaggttctgtggtattgtt

SEQ ID NO: 534478 - DNA, 282 bp, Homo sapiens
  misc_feature (53)..(53): n is a, c, g, or t
  misc_feature (127)..(127): n is a, c, g, or t
gttaaagatatcagcctgctgactacaaaggaaaatatgttgtgtctcttttncctcttgacttcacctttgtgtgccccacggagatcattgctttcagtgatagggcagaagaatttaagaaacncaactgccaagtgattggtctctgtggatctcacttctgtcatcctagcatgggcaatcacctaagaaacaaggaggctggaccatgaacatcctttggtacagcccgaacccaccattcccaagatatgggctaaagctataagcactcgtcag

SEQ ID NO: 534479 - DNA, 961 bp, Homo sapiens
gcggcggccgccccgggttgaggcaggctggccaggtggacaggcgggcaaggtacagctccagcagttagccccctacaactctgttttccttccgttcacccttcgcaagttgcggctgacatggtcggcagcgtagtggaccatgagctgggctcctgtgtggacgaataaggcaccattctccctcgtcggattccaggacttcacgttcctcccagggacaccagaagctgagtgcccggatcctgaaggaggctctactatgtgctgtggtacttgtgaagccgcacgtgtaacgagcttgcgaggagactcctccagccccggtgggcaagaacgattgctgtacgaactgctccagaaggcagacgccagatcctattcgccgagtccagaagtctccagatgagacctccccaatctgtctatggcctgccatcactacccgcaaatctgtacaacgtccccccactggcgcgtagtccaagccccatggttacgcggtcattcgttatcgggcatgggttccccttgctaggccttggtacgccccgtgtgtcccattgtccactgtccctcgagtctcccgcagagtagtctcgcattgtgtcgccgtttgtctaggggagctggttccggcatcctcgtctttggtcttttccccagggtcagggtcagtggctcgcgcaaggaatgcggttgaagcaggcgtgttggcgagagtcctgagaatctgggtgctgcactgccagcatgcacattacttgtgtgcctcatttgtgttgtctcagccacgttccctgatcccttgctgaggctgagagccaagtggctgttgttggaggtcctggtcgcctgtgcggataatttcctgactaagatggcccctggtgtagcctgactgggccaacgacacgagaatgcacgggggaaagattcggtgggggaccagacctgt

SEQ ID NO: 534480 - DNA, 167 bp, Homo sapiens
  misc_feature (99)..(99): n is a, c, g, or t
tcgtatacgacttcgtcttgatatgaatctgtctgcttggcggtcagaattcactctagcgcgcatacgatgcccggcgcctcttatcatggctcagtnctgaaaacaacaaatagaacgcggtctattcattattctagctgggtatcaggcgggttggatgagtc

SEQ ID NO: 534481 - DNA, 853 bp, Homo sapiens
tcaaaaactggagtctggctctgtcacccaggcgggagtgcaggggcgcaatttcggtcatggcaacctggagctcattgaaacctccgtttcccgggtctcaagcgattctccggcctcagcctcccgattagctggaataacaggcgtgcgccaccatgcatggctaatttcgtggtgatattttaaataaggaagaagggggtttcaccatgttagccagggtggggtctcgaactcttgaccttagggagatccccccgcctggtgccttccaaagtgctgggcaatcgcaggcgtagacgccacgggctcccgggcctcgcctctgcttcttccacagtttgttcggtacaggttgggccgcccaggggggactggagcaatactaaaagaaccatagattcttccatggcaattcttcccggtagggtggtctccggtttcacatacttccttgagccagaggtcatcccattcctctcccttttcccaaaaggggttttctctctaggggggtccccccaaaccaaggtcttggaaaaggacagtctatggtaactatccaacgtgtaacaaatattgtgccattccaagacccaatttttccatcctaatcactgtgctcaccccaattccaagtaagaagattggtcttaaggcagtgtatttctccaccacgtggttgtgatgaccaataaagagaaaatgcccattcagattcttaattaacaaagtattcctctaaaaaaaaaaaactcgggcttcattcggtgggaaaacgagctagaactggcggcatagtgtttccgcctttcttgaagggagtgcggcccaggagatatgacgcgtg

SEQ ID NO: 534482 - DNA, 408 bp, Homo sapiens
ttacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgcccccttctttcaaacagaaaaaa

SEQ ID NO: 534483 - DNA, 143 bp, Homo sapiens
gactaactggtcgagtctatcttgtggaattcagctaggatgtatgccggtacagatgtacacagtcaaaaggctatcgagctgttgagagttcttggaggtgtctggatcagtgatctagctgtgaactttaattcacgctg

SEQ ID NO: 534484 - DNA, 150 bp, Homo sapiens
aatctacaattctgcaatcatgccttttaacagaaagtacaaatatgaatagcattataatttgtaactgcatgtaaaaatgtaaaatatttctctccgaatccaaaacaccacacaatctttatctgttctcatcttggttgggagctg

SEQ ID NO: 534485 - DNA, 145 bp, Homo sapiens
cgatatgccagcgacatgaagggcttgacagagatggcggaggagctacgtaatgcgcccctgtctttccgaagagccatgatgttctacgcttcgaaactaccggaaggaccttgctaacctccatcgggagggggagacacca

SEQ ID NO: 534486 - DNA, 986 bp, Homo sapiens
gactgagccactgcactccagcctgggcaatagagcaagactccatctcaaaaaaaaaaaaaatcgggctcatcttttattggctggtgggttgagatgaatctactggatgaagaaaactggtactttggcttacattcagaataaggctttcaaaactggtgggtgtgctgtttacgtgagccttctatttgaccaccaaagacagtattttggcagctgtatcaaatgaaccgagtgggaggaaatggtataggagtatatcttaagggcactacagcaaactggggttaaattggggttttgggcaaagattggaagaaaacgggtattcaagatgtactggcagctgtcaccaccaagcatgaactttcactggattacccataacctacgtgaaatcttcagcctggctgtcagcattagaccactggtgagaaacagtacattccattccagttggcccggcttttggacgatctaaatggccattccatggtttcctggtgaccatatggaagtttctgggtggccacacgaaaacagggattctggctgaacttgtgggccagaacaaccccaaggtgggcaggacaaattgaacgacatagttctatagtttgcaccctttcaacacgttgaaaattttcaacaagagtgttaaaacaagtgaagttaaagatacatgggacactgaactgggtcatgggggcaaaacaccaaatgcgcggatccatgatgaaattacatcaagcaaaatgggcagaatgacacagtataagattttatggcaaatggttttggtgtgacgcacaataagtgtgtaagaagtggtctaagtttctggggataggtattgagagggagcagaattcatggaggttatttggagggggaaccaggtgaaaacctgtggaatatggaagagaagtgccctgagtggtatcaaacttaacagggaggctgtgggagaagtggttcaacgg

SEQ ID NO: 534487 - DNA, 493 bp, Homo sapiens
tcgagctgtgtgaaggctggattgggtcctgatggggtgttagcctcatctcacattgggagtactagcgttacgattgtctctcgtgcaatggacgtccgcgaaatgcgtattagtcgaaccctcgcgcgggttctacggttgcccagagtactcttgactggtgcacagcgcgaatgccgcgaagctcgcaggactttcccgagctcgatgtgagcctcggtggaggcgtagacgtcgcatgcgtggcacgcgcagcggtcgcgtagggatgggtagcccgtgtctttgctaccccacgcgcgcaccgtacgaggacgtgtggtagaggcgacgtggcgcgtctgtggcgcctcggcggctcccacgagctctgctcggcacctctgggtccgtccgcgtgctggctccgtcgacacgacgtgcattttgcggccaggctgggcacgctttgcttgttcgtgtgcttctaaccctctggtatggttttctg

SEQ ID NO: 534488 - DNA, 178 bp, Homo sapiens
tttaccacccgcttagggctgcactctcaagcaacctgactctaaggagaggttcacccgataccagcaccggccaactacgggcctggcaccctctcgggaccgtggcctcgttcaagatggacttggacgcggtgcggcggtatcgggtatgcgaaccctcccgaacaccacatgt

SEQ ID NO: 534489 - DNA, 255 bp, Homo sapiens
aacagtctttcttgatacgactatactgagacacagttgtcaccaggcagaagatagataatatgacctttattaagttgatgaattaacttaaccaagacgggataagtagttgactatttatcctaaaaatttctcgtggctgggtaaccctctgagtaggcctataatatctacccttgactgtgtacatcatattgtgagccaggcgaacctatgtggtgaaaatgcacaggagcttggtagattgcggtg

SEQ ID NO: 534490 - DNA, 962 bp, Homo sapiens
aggatgggcatttaccggtgggcgctagaccaggatatcggtgaagcaccgtcgtagtaaaaaaatccgcggtgacccgaatgccccggggtagtgcgcgagcgccctcgcatgggggttatacatctccccggcccaattcggggcctgcccttggcccccccggggaacagctacagcgcaccccaaagggagcccgaatgccacgatagtcagactggcgcccagtaagggcaaaccgcaaatctctccggcgcaggcccggcctacacatagagcgccccgatacctggccaagtcggggtgtgaaaccccacagcatgcgccgcaacaaagggtctaaagcccccagggtttgagaaaaatggtagcaacgataaaaaagccgggcgcaacaaccaacggcccccgaaggaattagccggggccaccaccaaaggtggggggggagctcacccacaggcccacaggattttcaaaagatgactgcatcaaactaattcttggcgacgcacaaagctgagaataagcgagggttgtaaacaatccccaggagggtccagcctcatgggcccggcgccccgtgggggtcaaaccccccgggaatagcccagacaacactatggggatagccgaagacgggggagtcccgactgtcatcagaaggacaggacaagccactcccccgggcacaaaacgcggggcaacacccccgcctgctctgcttaacaagcccaccaagttaaatcccgcgggtcaattcggcgggcggcccgctgatactgcgcacagccagtacctgcggagacggccgacgagccgcccgatgagattagagctgtgaaacacccgcgagaggccgggagagcgcctgaccacactgcggcccgagaaatgaccccagcccccgggcacacccacaccgcccggggggcaagggagcacccctttccaaaaaaaca

SEQ ID NO: 534491 - DNA, 369 bp, Homo sapiens
tctcagggcggccccccggggtcccggcccgatttccccgggtccccccccgccccccgggggggacgggggggtcattgcaggggccctcccccccgcggggctttttttgttttttttttaaaaggggccccttttttaaaccccccccctcctttgttttaacccccgggggggttttttttctcccctcccgcccccccccggcctccgggaagggccccttccccgggggtttttttttttaaaccccccggttggcccccggggggggtcctttttttttcccctttttttttttttttccggggggtgggggggcccctttttttttttggcggggggggtttttactttttccccccccca

SEQ ID NO: 534492 - DNA, 151 bp, Homo sapiens
  misc_feature (1)..(1): n is a, c, g, or t
naggagcagaggaacacaggagggaggactggccataaagtacgttaatcaggcaaacccaatcacgtgctgtgcgcccacttcacccttgcatgtgaaatggggcaggatatgcacgtgagttcatggtgaaggagctggagaggagcta

SEQ ID NO: 534493 - DNA, 320 bp, Homo sapiens
ccacacttcccgcaactgtggaagccagttatccagctagtatagttattaatacaagatgggtgaaagatgttcaacggcatcagacagcatgagtggtaagattttagtgtgtcaaacgattgcattagttgtgtcatgtttttatggcagcatagcctaggttagccttaattaattcaataaataaagttgcgcattatttgtacatgtaaaagtgttttgtatgtttgctttacagtggcttgccacttttctatcagagaatcccccctcctgttatgtaccatgctatattaataagttggaaggtgctggta

SEQ ID NO: 534494 - DNA, 412 bp, Homo sapiens
  misc_feature (359)..(359): n is a, c, g, or t
tattcggccatcttggctccctcaaatgcattcttttgacatgtattaattagttaactttccagtctaagggagcactttcccttctacatttatttatttatatcctcatgagctcatggttgttgacttagttcattttgtgttgctataacagaatccctgaggctgggtaatttataaagaaaggaggtttacttagctcctgattctgcaggctggaagttccatggcgtagccctggcttctgatgaggacttttgtgctgtgtcataatgtggcagagaaggtcgaagaggaggtgaacatatgcgagactcggaaggggtgccctggctttataacaacccactcttggngtaattaattgattcctgtgagaactaacccagtcttgccagagtgagctcct

SEQ ID NO: 534495 - DNA, 1357 bp, Homo sapiens
gtcgtgggggcggcactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccatgaaaaaaaaaaa

SEQ ID NO: 534496 - DNA, 212 bp, Homo sapiens
ccgctgtacagttgcgtaacaaccggtggccataggcagtcgcatccaggccggtccatgcgagaagacgtgcttcttacccatttagagtttgagaataggttgagatcgttgcgggccgaagagctctaatcattcgctttagcggataagactgtgcggggggagtgcgtcgggtctgtgagagctgcattaatcctgagggagaactt

SEQ ID NO: 534497 - DNA, 405 bp, Homo sapiens
ggttgcccggtcgctctagaggtccctcctctgttccgcctaaatctctcttcattccctgtccccaagcatccttcccaaccactggtaaccaccattctactctctgcttccttgagacctcagcttttttagctcccacatacaagtgggaagattcagtattcgtttttctgtgccgggcttattcacttaataaccttcagttccatccatatagttgcaaattacatgatttcattcttattaatggctgagtaatatcccattgtgtatatagaccacattttctttatccattcacccactggacacaacttgattccgtatcttggtaactgtaaagagcactgcaataaacatggaagtgcagatatccctttttgatttgatatactgatttcc

SEQ ID NO: 534498 - DNA, 437 bp, Homo sapiens
tgcctcagttacatggaggatgcttctttaccatttccctacaccctgattcccaaaacctatttgctttcacctggactgaccctgacaccctccagtcacaagcagctcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcatttatagaaaatctacccccagc

SEQ ID NO: 534499 - DNA, 1011 bp, Homo sapiens
  misc_feature (284)..(284): n is a, c, g, or t
tggaaacagagttttggctcttgttgcccaggctggagtggtgatgggctcgatcttggtctcaccacaacctctctgtgccctcctgtgggtttcaagcaatttctctcctgtgccctcagcctctctttgagttagcttgggtttaataggcgcatgtgccaccatgtgccgtggcttaatttgtgggggttttatagataaagacagggtttctcctcccagtgtgtgtggttcagaggcggtggtctctctcaacacctcccaaacctctcgaggtgtgnatctgtgcccctctctcgtgtggcctctccccgagaagtgtgcggtgggaatttcacgggtgtgtgtgtacgccccacgtgttttcgcgcggagccccgcgttgtccccccctctcccttttttatagagagcgccgctgaaatatcacaagaggtttacaaaagaaatctccactttctccttatcagctgtggtggcggggagaaaatattcctcttagaaaatactatagcaagtgtctcttttactctcctctctctcttctcccccgtgttggtgtctctctctccgagtgttgggtggcacccgcgggaagcggcgcgtgagagagggggacactccgtggtgtgtccacgcgtgtgatgaggttcactgtgggggggcccccgagtgaaaagggctgtgagggtgatgaaaagtgttgaacccccactctttataaatctgtggcaggggaattgggggtaggaaatttttatctcccccccaatctgtggctccccataaagggggggggcttatacctctccctctcttgtggcggccctttttttgaggacacctctccacctttttcacaaaagaggatctctataggggggcgccctcaatttctttataaacacgggctcccattaaaattccaccttcaattcttggggcccctggggatataatttcctcaagtgtggcccctttgggccaacaatttccccccatttttgg

SEQ ID NO: 534500 - DNA, 144 bp, Homo sapiens
aagcatttactgatactgtgaccagcaaacttgttttacctggcacgactgagagagttaaagcagaaagccctggaatggtcccttaatacaggtagtttcatagcattaaagagccaacagccgttcccgagcttgaccagc

SEQ ID NO: 534501 - DNA, 188 bp, Homo sapiens
ctaaaacaagtttaattttgtacaccctaaaagtcacgtgcttacggcctgttcagcgagcagagctgccatctcagtactcctgtcctacgcagtgcttcacttgaaaaatgatcaagtgactttacattgtatattcccattgtatccgtgacatttttcaaggatatggcactttttgttcatga

SEQ ID NO: 534502 - DNA, 163 bp, Homo sapiens
ctgtaggtccccttgcatgtaccggggctcttcgtatgtgtggtacgggtggggggcatccatactagtcctccaggtttatggagggttcttctactacttaggatcttttcgcttcgaagcgtaatggcttctcaaactcatgaacaattattaactatta

SEQ ID NO: 534503 - DNA, 320 bp, Homo sapiens
cacacctgtgatcccagcactttgggaggccgaggcaggtggatcacctgaggtcaggagttcgagaccagcctgaccaacgttgtgaaaccctgtctctactaaaaatatgaaaattagctgggtatggtggcaggtgcctgtaatcccagctactcaggaggctgaggtaggagaattgcttgaacctgggaagcggtggttgcagtgagctgagaccacaccactgcactctagcatggatgacagagtagactccattttttaatataaagaaataatatagacaagagacatgctctcatgtgcacaatgataac

SEQ ID NO: 534504 - DNA, 136 bp, Homo sapiens
tcggtcgacttctgctcagctaatgcagacagtttgacaggcggttgtctgaacagctgcggtactcagggatctggagactgtgagaatcgcaaagctgggtattcgggccgaagacctttcaggacttttacaa

SEQ ID NO: 534505 - DNA, 88 bp, Homo sapiens
ccccggggggggttcccccttttttgttttttaaaattttttccccaaacccccaaaatttgaaaaaggggggggggggcccctttta

SEQ ID NO: 534506 - DNA, 188 bp, Homo sapiens
ggcctttttttaaaaaacaaaaaccccaaaaattccccacccatacttgctaaaaattttggtaagtatgtgcttttttgtgggggtgggatttggaaggggggttgggttgggctggatatttttgtaaatgtggccccccaaggggttgttgaaaactaattgtattaaatgttttttgataagca

SEQ ID NO: 534507 - DNA, 1472 bp, Homo sapiens
cggctgctattactatacgatctctaataaatccacgcatagatatatcattgtgcgtggaacatgactctaagtgtacttagcactactctctccgaccttcactctgcctgcttctactactggctgtaccaagacgcctactggcagcttgctcacctactgaccttccagcctgtacaccaccaagcgcactacaaccacttcctccgcgactgcgcctactgcttccaaccaagcatcaacctttgcacccacttcccccacaccctctgccctctacaccatgagcctccccacacaccacctgcccctaccacacaccccccccaccccgccccccacccacccttctcccccaccacctcctcgctccctctcctacacctatctccacgcgacatctgcaccgccacacccaccccctgcgcgcacccacccctcacgagcccttacgccacacccggtcacccccgccacgcacctcccacccccaactccctgcacacctccactgcgctgaactgccctgcccgcgcaccccccactcgcgccccccgagcgtaccaccaccgcaccacttcctactccaccaaactgccttttgcccttgcccaacccaccctctccaacaccccttaggcactgcaaatcaccgagcgaccccacacgccacccccacccttcctaaccactggtccccccctcacctaccaccccacccccccaccacatcttcacgctcccaccactcaccttcactactctgggcacactctctgcttccccccacacactcaactaaccactctccaccccccccattctaccaccactgctctccttaccttcatctccacccacatccgacgcacccaccctcgctctcatcacaccccctccctcacaaaactcgcccaacatcccttccactcgcactccacccaaacctaccatcacacccttctctctctgctccgcctccaaaccccaccccaccccagctcaccctccaaccaccctcttcactccgcccaccacaccccttccttccaccctctactctcaccttgcaccccacctcattccccccttatccgacctcccccccctccccacctctcttcctccccctcacaatccccaacctcctcatcaccccctctataccccaccacccccctcgtacttgccccctcactactcacacacactcctccccccacactcaccactaccaaacccatccccccgcctcccccctctctcccacccccaccaccaccctgaccccaacccctccacccctaccacctcaccactccccccccccaccttcccccctccccctcccccaccccctccccccccacaccaccccacccccctcccccccctccaccccccacccccccccacacaccacccccaccaccttccatacttatatttttacatcccccccccccccc

SEQ ID NO: 534508 - DNA, 430 bp, Homo sapiens
atatttggtgtattaatgtttttaagttactatataatttttagtgcaatgttaaataacagtatattggacggaatgagaagacggaatagaacaaagaagatacatgtttatatttttgatagcggaggggtatggacgaaggcccagccgcataaacatagtaacaataaagacacatttgcctgatagccaagcacttaacagtgtgcaaccagtatggcgaagctacaacggacggacggccgcggggggtgatattaattaccttttaaaatttaaaatgtatataaactgtgatgttgcccggccggggcgggtgtgttatggaggatggaagcaaacgccgcgctacagtttatcaaggcatataagcacacaccggtacaaataatgatacagggaaccgggtggtggcgtgactggcgac

SEQ ID NO: 534509 - DNA, 295 bp, Homo sapiens
ctccataatgtgtgcccagcgacatggaaaggactattttagatacggctgttagaaaggactctcaagacaggcacaatggctcacgcctgtaatcccagcactttgggaggccgaggcaggtggatcacctgaggtcaggagttcgagaccagcctgaccaatatggagaaaccccttctctgctaaaaatacaaaaattagccaggcgtggtggcacatacctgtaatcctagctaccaggaggctgaagcaggagaatctcttgaacctgggagatggaggttgcagtgag

SEQ ID NO: 534510 - DNA, 226 bp, Homo sapiens
gtgtgccgccggggtagatggtttcatggatctcaacgctatcatttgctgatcatgctctcgatgtctctggcacgatgcacgacactgggtttcgctgtctcgaggaggagaaaattgtgagtgactgcagaacacagactaacccaccacccagaacaacacctctgtggagttagaacaattgtttccctgaagccctactctgacacatgtcgaccgactg

SEQ ID NO: 534511 - DNA, 763 bp, Homo sapiens
  misc_feature (736)..(736): n is a, c, g, or t
  misc_feature (741)..(741): n is a, c, g, or t
  misc_feature (744)..(744): n is a, c, g, or t
gaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaactcaggacagtggtgagtttcagactcctctaggtgcccattctgcatttatttccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaaaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgcccgaggaggaccagaagggcctgtgtccagcccccaaaggaacccggcggccccgggggcccccgtcctggtggtcgggagctnccganatntcctgtctcccctgtcagt

SEQ ID NO: 534512 - DNA, 247 bp, Homo sapiens
agccactgcgcccagccttgttttattggttttctgttttctattttatttatttctactctaatctttgttatttctgtccttctgtgtgctttatgctaaatgtcttcttcttcctctagtttcttaaggtgggatgtgtggttactgattttagatctgtctctgtctaatctaggcattcaaagccataaacattcattaggcactgcttagcggcatcacacatatgtgatatagtgtatgt

SEQ ID NO: 534513 - DNA, 652 bp, Homo sapiens
  misc_feature (17)..(17): n is a, c, g, or t
  misc_feature (21)..(21): n is a, c, g, or t
  misc_feature (140)..(140): n is a, c, g, or t
  misc_feature (183)..(183): n is a, c, g, or t
  misc_feature (286)..(286): n is a, c, g, or t
  misc_feature (395)..(395): n is a, c, g, or t
  misc_feature (422)..(422): n is a, c, g, or t
  misc_feature (547)..(547): n is a, c, g, or t
  misc_feature (567)..(567): n is a, c, g, or t
ggggaggggaagtcttnctgngggacgggagtgttactgacgagtgagtccagggggtttgttgggaatactctgtacattccagcaatttggctgtgaacctaaaactgtcctaaaaaaaaaagtctgtttaaaaattngaacagttaaggccggtgtggtggttcacacctgtaatcacancactttggggggccaaggcacgtggattacctgacgtcatgagttcgagaccagcctggccaacatggcgaaaccccgtctcttttaaaaatacaaaaattangccaggcacagaggctcacagctgtaatcccagcactttgggaggccgaggcagttggatcacctgaggtcaagagttcgagactagcctagctaacatggtgatactncatctgtattaaaataacaaaaaaatntagcctggcatggtggcaggcacctataataccagctactcagggggctgaggcaggagaatcacttaaactcggtaggtggaggctgtggtgagccgagatcatgccattacactccatcctgngcaacaagagcaaactctgnctctaagaatatgtatatataagtgctagtaaccacaaagtatttgtctgaagtactcattcccctatgtatgatatctatcatt

SEQ ID NO: 534514 - DNA, 585 bp, Homo sapiens
  misc_feature (558)..(558): n is a, c, g, or t
  misc_feature (563)..(563): n is a, c, g, or t
  misc_feature (566)..(566): n is a, c, g, or t
ctgacaagaataacggatataattagttgttgatttgtgtttttgtgttattactctaggtgcccattctgcatttatttccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaaaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgcccgaggaggaccagaagggcctgtgtccagcccccaaaggaacccggcggccccgggggcccccgtcctggtggtcgggagctnccganatntcctgtctcccctgtcagt

SEQ ID NO: 534515 - DNA, 104 bp, Homo sapiens
tatgctcagccctagagtatcacacaaataagcaattatcatatttaatttctacattatctcctactaatcctttaactagacacactaagtacaaacaattg

SEQ ID NO: 534516 - DNA, 276 bp, Homo sapiens
actaaccctaatcgcccaaaaaaaaaaaggggcggtctcttgattctgtcaggacccccattgactggctcggtgtgtctggtgctttggcacaggttgagtgaagggagcactggtgtccacagtagaacttggtaagatttatatattgtatcatttatgagttttcccagccaggtagtggagagatttttaataacaggtgggtgcattacaggcggataagggtaaggggggtcaccggagctcggaattcggtaatctagggtctatagc

SEQ ID NO: 534517 - DNA, 437 bp, Homo sapiens
gctcagtgatgccggagacggaggaggtggtgtgcaataactgccctcccggggtacacggtgcccgctgagagctctgtgatgatggctaattagagaggacccacatatggtgaacatggcccagagaggccttgtaaacactgtcaatgcaacaacaatgtgagaccccagtgcctctgggaatagtgaccggctgacaggcaggtgtaagaagtgtatccacaacacagacggaatctactgagaacagtgcaaagcaggctacttcggggacccataaggctcccaaaccagcagaaaagtgtcgagcttgcaactgataacccatgggctcagagactgtaggatgtcgaagtgatgactcctgtgtttgaagccaagattgagggcccggaaagtccaaggatcctctagatcgactgaggaatcagctg

SEQ ID NO: 534518 - DNA, 128 bp, Homo sapiens
acttgtatttatgcaatcaattcttgactctcctggagacaatcactctttaaatcttcattctccgaatctgactttcgtgtttcatcctgagtatcactcaattcaacaagggaacagagtctggc

SEQ ID NO: 534519 - DNA, 244 bp, Homo sapiens
actgatcgcttagcatagctggcggtatgggccctgctcagaaacaaatggattgtccgaggggactcggtacgcttgccatctgagcgtggcctgttcacatcgatccttaaaacttttccagcaggaacttttgttctgagcatttccaaacaggccaaagggatctccagctgctgttgtttccgaatcttcttcttccggatctgttcttcagaaaggacgcactgctccctccttaagc

SEQ ID NO: 534520 - DNA, 844 bp, Homo sapiens
ccacatcccattccacattcattttctagacttttccccatacagttatctcagcactggtatctagcaggttcaactaacacatggctcactaaaaacattatactaataccttctctgaaaaacttattttctcctgcctactaaatatttatttcatcaacatgggctgcgttccactgtgtcaggattctgcatgtgggtggagcactgttccagcctgagaaagatggttctgaggccacttatcaagacattcttccaacatgagcaagtttctctcgcgcaaatagcgacacctgtccttggtgtgttgtctttcctcaggtaacttaaggggtccaaagcctctgaaaatgttctttatgctggttgaaacctcttatgtcgttgtacttataccctaccatgcaaattaaaataacgggacttcaaactctccaccaaattatgttggcgcccacccaggctgaaagctgcaccctttctccgcatatttctgtcttcaatatgtatcaccttttaaaccctgcatatattattgagcccccttctcctacaaaaatactaaaactagtataaccatcatttactaaatcattacactttctgtataaccaggcgactcacccatactgttttccatcagtttacccctctattcctgaatttcagcgtcacctgcgctgtcctgtctactactcataacaccgcgtaccccccccgtactattgtattactatcgccaaactatgatcaccatatctactgacacctatatatgaacccccccccgcccgctcaataatattcttatacaatatactatcctagttaatctcct

SEQ ID NO: 534521 - DNA, 283 bp, Homo sapiens
cagtggtgttgagtgggtcagcatgtgcttggataggtagctcacgtctcggcatgtgaagtcacacgagctcacacttgtaggggcttctcacccgtatgctagaagcgtgtgtcggatagagcaccctctttgtgggcagtggcaaatgttgcactctgagacattggtcggatcttttcatgcagcatgcatcttggcctacagtgatcctaggtaagccactgagttgaacggttgcaaaaggggctgaaccgtgcacgcgcaggttcttcactgccag

SEQ ID NO: 534522 - DNA, 218 bp, Homo sapiens
  misc_feature (117)..(117): n is a, c, g, or t
  misc_feature (135)..(135): n is a, c, g, or t
  misc_feature (147)..(147): n is a, c, g, or t
  misc_feature (168)..(168): n is a, c, g, or t
gagcggctgatatgctctgaactgctttgtaaaacttgctttttgaggaattgctcaaatgttacatggtattttatggtttaaaatacatgagagggaattccttttttggcacangtactgtgaaggacccangcattgtcactngtagaggctcaggtcactgcncgtggagtgggtttgctctctggcctggggaacttcagaccgctctaccg

SEQ ID NO: 534523 - DNA, 111 bp, Homo sapiens
tcaggaagagagaactgcaggtagagagaactgcagagtgcgggcagtggagactagcaagtgtgaggaggcgtgttataatcagtggtggtctctcgtttatgataaatc

SEQ ID NO: 534524 - DNA, 374 bp, Homo sapiens
  misc_feature (105)..(105): n is a, c, g, or t
cgtacaagtagcatcatattcaacagtgaaagactaaaagttatccacctaatatcaggaacaaaaaagtttccacctaagatcaggaacaagataacgatgttngttctagccacttttttttttttttgttcaaagacagggttctggctctgtcgcccaggcggatcttaacctcctgacctcaggtgatccacccgcctccacttcccaaagtcctagcattacgggcgtgagccaccgcgcccggccccctaagattattttaaaggcaaaccccagacatcgggttattccatcggtgaatacgggggaatatagtcttaccaggtgcccccgaaaataacgccgatttacgagtcgggggccaaaaa

SEQ ID NO: 534525 - DNA, 786 bp, Homo sapiens
  misc_feature (472)..(472): n is a, c, g, or t
  misc_feature (523)..(523): n is a, c, g, or t
  misc_feature (566)..(566): n is a, c, g, or t
  misc_feature (599)..(599): n is a, c, g, or t
  misc_feature (707)..(707): n is a, c, g, or t
  misc_feature (717)..(717): n is a, c, g, or t
  misc_feature (721)..(721): n is a, c, g, or t
  misc_feature (723)..(723): n is a, c, g, or t
  misc_feature (727)..(727): n is a, c, g, or t
  misc_feature (741)..(743): n is a, c, g, or t
  misc_feature (760)..(760): n is a, c, g, or t
  misc_feature (767)..(768): n is a, c, g, or t
  misc_feature (771)..(771): n is a, c, g, or t
  misc_feature (777)..(778): n is a, c, g, or t
agtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccctgctcggtcagtcagtcggcggccggcgcccggtttgtgctcagacctcgcgcttgcggcgcccaggcccagcggccgtaagctagcgtctggcctgagaacctcggcgctccggcggcgcgggcaccacgagcggagcctcgcagcggctccagaggaggcaggcgagtgagcgagtccgaggggtggccggggcaggtggtggcgccgcgaagatggtcgccaagcaaaggatccgtatggccaacgagaaagcacagcaagaaacatcacccagcgcggcaacgtcgccaaggacctcgagaaaatgcccccgaagaanaaggcgtctgtaggacccctggttatttggctctcttcattttggtggtcntgtggttctgcaattttcccagattattcaaagtatcaggatngggcattgtgaaggtgactgaccttaagatgtntccatttctcctgtgaattttaacttgaactcattcctgatgtttgataccctggttgaaaacaattcagtaaagcatcctgcctcagaatgacttcctatcatgctncatgtgtcantccnanggtntcttcatgagtcannnccaagtttctaggtccnataccannagntgcctnngcaaaaaa

SEQ ID NO: 534526 - DNA, 631 bp, Homo sapiens
  misc_feature (291)..(291): n is a, c, g, or t
  misc_feature (300)..(300): n is a, c, g, or t
  misc_feature (329)..(329): n is a, c, g, or t
  misc_feature (459)..(459): n is a, c, g, or t
gagaccttctggatgccttcaaggaggcgaacccggcagtaccagaggtggaaaatcagtcctcctgcaggcagtcaatccaggcccagagtctgagggcagtggtgtgcccccacgtcctgaggaagcagatgagacctgggactcaaaggaagacaaaattcacaatgctgagaacatccagcccggggaacagaagtatgaatagtaagtcatgatcagtggaagccgtctaaacctagatggagaaataatacgttagcgaccgggtgagattccgtggcgttgggnttgttcaangttcactctgttgcccagatatgcatganagcctagagggtattgccagcatatcagatgagcgtggtagctggacgaaggcgcagataaaacacacatcgtgtcggtccacgtgggatcgccactaagactacagaggcataacattcgtggcccagnacttcactcgcatcctttgccaaccgttggccggagcgaaccacttagcacccgtgggcccccgaaggggtgggccaggtggggagctagccccgtgggccggctaggactgggaccccggcgctctcagcagggaccccgtaaaagaaccacgcaagatcattgccacagc

SEQ ID NO: 534527 - DNA, 244 bp, Homo sapiens
atcccggctatacactatataggtgtgtgtgtactagtgtgtgtttctgtggtgtgtatagtgtgtaatgagtgtgtgttctattggtgtgtgaatgtgtatggatgagtgtgtgttactgatggggtgtgtatgattgtgtgtttctattggtgtgtatgtgtgtggatgactgatgtgttcctgtacgtgtgactgtgtgtaccttttactgggggttgactgtgtgtgacttctcttgacg

SEQ ID NO: 534528 - DNA, 667 bp, Homo sapiens
  misc_feature (353)..(353): n is a, c, g, or t
  misc_feature (404)..(404): n is a, c, g, or t
  misc_feature (447)..(447): n is a, c, g, or t
  misc_feature (480)..(480): n is a, c, g, or t
  misc_feature (588)..(588): n is a, c, g, or t
  misc_feature (598)..(598): n is a, c, g, or t
  misc_feature (602)..(602): n is a, c, g, or t
  misc_feature (604)..(604): n is a, c, g, or t
  misc_feature (608)..(608): n is a, c, g, or t
  misc_feature (622)..(624): n is a, c, g, or t
  misc_feature (641)..(641): n is a, c, g, or t
  misc_feature (648)..(649): n is a, c, g, or t
  misc_feature (652)..(652): n is a, c, g, or t
  misc_feature (658)..(659): n is a, c, g, or t
agtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccctgctcggtcagtcagtcggcggccggcgcccggtttgtgctcagacctcgcgcttgcggcgcccaggcccagcggctccagagtgaggcaggcgagtgagcgagtccgaggggtgtgccggtggccaacgagaaagcacagcaagaaacatcacccagcgcggcaacgtcgccaaggacctcgagaaaatgcccccgaagaanaaggcgtctgtaggacccctggttatttggctctcttcattttggtggtcntgtggttctgcaattttcccagattattcaaagtatcaggatngggcattgtgaaggtgactgaccttaagatgtntccatttctcctgtgaattttaacttgaactcattcctgatgtttgataccctggttgaaaacaattcagtaaagcatcctgcctcagaatgacttcctatcatgctncatgtgtcantccnanggtntcttcatgagtcannnccaagtttctaggtccnataccannagntgcctnngcaaaaaa

SEQ ID NO: 534529 - DNA, 430 bp, Homo sapiens
  misc_feature (19)..(19): n is a, c, g, or t
  misc_feature (43)..(43): n is a, c, g, or t
  misc_feature (377)..(377): n is a, c, g, or t
  misc_feature (385)..(385): n is a, c, g, or t
tggccgtgttttatacagntaatgccccccccccctgttttgntaacttttagcattttttaaaagtatatattgtatataacattcttggtagaaaagttacaaaatgctcattagtaaatagaaaagatgtcaattactcatactaccaccatccagaaatatcactcttaacatgttggcacacatccttcctaacatttttctctacacataacacgtgtgtaagacttttttttgaccaaaaaatagaatcaccaaccatccgatttattttttccccttattggcctttacctcccaaagccctcctcacaaaacccactgtgatgtgtttgatgggggtcctgaccacccatccttcttataaaaagtgngggtgtgncaattgtgccccgggccggggcttttgaaccccaacccagctgcc

SEQ ID NO: 534530 - DNA, 183 bp, Homo sapiens
cagtcaaaatctttggggttatagttattaatggaccgaagcttctccaacactgggtgggggttctgaaggagtagatccagaaccagtcctgatgactgtcctactcgcattaccgatccactcccagttactgacctgaatcccaactgtccacgagttccgaggctgctacccagcggg

SEQ ID NO: 534531 - DNA, 237 bp, Homo sapiens
  misc_feature (177)..(177): n is a, c, g, or t
tgaatgctctaccataaatactgatactcattctggtggcgaggaataatggcgatgggtaattattgcgataatataaaaataaaacttatattagctttggaaagtatctatactgcgtaggtctgaagaaaagctctatatgtctagtttgactagacagagagaaaccaaaanctcccttgttgctcacgcaagacaacagcacacccactgtccctctgctaggaacccacg

SEQ ID NO: 534532 - DNA, 654 bp, Homo sapiens
  misc_feature (461)..(461): n is a, c, g, or t
tatattttaactttacattttatttacagagcattaaaggcggtttacaaatcaatcacatcttcgcaaaaacacccggtgttgttttctcctcaaagcagttttcatacatggcatcattattctgttcataacagtcccaaggactggatagggtcggcttggctgtctccattttaatgacaggaacttagatgtggaggccttacgctgtccaggaaggggttttacagacgtaacttcgttgggtcttctcctcccacccgttgcacggcgcaaagagcccatcagttggcggaagtctgggggtgggaggacagtctgggagtgacaggctggcgtaccagaccagtcgatctgggtctcgggcttgttgacataagctaggggtcgaagtcaggggcacccgcaaaggcggacctgcctgggcacctagccaaggggaatccaccttcccgggncagccaccagggccttgaatgggcaaagtatcgaatcctgtcgtgtgtgaagcaagctcttcatggcgagcaccttcaggcgcgacctcgggtcaagaaatactccattgtgctgctgtggacgcgccggggccgagtcttcgggggatcggccaggccaggagtgaaaggcctgggagttcttcggccaaga

SEQ ID NO: 534533 - DNA, 1401 bp, Homo sapiens
gctctacaattgaatgagctcaccatggatgatgataccgctgtgctcgtcattgacaacggctctggcatgtgcaaggccggctttgcgggcgacgatgccccccaggctgtcttcccttctatcgtggggcgccccaggcaccagggcatgatggagggcatgcatcagaaggagtcctatgtgggcaaagaggcccagagcaagagaggcatgctgaccctgaagtaccccatggagcatggcatcatcaccaactgggacgacatggagaagatctggcaccacaccttctacaatgagctgcgtgtggctcctgaggagcaccccatcctgctgactgaggcccccctgaaccccaaggccaaccgtgagaagatgacccagatcatgtttgagaccttcaacaccccagccatgtacgtggccatccaggccgtgctgtccctatacacctctggccgtactactggcatcgtgatggactctggtgatgggttcacccacactgtgcccatctatgaggggaatgccctcccccatgccaccctgcgcctagacctggctgggcgggaactgactgactacctcatgaagatcctcaccgagcgtggctataggttcaccaccacggccgagcaggaaattgtgcgtgacatcaaagagaagctgtgctatgttgccctggactccgagcaggagatggccatggcagcctccagctcctccgtagagaagagctacgagctgcccgatggtcaggtcatcaccatcggcaacgagcggttccgctgccccgaggcgctcttccagccttgcttcctgggcatggaatcctgtggcatccacaaaactaccttcaactccatagtgaagtctgatgtggacatccgcaaagacctgtacaccaacacagtgctgtctggcggcaccaccatgtaccctggcatcgcccacaggatgcagaaggagatcactgccctggcgcctagcattatgaagatcaagatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcgtggctttatttgttttcttgtttcattttttgttttgttttttattggcttgactcaggatttgaaaaccggaacggcgaaggtgatagtagtcggttggagcgagcttcccccaaagttctacaatgtggccaaggactttgattgtacattgttcttcttttcaatagtcat

SEQ ID NO: 534534 - DNA, 1584 bp, Homo sapiens
  misc_feature (171)..(171): n is a, c, g, or t
  misc_feature (251)..(251): n is a, c, g, or t
gacatggagttatgtgcgctactcttgtagactccgtgatctcaccctctagatatgatgcaccgtaggctgctattgagcagagaatgacttacatcttgcatgcgtcatcacttggcatctgaacacacttaaaaccaaagtgctaatcagattggggttagataacgnattgagtctcactagttcctcaccacaatggttagtacgtcacgccttatgttgtgcgtgctcatctcttacatgaggtntctaggtcgactttctaaatctcttaggtaacagcgaagaggaagctcttgcagaggctatcgacttctatgcaggtaaaggctatccactcaacttcccgttcaggcaacttattgccatagtttcccgggctaattggtggatgggtggctcatcatatgatacaccatgacaaatgactatgactggcatcttaaatgtatcgtggctggacactatcataaattgcgagagtgcgtaacctctcaaaaatcctaagcaaaccgaacgcaaagtcacaggactgccccgtgtggacggtgaaccaccagacatgattctgggcggacgcacacatggtacatcctaggtaggtttggttgccctaattattcctttggtggagcgggctacactaccgtggattttgcttgcgagattttataccctaggttccttagccttatgcactaatttcctataggtccgtaattacttcgcatcggcaatacggttaacattactgggttagctacctttcatttacccacttgcttgagacacttaattgattatcgcacagacgagtagggtactttcttaattacggataaggatgcaatcactcacatcatgtggatttgacttgatgtcactcacatgggtttaaatccaggcgttgggggagcactatgggggccacaccaaggtaacttacagccaagtctccttacacctaagaagcttggcctgaaacatagccgtttgcgcccaacatctagcacacgtacagcggcaccaatgcttaatttagctcaactaaaggttattagactcatgccccgttagttgcgacattttgtggggccgccaggatcacattcttctcatttgaagatattcgcggactaaaaaattgatactcatatacacttattagtacagatggacaatattacggagtttcccgtttgatcattacgacggctcacacttttatgactagtgcgggtaaaaatatcttgtccacgtacaatatttgacgcattgtaaatcggtagaggtcgtgataacgaattataacaaccgatgggatttcggccgtggacgcatccatacatgacaacacagagacgcaacgctcatttagtcccacaagtttacgcgcacaggtagggatatacacctttaagacgggtatggtccttggcattgatctcttatgcaaacgcacagtgcagcacagcgtcacgtaactaattagtagagtttcgccttagaaaccgggctatacagataacggtgagggccataatcaaccaaggacagaagaaagcgggcaactacattagt

SEQ ID NO: 534535 - DNA, 824 bp, Homo sapiens
tcccttttctctttaagggagtttggccgcgagcgcgttctcctttaacattccgcaggccggggcgcgttcgcagctcggtgtggcggcaaaggagggcgctctcgggacctcgggggcgcgcgtcttggggctctggcccttggtcccggcgggctggggagaagggcgtaaccgggggggaaaaggccgcggagaaaatgtgcgagagagacccagggtgccgccgggagatgctcacacggagacaggcgaagcccgggagaagaaatgccgcccagaaggggggaggcctccagggccgggttggaagcccgagagcccagggggggggggcccccttcgggccagaagggggggcgcaaagaaaacaaccgggggagaccccggacaattcgtggcctttgggaccccgggcacacaaagcgctcctatacagagaaagatgtgcgtcaggtgtggcccaaccaattacaggggcgggatacgctgtagagcaaaagagtagaggctcgaggcgcttcccaggggagggggtgtgaccctataatgtggggccaaggaaagggggacgccgcttgtgaaaaggcgccaaggaggagcgcccctttaaaaagagacgcccgggggggggggaaagacgcaagagaaacgttccttgggggtcccccaaagaggtgctgggcaccaggggaggaagggacctcctgggcaagcatgtgggggcgcaaaaagaagaagaccccgcggattaaaaagaaagatgggcgataccaaaaggtccaaggggggtgggtaccacaggactttccccgagtagtatc

SEQ ID NO: 534536 - DNA, 993 bp, Homo sapiens
  misc_feature (993)..(993): n is a, c, g, or t
ggcccagttctccgtgttccggatgtgggctcgacaatgtgcccccaagtgatattatggtacaaccttcattgaacttgcctctaccacgggcgaaagcatcagcatgctgagtggcacgggccgcacgtgagcagctcgcactccggctgtctgccagtcatcccgacaacatcagacaccatagaccatagcacagcttggattgacgcatcatggtgcccaaagcagggttgcaggctgcatccttggcgccaaagtttcaaacagcatgttagccacccaagaccaggcactccggcacaaggcagcccgtcttgcaaaggctacatgtgcgccacctctacccttgaccaattggctcgctggacattccaatcacaaatgttgcccacaagtcttctgtgcccatacacatctagacgcaacccagtggtgctcaactgcaaagtaagactgctgttcaccgatttggactattcacgtaccaatttcattcctttgtggctcaacaccaccacttggtccagatcaagatcgttctggcgccatgtgatttctcatgatcgtggaccacgtgcacgagtggctgcactcacctccgagagagcagtgtcgttcgtcgctatctcagcgggccgacgatcccgcagttcttttggcccatatgttcacttcctacttttctgtggccaaacagggaaagtttcctatcgttcctggaccccgtccccccccttgttgtcggttatcgcatcttcgtgtcttaccggcaacctacgtgggaacacccagtctgtatcacaccattgggaatacatctctgataacgacagttctgccgtgtggactcgatactttaaaatgatctccgctgtttgactcatcggtggtcattgagtccgatggggatagggtattacacgcttatacccagattatgtgaggttcatgcgtcagcttcggtattttatagcagcgcagatacatccn

SEQ ID NO: 534537 - DNA, 390 bp, Homo sapiens
tggtcgtctctagaggtatccccccaccgtgcggttgtactctctccttcagagaacatggccgattgatgttttacaggcgtttatcagaggataactgacacaaagaagattggagaatatgccagtttcccagtccttacgatcaaatacagtgaccccagccagggagaataagggctgtaggaattgtaggtcttgaaaggaaactggaagaaaacataaatgaagactgacataaacatttctgaggcctttgaagacctcagcaaactaatgatcaaggctcaggaaactggtgcgaattctcaaaatccattgctcctaaatttaccgacgaacgaggtgacatcacagaagatgagaccatcaggtttaaatcctacttgc

SEQ ID NO: 534538 - DNA, 367 bp, Homo sapiens
  misc_feature (169)..(170): n is a, c, g, or t
  misc_feature (260)..(260): n is a, c, g, or t
  misc_feature (310)..(310): n is a, c, g, or t
aaaagataagaaatagtacatctgtatagggcactaacttgcaagtggtgtgggtgagtcagtgagtcagcagggagggaatgtgaaggactaggctattactgtacactactgtagacttacaaacactgtatacttaggctattctgaatttatataaaatattttnnttttttcaataatgaattaaccttcgtttactataacctttttactttataaattaaaaaaaattttaacatttgactcttatgtaacanctgttagcttaaaacacaaacacactgtacggtactgtataaaatatttnctttccttatatccttattattaatgagggttttttatggttttaaatattgtaacc

SEQ ID NO: 534539 - DNA, 424 bp, Homo sapiens
  misc_feature (21)..(21): n is a, c, g, or t
  misc_feature (55)..(55): n is a, c, g, or t
  misc_feature (64)..(64): n is a, c, g, or t
  misc_feature (189)..(189): n is a, c, g, or t
  misc_feature (380)..(380): n is a, c, g, or t
  misc_feature (389)..(389): n is a, c, g, or t
ccatcagtttcggcgtttttnccagagaggcaggctcacagcgatatcgcgaganacgagtttnactctcgttgcccaggctggagtgcaatggcatgatcttggctcactgcaacatctgcctcctgggttccagtgattcccctgcctcagcctcctgagcaccaacagacagggaattgctctgtnacgcaagctggagtgcagtggtgccatctcggctcactgtgacctctgcctcctgggctcaagccatcctcccacctcagcccttcaagtagctgggattacaggtgcctgccaccacggactggctaatttttttaatttttaagtagagacggagttttcaccatccatgttggccagggaggtcttgnaactcctgnacctcaagtgatccgcctatggctggctttttaat

SEQ ID NO: 534540 - DNA, 914 bp, Homo sapiens
agcgggtgttcggctggcagtcgggcgttggacggtcgccggatggctctggacgtgaagtcgtcggggcaatagcgttatgacgaagctggactctccttgtgggagggacaagtgtagccaccgtctagaagggcagagataggaatagcgaatccaatatggctcggacgcatatagagcaagaatactaaagcttaggaccatagatgcagagagcgtaaagagggtatagatgtagaagcagactttaagagagataatacatttattacagggaggctaatgtcatcacgagatagtatagatggggtactaccctgtgatgactatatggtagctagtaaagtactatatgattgagggcattggtaccttggaatgttagaatgggagagactgagtcgtagaggttatagattaaaggataattagtgcattgtgctggacgaccatcacactatcaaagatcatacgatgttgatgacgtctttcgtaggattagaatattgtacatcatacgattggatccatactatagggatctgagaaccaaagaagttgttgctagatgaaacatggaggttctaaaattgggcagattgaggaactgggcaaatctttagggaggcacccaaatagaggcttatacacatcaggtagtaaccaggatggtatcgaggaccctcgcgaagattagctaatagagtgatggtaggactgtatggtgtaggtggggatcactgttgggctgtcggtgtaatattaaggaggagttagtgtacgtaaggggttcgctttgtgacaggaagatgcatgagcttgataaactagggaaagaatatttgaaggtttggggacaacgagtgaggaacaggtggacggaagatgtgtaagtctgtcagattagagtg

SEQ ID NO: 534541 - DNA, 113 bp, Homo sapiens
ttcgaaggtcgcgtcttttactagtgcatgcactcaattgtttctcacgttgagatgtgtatgtagttctaaatttgtttttaactgtcatgtattctctctttttctctttt

SEQ ID NO: 534542 - DNA, 469 bp, Homo sapiens
acgatgttctgagtgtgtaaactcatgcgtgccaagtttctgtcaggtttgtacctgccacagaaatatccttgaaagtttatctaacagctggagccatgaaaaaaaaaaaaaaaaaaaaacccatgggagctttgtaaaacagggtgggttttgccaacgggaagagcccaagaaaaattacgaggctgccaaggtggtgggctgccaaagggtcccaaggtgggaggcaggaaattggcaggttggggggaagctgggggttctttcaaccattggtccctttcttggccccagttgttgtgttctctctacactgtgcacacttcttttcatgaagatagaccaagcccatacataaccggggcatgaacaccccactgtgggttattcctggcactcaggaacaagctgggtcttatggcccagctctcggcggaaggggcaagtaaaaagggggagataataa

SEQ ID NO: 534543 - DNA, 107 bp, Homo sapiens
  misc_feature (85)..(85): n is a, c, g, or t
tatgagaacctgtttatagataaaatagtgaatagtggaggactgtatccagctattgggaggtgaggaggagaaatcgttgaanctggctggagaggttgagtgag

SEQ ID NO: 534544 - DNA, 374 bp, Homo sapiens
cataagaatactctcttgaaataacaaatcttcataaccagtaactaataaataatcatcatcacaatagcttcactaaaaaaaccaattcaatgaaaggtgcttacttatggttaccttgaagccaccgaacttgtgtagctagtccatatccctttacattctttgctgatatcctgaacacaatggcaggcctggatgtatcagtcaatatgtgcatttgcaagtagcccgagcagttactatacataatgtcttccagactaaaatacatcctcatgaacacaagttgacttggattatcttgtatctgtgctgtgcggatagccaagtaggctgaatattccaaaaatattacccagaaagtgaggttg

SEQ ID NO: 534545 - DNA, 154 bp, Homo sapiens
cgagccgaatgtcggccaggcgcaccaaggtagttatacaggggacaagaaaatgagtacatagtgcaaggcaaaggtctagaaatagcacagcaccttcgagtcacgttggacaaactcgacttataaactacacgtcttgcttagcccctag

SEQ ID NO: 534546 - DNA, 597 bp, Homo sapiens
gggcagagctgttccagagtatcccggtaaccgggaaggagctattcttaccattgtgtaggcgagagatcacagtagtagcagcattgcctgtgacattgtcgctagcagaaatcaaaaatattttcatattacataagtggtgccagcatctcaaaatactgtttatgcttatcaccatttgggaattatgagttactaagtaatatcactacaccttgtaacccaacaagttaataagtccttactgttctagcatactttagtttgataaccattattcagtataattggcttctatcgtaatcccatgtattatgttttatgcatttttttaaaaaaacattctaaaggagcctaataggcttttccagactgctgaaggggaccacagcagagttctgaagctttgtaccaggtagttcattgtgtgtacaccaagcttatcaatgcttaatctgtaaatctgaaactattttaaggaaagtgtctggaaaggttaccttatacttttaagaagtcatttgtataatattgtttcttggcatataattttccagatttcttgtccagtagtacatggagttaatgaagtat

SEQ ID NO: 534547 - DNA, 265 bp, Homo sapiens
tcggagaggatcccgtgtgacagagctcagtcctctcccaagtccacacaggtgaggtgatagcatggctttcgtgtaaataatgtaatggcaaaatttttttaatcttcgccttaatactttttttttttttttttttttttacggggaaattgtttttactcttaaattgttttttaggccaccttcggttaacccggaggggctttggggcggggggcaccggaccccaaatccgaactcgagggccatagagtcggtgcgg

SEQ ID NO: 534548 - DNA, 142 bp, Homo sapiens
cgctcttatcctctgtatatatgtgaactctggtactcttctactcgcacataacttattatccaatgcctgagatcttgaggtcagtgaggcccggccgtacacttctcccattctctccagctaaaaccctccgcaccgc

SEQ ID NO: 534549 - DNA, 216 bp, Homo sapiens
cgttgcagttagacggcatccagtgtgggctgttttcgggctatgttgtctttgagctgtacagactccacctgggtcgcgttgagctcagcaacggctctgatctgctgactccatcttttcataggtgacgaaggcacagtttctggtcagagcctcaggattgctcagccaccaaaagtaactaccttcgaggtactggtccctacccacctt

SEQ ID NO: 534550 - DNA, 461 bp, Homo sapiens
gtaagcgtcaaggcgttgtctgaaccaccggttgagcggaagagtacctgtattcagtcgaacctgacctggatccatgacacctcatggccattgaattcctactacccatcttgaacacgttgaacactaccatctatcattatatgacaacatccaacctaaacgaacatcacagactttactggcatccatatagaactgatgcagacgtagacaacaatgattttccttggtatggcttatatttccctgaagtcacagactgtctcagacgcatatgcttacttgaggagaactaaccacctgtagagaatcccggaacgatgcaatgttctatgaagtgatactttaatggttttctgggctgctgtgtagatagacatattcttcagcgttcaccctgccaactgaggccacacttcacttctctcatcgcttcactatgccggtgcttgcag

SEQ ID NO: 534551 - DNA, 583 bp, Homo sapiens
caatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgccttcatggtggcctctctccatccatagacacactggatcatataagagccctggatcgcttacaggaagttccacatgagggcccaatgtgtgatctgttatggtcagatccagatgatcgtggtggatggggtatttcaccacgtggtgctggctacacatttggacaagacatttctgcctttaaccatgccaatggtctcacactggtttctcgtgcccaccagcttgtaatggagggatacacattgggtcatgatcggaatgtggttaccattttcagtgcacccaattactggtatcgctgtgggaaccaggctgctatcatggaattagatgacacttttattccttccttaattttgccccgcctcctcgtggtgagcctcatgttacacggcgcaccccagactacttcctt

SEQ ID NO: 534552 - DNA, 307 bp, Homo sapiens
ttactcgcttatgtcctgggatcccctcctgagctaggagaatgaactttcttcagggagctctaaccaaagaaagaagaccactgtgtcttctcttaatttgaaatagcttattggtattttcaccagcccggagtactgtaggagagtacgcttccctgtcttctgaggaatgcatctaaatgcataaggtattcctatttccattaactctatgtgtggtgtcgctgtaggaacgtcaggaagcagagaaaatgttcaagggcgaacggggtgcacagcttgcacaggatgttgccagggagca

SEQ ID NO: 534553 - DNA, 278 bp, Homo sapiens
ggctcggtaccactagtccacggttggctgcgcggcgcctcgtcttggcgggcctataagacgacttagaactggtgcgtgaccagggatactccgactgtttacttataacaaatcatctcgaagtgccgcggcgtgtgttgaggcgatgtgatttctgcccagtgctctgaatgtctaaagtgaagaagtttaatgaagcgcgggtgaacggcgggagtcactatgactctcttaaggtagccgaccggtggactagtagccaaccgtggactagt

SEQ ID NO: 534554 - DNA, 684 bp, Homo sapiens
ggcgccaatgttttagcgcacatccccgcttgatctcactaaagtgggaaagtgaggctcagagagccgaagctggactgtactgctgccatctcggctcactgcaacctccctgcctgattctcctgcctcaacctgccgagtgcctgcgattgcaggcgcgcgccacacgcctgactggttttcgtatttttcttggtggagacggggtttcgctgtgttggccgggccggtctccagctcctaaacgcgagtgatccgccagcctcggctcccgaggtgccgggattgcagacggagtctcgttcactcagtgctcaatggtgcccaggctggagtgcagtggcgtgatctcggtcgctacaacctccacctcccagccgctgccttggcctcccaaagtgccgagattgcggcctctgcccggcaccaccccgtctgggaagtgaggagcgtctctgcctggcgcccatcgtctggatatgacggagcctctctgccaggctgcccagtctggaaagtgaggagcgtctctgcccggcgcatcacatctaggaagtgaggagcgtctctgcccggccggaccccgttctgggaggtgaggagcgtctctgcacggcgcctgtctgagaggtgaggagacctccgctgggagccgcccgtcctgggaagtgagacgtgtac

SEQ ID NO: 534555 - DNA, 328 bp, Homo sapiens
aagtgactgcaccggcaatttctgtttgttcaagtccaccaccaaggaccttctgttcagcgatgacaccaaatgtttcgttaaacttccagagggtaccacacctgaaaaatacttaggagcggagtacatgcaatctgtcggtaacatgaggaagtgctcaacctcacgactcctggaagcctgcactttccacaaacattaaaatccaagaggtgggttgtcactgtggtggagacagatgctccctcccgttgcccatgggcttctcttggtcttcatgtcctgaggggttggggctaactggtgtagtcttcgctgctgtgcc

SEQ ID NO: 534556 - DNA, 303 bp, Homo sapiens
  misc_feature (57)..(58): n is a, c, g, or t
  misc_feature (88)..(88): n is a, c, g, or t
  misc_feature (147)..(147): n is a, c, g, or t
  misc_feature (213)..(213): n is a, c, g, or t
  misc_feature (265)..(265): n is a, c, g, or t
  misc_feature (282)..(282): n is a, c, g, or t
ggcgtgtctagaggatcccagcgctgcagcaatacgtttagcaccaaaacgatgtanntatctcatagagggtaggcccacattaccnaatccctgaacaacaaaggttttatctccaaacccgggtgtcattcctaaaaggctcangtaagaagcttcatggatgaaattttcaatcccagggaagacaccagggccagtagcagagatgcntccagggattccccctgggctgaggggtttaccagtaacacaggcgtgtgcnttaatatcataggtatngctcagcgcggggtaccgagc

SEQ ID NO: 534557 - DNA, 979 bp, Homo sapiens
cgggaggaagtgtctgggcggtcgcacgcactccggggcgacgccgcgagtcgccgtggttcgggccatgcgaggcggagcctgccgtgtctactcgcgcactggcggggcgctgcggggccgcagggcgacgaggacctgtgtcgtgggtcccgagacggggcccgaggccccggtggacgagtctggtgggcgtcgtacgcccaggcatagcgaaacgaggtaggtacggtaggagcgccgcgtactacgcgctcgctaatgcagtcctgtggtcggtgctcaatgatactgatgcatggattgccagcgtccgggggcgatgctcacctacggtcgtctacctggtcctccgtgcgagatgcataagtgaatcgctgcacgtacgtacgagattactaccgtgcgagagtgaagtatattggacaactgtggggtctgtcccgatcatcgacagcagacaaatgctgatggagcatcaacgtgaactcccagtcgccagcctctgctcttacgagaaccatggtgctcgatcgaggagtttggcatggcaaacgaagttggatcgcattgttccatcggcttggtgcggcatcgtacagcccgtcatttgtcctcctacacaatatactgggagctgctactacaaccgcatttggtgccctcggatgtggacctgaggcatggccatcgtggcctccattttgcggactctcgcatggcgtcaaaactacaatcacctagtgagtggcgcaggaacgtaccatgagtatctcccacgtacaaaggagccaggatgggcatggggaatagcaatcatgcacggcttcacgttgggggctccagcgcgccctatcatcctggatcgatcccaaggcctagtcgttctatcaggtttcgtttccatcgtgaggcttcggctgcgccctaggtgcccatgattaatttcctgaagcaactactgtattaacctgaactc

SEQ ID NO: 534558 - DNA, 393 bp, Homo sapiens
  misc_feature (111)..(111): n is a, c, g, or t
ccaattaggattaaatatgggcttgtccaagaaccagctgggggaagtgaatgggggtatggaaggctaccatcaaaatagccaaagaccgggacaaccactgtggacttnccaccgcggccagctatcctgtcgtgaattgatgggtagcggtaatgaggacttatggacactatgtccaaaggaattcagcttaaaactgaccaaacccttattgagtcaaaccatggtacttgaatcattgaggatccaagtcatgatttgaattctgttgccatttttacatgggttaaatgttaccactacttaaaactcctgttataaacagctttataatattgaaaacttagtgcttaattctgagtctggaatatttgttttatataaaggttg

SEQ ID NO: 534559 - DNA, 118 bp, Homo sapiens
atgctgcggtcgactctagacggactcccctttttttgttgttttttacctcttatactttggactatttacaaacgacacaacagaccctggacgggactacggggacacgggggga

SEQ ID NO: 534560 - DNA, 624 bp, Homo sapiens
aaactttaggctaggtacgaggctggggttgaatcggccgaggctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaccaagaaaaaaaaaaaaaaacttcggggacattccgtgggaggggttcggggctgtctgggaaacttcttctggtcttgacccgggggaaggaccctccttggaccccggccttcctccgggtttattggaaagggacggcctcagacatggcttggtttcct

SEQ ID NO: 534561 - DNA, 240 bp, Homo sapiens
  misc_feature (92)..(92): n is a, c, g, or t
cacacttattcgacgtgtcacagtcaggaatggcagaccagcaagaagatcagccatagctgacggtggacaactcggaataagtttgactngtgttttatcttaagccaccagatcattccttctgtagctcaggagagcacccctccacccacaagttgcgttgtaatccaagctacttgagaggctgaggtgggtgatcacctaagtcaggagttgaatgaccaatgctgagatctg

SEQ ID NO: 534562 - DNA, 678 bp, Homo sapiens
  misc_feature (91)..(91): n is a, c, g, or t
acccacagcgccaatgtttcggtttttccgggcccccagttagagcaatctttggccccccttgtgtttctcctagtttcccactgtgttnaaggaaaggccctctcccacgcttcggcccctggacgggtgtttcaggcacaaggatggcccagggattaagtttgcctgccactccccccgtgtggagtccggttccagggttaaggttttcccaaaagcacgcagagctgctttccccctttttgagaccaagatcacccaagtcctgcatttccccaaggatgtcaaggccgctgttaataaaatgggcaactttctggttggaccctcccccccccttcgcttggaacctgggaaaaaaaatttgatcatgggtttggatggggccccctatgcccttgagggacccccccagtccctgttggactcgaaaagttggattaaggaaatgcccttttaacgcctgtgccggagccccccccagggggcagcctgtgcccagctcaaagacttcctccaggggtatggccctcaggggtgccaggtgtgagggctcccccccccccccccttggggggaccctgaacctgggacccatgaagctggaagccctgctgggtccgcttttttgaacccagcctgggccccgggcatattaaaggcttttggccccca

SEQ ID NO: 534563 - DNA, 780 bp, Homo sapiens
  misc_feature (416)..(416): n is a, c, g, or t
taatcatgttcaggctgagaattaagttcctattggctaaaagtatccaattaagtgataagaactattcccaaaggttcaccatcatacacaactttagaactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaactaaataacaattgaaaaaaaaaaaaaanaaaaaaaaaaaaaaagaggggggggggcgggaaaaaattactccccgggggggcggccaatttagggggaacccggttttttggaaaaggggggccccatataggggaggggtataataaacaagggggggggccgcgctttaacaaaaagctctgggagcgggggacaaactggccgtcccgggggaactccgggggcaacgaacccctcactcgcgggggggggaccatcgtggagaccactcccccaaaggagatttgacgaccctcaaggcaacattatcacatctgaggctgattacggtccaccaagcgcgctatgacagctgcctaaaaattgtcacgagatatattggaacatttc

SEQ ID NO: 534564 - DNA, 403 bp, Homo sapiens
atgtggctgggccattgtttctctctgctgccggagctccaggtctacccttcactgctctgtgtcctcagcgtgtgtggcttcgtgaccggaagatactgggaaatccatagctaagatgccaggaccccctggcctagacatggtgagagtgctgggtccgacatcacgagagaggggaaggagttgctcggaaccggtgggaagtggctgtggcgggactcaggcctccccgcagtcagctccacaatctgctccctgagttctccttgcccagctcggcctcagtctccttcagccgtaagttggcggctgcgcccagccggggccccgggcgtcctgtctcttccctgcactgtgactgtgccctgcctggagtcctctctggcagttctgcacccgc

SEQ ID NO: 534565 - DNA, 973 bp, Homo sapiens
  misc_feature (861)..(861): n is a, c, g, or t
agggccggggtaatcggcgaggcaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534566 - DNA, 975 bp, Homo sapiens
  misc_feature (863)..(863): n is a, c, g, or t
gctagtacgaggctgggttcgaatcggccgaggggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534567 - DNA, 1098 bp, Homo sapiens
cgccccccagcaaaagagaagagtagagaagagaaacatctcatagaagcgctagattttgcttctatgctacacgtctttctacgtccctcatgtgtttatcccctcaacgctatgttcattgtgtagttgtcctacccacctttctgtcgtatgagtcctgctttggtgaactcctggtccctcgcgttttcccctttgggagtttatctcatctattacggtaatttatacacacggggggcccatcttccagttctcggatttggcgctttaccgagtccccctgtgttcgtccaccgaagttttccccccgtgccctgccccacccgtgggcccgagtcggatggcgcgatgttagtccccggttttctgtgcctctgagatgagcccggatcccacctgggaccggatatcagcatcacgcactaccccagcgcttttagccatgaactgacagtcccagtgactgaaagcaccattttcaattgtgtggatgatttctcgaaaccactgcccgaacagtcttccacaggtcatcttgtagaactccagctttgttgaaaatcacggacctcagctacatcataccctgaccccgagccaagctttccctatggttcccaagaccactagtattccaccaacctctgtatagtgtatgttttgccacaatttaatattaataccacgaggaagactccctctttttcatcacccgtatgaattttttataaagtgttttttaaaaaatatttcaagtatacttattaactaattcacccccagtggtttgttcttagatgattaaggagagactatattctagagtcactagtctgattttttattgtgactttctccacgccctggtctgaatttcttaaggttttataaaccaatagctgctatttattagctgccagaatagccactttagaactatttgcacgcattcagactttccagaataaagatgtaaatgactggcccataattaccctttttaggaaggtgttttgaattctgtatgtatatattcactttttgacatttagatatgcccaaagaatttaaatccaaagccctaagaaatta

SEQ ID NO: 534568 - DNA, 979 bp, Homo sapiens
  misc_feature (867)..(867): n is a, c, g, or t
ccacgcgtcgcggacgcgtgggtcgacccacgcgccgggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534569 - DNA, 941 bp, Homo sapiens
gattgcgtatggagaggatcggtctgagtgctcaacgtgtgtcggtactggatggggtaaatctgtgcactttgtgattggtcctgtgcgtgagatatacccgcatgggccagtaccctccgttgggctgtgtcccctttagtaacgtccgaccgccctgggctgcttagaaattcctggtatcgctagtaacggggcggagtgtaaagcggagatccacgaatagtagataagggcctgaaggaacctgagcgcatatggtagggagacctcacataatgggataccggacgggtgttcataatgagtacaccacgaggttctagcagaaagtcgcttgagcaggggactggctgcctggcctttaagtgtatgtaccagcactctttggcagtaacagggatgcagtgctagagtatacactttagactggtggtgacactagtttggtgactagtctgattattctacgtcgagggtgagaataaggcgcgtatattgtgaattaacatttttgtttgataatgagggagggaatggatttttgagacgatgggcgatcgtgcaagagtgcctcttgaggctgggagttgacctggaaattgtgcattaagagaggaaggggcagaggagtgaaataggaagtactcgggggtacgaaggttgcacgccggttgtggacccaatcgtagtttccgattgtgtttcggctggtcctggggcgcacctcctttgcatgaagatagtcgcacagtgtaatacaacgggcatgccgtgtaccagtatccatgtctccgagttgtaaagccatccgtaggaaggaggcatcgcatttgggaacagtcaatggcctggcaggcgcaccggaacgaagcccgcgccaaaagaggtccacgccaaagctccccaaagcacccacctgcaccgaagtagccggacaa

SEQ ID NO: 534570 - DNA, 1202 bp, Homo sapiens
  misc_feature (92)..(92): n is a, c, g, or t
  misc_feature (1090)..(1090): n is a, c, g, or t
cacacttattcgacgtgtcacagtcaggaatggcagaccagcaagaagatcagccatagctgacggtggacaactcggaataagtttgactngtgttttatcttaagccaccagatcattccttctgtagctcaggagagcacccctccaccccatttgctcgcagtatcctagaatctttgtgctctcgctgcagttccctttgggttccatgttttttttgttatttagtttttatttcataatcataaacccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534571 - DNA, 982 bp, Homo sapiens
  misc_feature (12)..(12): n is a, c, g, or t
  misc_feature (27)..(27): n is a, c, g, or t
  misc_feature (870)..(870): n is a, c, g, or t
acatggctagtngaggccgcgtgtaantcggacgaggcgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534572 - DNA, 764 bp, Homo sapiens
  misc_feature (8)..(8): n is a, c, g, or t
  misc_feature (48)..(48): n is a, c, g, or t
  misc_feature (139)..(139): n is a, c, g, or t
  misc_feature (187)..(187): n is a, c, g, or t
  misc_feature (686)..(686): n is a, c, g, or t
ccccttcngtcccggagtagctggactagggggcatcccaccacatcngacttattatggttttgggttgaaatacaccggtggtttctgaactaccatttagttaaaagaggtttgaaaagaagggccccaaaacggntttaagagtaacacccttaatcactaaataaatttatactgcccaaangattaagtttgaatttcattcaattacagtaacagcagaagtgcagtaaagcatttacacttatgggcattactactttattattaggaaagacaatccattttcctcaaaataaacataccaactgcaaaccaagagtttgccaacagtacacacccaacagctaaaaataccataattggcaataggcttccattttgacaaggctttcagtgtatgttgtaattccaatgcttcatatcaagctggttcaaacaagattctttcaacacactaatatttcaattaaaaaggcatgttcctttgataagatctatttttcaactgtccactaaatttcttaatggctatctctttagagactcttaattaaacaagttatgattagagtggctggcgttaatattgccaatgcaaacactgaccttttcaggaagagaaattgaagagggttataagaattctcaaaatagggccgggcatggtgctcacgcctgcnaccccagcactttgggaggccgaggagggcagatcaccggaggtcaggagttcgagaccagcctggccaacgtggtga

SEQ ID NO: 534573 - DNA, 285 bp, Homo sapiens
  misc_feature (2)..(2): n is a, c, g, or t
  misc_feature (11)..(11): n is a, c, g, or t
  misc_feature (15)..(15): n is a, c, g, or t
  misc_feature (49)..(49): n is a, c, g, or t
  misc_feature (52)..(52): n is a, c, g, or t
  misc_feature (64)..(64): n is a, c, g, or t
  misc_feature (67)..(67): n is a, c, g, or t
  misc_feature (79)..(79): n is a, c, g, or t
  misc_feature (97)..(97): n is a, c, g, or t
  misc_feature (100)..(100): n is a, c, g, or t
  misc_feature (104)..(104): n is a, c, g, or t
  misc_feature (107)..(107): n is a, c, g, or t
  misc_feature (132)..(133): n is a, c, g, or t
  misc_feature (156)..(156): n is a, c, g, or t
  misc_feature (167)..(168): n is a, c, g, or t
  misc_feature (178)..(178): n is a, c, g, or t
  misc_feature (212)..(212): n is a, c, g, or t
  misc_feature (214)..(214): n is a, c, g, or t
  misc_feature (230)..(230): n is a, c, g, or t
  misc_feature (236)..(236): n is a, c, g, or t
  misc_feature (249)..(249): n is a, c, g, or t
  misc_feature (264)..(264): n is a, c, g, or t
  misc_feature (275)..(275): n is a, c, g, or t
  misc_feature (281)..(281): n is a, c, g, or t
  misc_feature (283)..(283): n is a, c, g, or t
gntaaacaganaatngtaggaaagaggggtggtttggtaagcgaatttnccntggtttcctgcnccncggatgacgacnttagtagaggctgaatcnacnatcntcngaaaatgcagctgcatgtcctggcnncgagtgctgtattgtaaagggcnagaatatcacnngaaatagacnaagatgttaagatttacatttccgttgccttgananttccctgttactcccnacttcnccctatggtgacngtttatagaagaccntaaataaaccnctacancngg

SEQ ID NO: 534574 - DNA, 971 bp, Homo sapiens
  misc_feature (22)..(22): n is a, c, g, or t
  misc_feature (859)..(859): n is a, c, g, or t
tacgggctaaggtagcgaggcngggtgtgggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534575 - DNA, 985 bp, Homo sapiens
  misc_feature (873)..(873): n is a, c, g, or t
aaactttaggctaggtacgaggctggggttgaatcggccgaggggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534576 - DNA, 112 bp, Homo sapiens
  misc_feature (112)..(112): n is a, c, g, or t
ggtaatatacagaattataatggaaccatgtagttttaaaaactaaccctggtgcacgtgcatacataatcttttccttggtcaataacggcaattttcatttcttttaaan

SEQ ID NO: 534577 - DNA, 324 bp, Homo sapiens
cgacgtgccacacacctgtgcgcagtcaaactgacacatgcacacacattttgttttttaatttctaaaagggaagcaagttaatattgctggatgcatgtgccttctatgttcctaactcagactgactttggagacctttccagtcactaccagcacatgaacactggcacgtcagctaacatcacagagcttcagtttctgtaaaatggataaatgacaattactgtctatggacttggtatgtgccaaacactcagtgtatatgttaacagatttcatgaaatgaaagttcaaccttattagggccaaaaatgtcgacac

SEQ ID NO: 534578 - DNA, 833 bp, Homo sapiens
  misc_feature (4)..(4): n is a, c, g, or t
  misc_feature (14)..(14): n is a, c, g, or t
  misc_feature (99)..(99): n is a, c, g, or t
  misc_feature (807)..(807): n is a, c, g, or t
  misc_feature (833)..(833): n is a, c, g, or t
tttngttatggaanatatatctgtttttccctgcagctgtgtacggaagtcaccagactttggagaacccatggaaagatccaccccaaaagaaaaagnctattgataaaccattctgaaactgaataaatggaagccccctatgcatcctatcaactattatattcaagttgttctattcatctataatcacctatttaaatccaaaaaagcatttcaaaacaaaaacacgtccttcaaaagctctgcctcgcacaaaatctgtaatactttgctgtatatcctaccccaaacacatgccagagaggtcaatgaaagaatgatgcgaaagaaaggccacttgttggcccgccctgatgggaggccgccgaggatattttgtatttcgactgtcctgtgtttgtattctccccggctcacccccgctccccacccctctgcctattactccccccactatagctcctccatccagtgctctccatccctcttttgtagtcgcctactcgtccctccgtattccccccccctcgccagatcgtgttcgactccaacactgctcctcgtatttgcttacatcaacttactcccatttgtttatagacgcgcatgtgtcgtgattaatgaagagttgctatagaaaaataaattcaactccccaacgtccaacacccaacacaaacaattttatttattccttcattcgattcccgagtgagttcctatctaaccccacgtcgctccacagggagtcgacccctccaatttctccacacaacctctaagttccttaccttatactcgcgncatttttattttagcatttcctcctn

SEQ ID NO: 534579 - DNA, 111 bp, Homo sapiens
acttcctaagggaacttcgtgctggcgctaagggatattcccttagagcagcacgaatacccttagacagatgaataccttagcacacagaactagcaccagcacgaatgg

SEQ ID NO: 534580 - DNA, 214 bp, Homo sapiens
cgcagtgacagcacaaaagtgtatatttatactctttggggagatggtcatccagaaaatgcagaatgtgtttctattagatttccctttttattagtttatgaatgaaacaacaatacaatgttgaaaaatacttataaaggtttcacacatactcagaagtatgttctctgtgggcccaagtttgagaaacagtgatccgtaattggggttt

SEQ ID NO: 534581 - DNA, 127 bp, Homo sapiens
tgtcgacttctgctcttggtgtgagataaggtagaatcggtcggatttctggagtactggatcatgatagggacactcaagtggtagaggtcatcttcactgagacagggaaaatgggaggctataa

SEQ ID NO: 534582 - DNA, 214 bp, Homo sapiens
  misc_feature (57)..(57): n is a, c, g, or t
  misc_feature (112)..(112): n is a, c, g, or t
cgtggtgtgggtctagatgtggcttggatcctccactgctgtggctgtggcgtaggncagcagctgcagttcatattcgactcctagcctgggaacttccgtatgcctttgntgtgaccctaagaaaaaagttataaacaatttttatcttaaagtctattttatctggcattagtatgtatcacctttccaatttttggatgggagtactggt

SEQ ID NO: 534583 - DNA, 807 bp, Homo sapiens
agcgggctgcccgggcggcggcgatgctgaggccgcggctggctggcgtgccgagtgggcggctgctggcctgggagctgctgggcgcctcgtgcgctgctgatctgctgtgcgtgtggctggtgcggctggctgggccctgcggctgggaggtctgggccgcagcgggaccccagttcctccgccaatgcgcggcctgctgccccgcctcaggtgacatgacaatggatgctctgttggctcgatttgaaacttctgaatccagatgaccttagagaagaacatcgtcaaagccggagttgacacatgtggacccattacatcaactacaaggttcatttttgagaacacaattggctcaggctttactggacgcaaggaggaaggctgtcttctttctactaccatgaggcaggtgtcaccagctctcaagccaggaagcccaacaaaggattttgaagccagcttgaagggaacccaagtgaatcaggctggattatctgaagacagagatatgggttacaggtgtgggcctgaatcctccagaagggggaagcttgtgacatccaagaacttgctcggtgacccctaattgacagcggacacctacagagcttggagcgacttgcgtctaaggagccggcctgtacatatgggggtgtgtccaggtgttatgaaggaacgtccagcggagaacttgaaaggatctatagttactgaaagatacaaaggaagccattgcaaagctgtcgagatgatcaaagggttccgaatttaaggctattcaccagagaagcacgctgagaa

SEQ ID NO: 534584 - DNA, 996 bp, Homo sapiens
agcctcacccctggtcctgtgacccccccacccacacagcacacatacttcaggcttggattctaggctccaagtggcagcatagaagcagcagcctctctccaaaccctggctctgtgagccataggaaccagcactaggtcatcttctgacatagccctggtgaaggtgtgtgtgtgtcggtggccacactcgctaaggctttgtgtctaagaattgacgtatttgtacctaggtgtgagggaaccagggtcagccagcctttttcagatggcgccaggcacacacactacatcaatggcttgctggtggcttcaccactatccaggtgacttaaaagagtgtctggaaacatgtccctggtatacttcaattcctactacaccattgtaatgaccactggtgtcaggtaacggcacgagagagttaacaacctaccagtcgtggactagacatcagtcgcattgtcccaaagacaggcttcaccaatgattgtcgcatatgcagtggggctcacatcacgccgccatgaacagtctctccccaaatccatttagtgcttcactacccccgccaagcacagccctaacaacacattctcgtccactttcctgttcagccacccccagccgcaatatacttgccagcaccccagagcatatgatgtcacttgctcaccttatcttccttccacattcctatactaagccatctgaggtctccacgaatccactcttgcgaaacgccaatgagccaaccaatccggagccgagcgcaggccaacctggtgcatggaccaggaacagcatgcttatcacgccgatgtccagcactgtgcacacgccccagggccaccggcttacaccctctcaaacggtcgaccccagcgcacctcactccggccgccgccctcccacgggcgggcgcatgtccttcgaacagcgcctactcccgccgccacccccctggccccccagcgcccccacctcccctcac

SEQ ID NO: 534585 - DNA, 492 bp, Homo sapiens
ccgtgccctccttcagctcagcctagcttggtcgctctccccggcctctctgtttcctgtttctttaatgatgaatctggctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtaattggaagttaagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcaaaaa

SEQ ID NO: 534586 - DNA, 112 bp, Homo sapiens
gtcacgagttcagtgaatcgtatcctgtcctcgctgtttcctggtgtcaacgcggcacgtgcctcctgtaactccttgtcctcgctgtttccagtgtacaacgacggcccgt

SEQ ID NO: 534587 - DNA, 725 bp, Homo sapiens
  misc_feature (75)..(75): n is a, c, g, or t
  misc_feature (339)..(339): n is a, c, g, or t
aaggtggtcaccttctgtgactatgcctacaacaccttcaggtcaccacggtgcatgtcctcagctgaagaaggncccaaaaggagggggggggggggaaaagaaaaccgttcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaatnaactcttcaaggccaagggacagtggtctaattcaactctgtgtcccagcacctggcacaccagaagtgcgcctgggtgcggcaggagaatcgcttgaacctgggagatggaggttgtggtgagctgagattgcaactctgcactccaccctgggtgacagagtgagactttgtctcaaaaaaaagctgtgaggtgaaatctgttctgtgaaggtggaacttggaaaggcttgtaaggatggtggtcccatgaagaggatgaacaaaccaagggaactgtcctcttgctggtttgggtgatgtcccatcacctgtcactttgtttgtttgggctgcagtggaccaatggtttcccaggcacactgaagtgacatgtagatggattg

SEQ ID NO: 534588 - DNA, 443 bp, Homo sapiens
ctctgtggacccccaggtcttttcccctcaaattccttcagctgttggacacagtactcatcaaagatctcatacaccagaatgataggttaaaacaccttttctgtaaattaggaaagggcaattttagtcagggaagcctcctcgtcacatttgtggctcagagggaacactaggaaccagagtgaagagaagtgagattggagacaaggagcctagtgtggagcttactgcagaggctctggtgagagatggtgaaggtttggaccaaggcagtaacggtggttgcttttacttacacagggtacatcctgattgtcaatggatggactatgaatggaacatgactattcgaagtataaaaattgacgcttgaccatgttctctctgtgggagtttttaggtagcttacaaaacttttgaggggaaaaggcctgggggtc

SEQ ID NO: 534589 - DNA, 468 bp, Homo sapiens
atcaatacgatacaaaatgattcttgtagaatcctgaatccataaattacacttttttatttttcaaatttcacaaaattcacaggggtgctgacggtaataaccactatgggaaaacatcccgtaaacctgcctgtggctatgccaatggagtgactgacctggtgacatctgtttgacgcttgcttggtgtggctggtacaatgcccccgttgtgcatacacttggtccatcaggggtgccgggagggttttctagattatggggggcgggtaaaattgggacttttttggttgtcccttttttgatggggtgtgggggtatagtactcagcttatgccctaaaataccatgtttaaaaaccccctgaccgtattggtgtgggtgtgtccgtgtgagtgtgtgtttgtttccttctggcaattacagcttggtcttctggaccttagtgaattctttactcttttc

SEQ ID NO: 534590 - DNA, 400 bp, Homo sapiens
  misc_feature (4)..(4): n is a, c, g, or t
tttntctgttgttttctggcatccactgttgatagatattatttgtgatctacttgtcaattctttggatatctttcttacctccagtagtttttcactctcttggtcctggtcaggtatggcagctcatgcctgtaatcccagcaatttgggagaccacggtgggcaggttgcttgagcccaggagtttgaagaacaaactggtgcaacacgacaagaacctatctctacaaaaaataacaaaattaaacgggcgtggtgggcatgtatctgttgggcccagctattcacgaggctgaggcgggagggatcacctgagcctggcagggtcaaggcacagtggaccgggattacgcccctggcggccaaactggtcgacaggctgggggattcccttcac

SEQ ID NO: 534591 - DNA, 571 bp, Homo sapiens
aagttagtcgggacctgttgtgagctgcctatgcagctgtcaagaaacaaccacgtgagtaagcttggaactggattctccagctccagcgaccctttatttgactgcagccttgtgggagatcctgaactacaaccacttagttgagccgttctcagattcctgagtctcagaaactctatgatataataaacatttgttatgaactgcttcagttttcagcaacgtatacacaatagacaactgtacgactactaaaaaaaattgagtaaaaaaaaagagtcttgaaaaatgacaagatgaagagaccagaagtgaacgtcaattcaaaaatactaagatttctaagtcaagagaaactgttagggcctggaggactaagggtgagatgatgattatgtgatgcactaagtttgagctctagggaaagatctaatatagatctgaaagtcatctatatagttaacttcaatgtatgacattgtccaaagcaaatatggaacatgtgaaaaagcacaaggtcaaaaattagaacatggcacgaacacagtaaagagaagaaaatgagctg

SEQ ID NO: 534592 - DNA, 440 bp, Homo sapiens
agaagacggacattgcttgccttcgtgaaggagatcctgggagaagactcataggggctgggcctcggaccccactccggccctccagagccccacagccccatctgcgggggcagtgctcacccacaccataagctactgccatcctggcccaaggcatctgggaggaaccgagggggctgctcccacctggctctgtggcgagccatttgtccaagtgccaaagaagcagaccattggggcttccagccaggcccttgtcggccccaccagtgcctctccctgctgctcctagacccgtcttcaagctgctgaaaatcctggcctgaagggggccttgattgcccctgggattgcttgttgcccttgacaagaaggcttgcaagtgctgggtgggattgggccaccgctttgccaaccttgattgcattccaagttgg

SEQ ID NO: 534593 - DNA, 919 bp, Homo sapiens
gcctgcgcacagtcacatggtcacatctctgagagagaacatgttcactgttttcccacagggtactctttaccaggaaaacccggtgaacactatgcaaccaacacgtcccctttttataaaggtgtcggtacaacaacatgagcatggccatcaaggtaccacgtatttccgcttggcacaatcggtggttgcccccaacccaatgtcaatgtcggacaaaatctggaggcactctttaccagatctctggtgatcgctgcgcctccggacccctgtgtaaactgtcaggcagcacaagccagtgtgtgtggcgcgcccctcgccgtaaatccgacggggagcccccccgttctccctttcgcgcaaaggccgaagaaaccgtaggtcatcaaaggtcagggggcaaaacctccgacttttcggctccgggcgtggacgacgaccaaacctcttcatgcgttgtgaaacagggaaacacctctttctgtggaaagcaccaacaccatatcggcgcgccccgccggaaggtttgggcggcgcaatctccccaagtgaacgaaaaccctgtgggagtagttataccagaaaacgttccgccccctaaaatcttccccccttgcgagcaccgccgcggggcacttgttcccgcccccagacgaaacaggcggccacccacaatacaggagttggttgctgacaaagaatgcctcgggcaatgtctttagaggaaattgtacagcagtattgtatggagggcagatgatcataaggacgcgacgcatagtctccccatggtccggcattggcgtgcccgccgttagaaccgttgtggggaaataccggggtgtgacctgtctaactggccgtctccccccccaaaatgaaaaaccgccctttgataccccaaacaataaca

SEQ ID NO: 534594 - DNA, 315 bp, Homo sapiens
aaacggctagctaaagacaagtgcatctgtataggggtacaggtaataaacctactgcaacatctataagatccacaaatgaagggatataacaataatgtcataggtgagaaacacagcaaccatgacttaaccctatgaatgtggaggctatcaacaaagaatgggcttcaaacattactaagaaattgacaataatttagttaaatatattttctcattatgtaacgacttctccatctccagtgtaatccaggccagtgctaaaaatccagatgctgttagtaacctacctcagtcacagctatacctatt

SEQ ID NO: 534595 - DNA, 892 bp, Homo sapiens
  misc_feature (428)..(428): n is a, c, g, or t
taaagaaaaatttccaaaggggaaaatttttttaaaaaaaattaaagagccctttttaaaaaagggggaaaaaaaaaacttttaaagagaggagaagattgtttatgttgatttgagacaagaaacatttgggggggaggataacaatgttggtgggaagtcaatatagcgcttgtgggggtatttaaaaaaatttccccagaaaaagagggggcttcaatattttaagggtaaccaatgtgggacaaaatactttttgcacctcatatagtagagctgctcctaatatatgttttgatggtgggaaacaatcttcatgtgtggtgagacgcgaaataatggggttctaaccgaagtgtttgtgggatattacatgattatgtttggttataacttataaaagagctatgtgggggggagaaattatnattctccgaatgggatgggttcttttaaaaaaaaaacctcctttttatgtcgggttttctgataataaaggtggggacactatttgttggaaacaaacgtggtggttgaaagcggggcgtttattaaacttcgaccgtgggtggggtaattatcaagaaactccgggggtggtgtgtccgcaccacaaaattgatatattctctcatataaaggtatgtttggcggaagaaacataacgaggggaaggggaggatattagaacaggagggtcattaaaaacgtggtgtttttgggggacgaggaacaagccggattattatatcttttatcaactaggttctgtggtagtttgtgccacgtaatattattttcccctaagaggaggatggttctcttggtggcccaatttggggtgggcattaaaaacaatacagtttcaaacaacacattttttcacgcgctg

SEQ ID NO: 534596 - DNA, 403 bp, Homo sapiens
ttcctgctgctccctcttcaataggtctccttgctcattggtctccctctatctgaatctcatattcagaaacgctcccactgctcccgcggtctgagtgcccctcctcctgtaagcggctgcgcaaagctttggtgggggttcgttctcccatcccggaggtcaactgctttgcggtggggttgccgtcctgagagcaatatggaggagagatcttccactgggtttggcacaagaaagctgctgtcctttccactcccgtttcgactctccgggatttctcttcaagcaccgacggtaaacagagtcaacatctccaacgctgattttggaatggatgctctctaaggatctgcgtgcccttgtcaattgacacactggcatctgaagagagaggcagcag

SEQ ID NO: 534597 - DNA, 1011 bp, Homo sapiens
attgcacacttaaaagacatcagtggatgaaatcacaagtgggaaaggaaagctgactgataaagagagacacagacttttggagaaaattcgagtccttgaggctgagaaggagaagaatgcttatcaactcacagagaaggacaacgaaatacagcgactgagagaccaactgaaggccaggatatagtactaccgcatgcttgaacagctggaagagacaacgagagaaggcagaacatggcagggcagcaggtgttgactagccttcatctgcagagcaaagacgtattgaaacaacagtttgtctgctgcaacctcacggaattgctgcatacttgaaagcaaaaccaatcacactccgtttatcacagactgtggctccaaactgcttcaactcatccacataaatacatattcatgatcatggatacatacagctgaaagatgctctggagaacaatcagcagtggctcgtgtatgatcacgcagcgggacgtctatgtcaccaggacttttagcccacgatcttgcagtcggataacgaaacacggacaccagctgctccttcactcccacagccgaccaataaagcctgaactccgaaggttatcttcacatgacgcgacgcacgaactgtctacgaccgaatctccttggcgccaggtgccaaactcgccatcctgtcggtgtggaccgagcaacgcaataatctagccctgacgattctgaccttggaggtgggacgtatgaaacgcacacactgacgcaaccccttacgcatgttccctttaaatccagtgacgacttaccaaccgaagggcacatgtcgcaacctgtgacgagtgacacgatataacatgatagatcacacagctcgggttgactatccttgtcgcgtaccgcgtctgcgtcctaaggactgaacagcgccatctcacggtccgacttgcacatacgtatcgctgcacaagataacgctgtccaacgccctataactaatactagagt

SEQ ID NO: 534598 - DNA, 555 bp, Homo sapiens
  misc_feature (87)..(87): n is a, c, g, or t
tggttgggcctccctccttccccccggtgggttttgtgggggggggtaggtgggggtttccccaactcttcccgcccccttctaggnacttttcctaggcccagggggggccccagacccagggttgttcccttccccctttccggggggggttttcccaaaccggtgtcgccttccctcgcggtgtgaagggttttttttccccggccttccgtgtgggtggggggggcgtgggggggcgggggaaaaattccaaaacccccccccccgggtggggttccgggggctctttttttttttttaaaagccccccctgggccaaaaccgggggggcccggggggggttttttttttttcccttttgggttggggttttgccccccccccccccccaaagggccctttcctttttccggggtttttggttgggggggcgggccacccccccccccccgggttttttggttgggggggggggttttgggggggccccctttttttttttttccggggccccgggtggggtttttggccccccccccccccctgggggga

SEQ ID NO: 534599 - DNA, 919 bp, Homo sapiens
ctgcaactgtcagaacttggtattgtatatgctgcccgctgactagcagctggactgatttggaataaagaaaatgaatacgcattatagggttcccctacaaaacattctactattcacaatacttttgaaatgggtataagtcagttgactttacaccccttgcgaagagcatctactacatgtgtgaggttcacttgtagttgtatgatcccttcccctcgagctctccttccgtgctttctattaaagttgaatctgggtgcgtggcaggctatactctctaatacttcattatagtcatcagcgtcattgtcctttttactcgtagacccatgaaaaaggaaaacttagtgatgataatctataaaatagtgtaatttattcattaatagcatgtcacgcgcatgagagattataacgaatcatattgttctgggaagatagctagtcgggcagcctatagtggtgtaattgtcatggtcattgtggtgaaacattgagacctgtgtacatagttgtaaaattggactagcgtgttctggtcatgatttgtgtcaacgtgatatatatagtttctgtatgattgattacttattctggatatagaaaacctacttgagcaataagttaagtttccatggaattgatcgagcaatttctgccaattaaaggtgactatttatgtaccggtaagtactgacagtaagattatattacagctctgaacttgcttgggggtaggcaggcttcattagctttcttgtcctaatccaagcgttgatcgggtgagggagtggggttctggaggaaataaaacgcttgaatgttgtaggcacaaaatggggctaaaaagagtaattggggaaaagttgggcacaacaacggtttgttgggaaaattccggggattccttaga

SEQ ID NO: 534600 - DNA, 979 bp, Homo sapiens
  misc_feature (867)..(867): n is a, c, g, or t
gaacctaggctaggtacgaggctgggtgttcacgcgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534601 - DNA, 982 bp, Homo sapiens
  misc_feature (30)..(30): n is a, c, g, or t
  misc_feature (870)..(870): n is a, c, g, or t
aaggcaatgacttacggctaggtacgaggnctgggtggcgggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534602 - DNA, 522 bp, Homo sapiens
  misc_feature (472)..(473): n is a, c, g, or t
  misc_feature (477)..(478): n is a, c, g, or t
  misc_feature (508)..(508): n is a, c, g, or t
catcctagaccttctcaaactggcctttaattgaaactatctcagttgatgatatgctttcaccacttacttctctggattcagagtccagagtgctcaccattacacgatggcaccacttacttctcaaaaaaatccagcaaactataacagatcagtagttatcaaccaggggcaattttgtccccagggacagtatcagaagacatttttaattgtcacaactggcagagctgaggagtggctctggtgtccagtgggtaggggacttggatgctgctaaacatcctacaaagtacaggacagcctcccacaacaaagaatgatcccacccaaaaggttaatagtaccaacaatgagaatccctggcgtagatccaggtatagtaagtctgcaaaagccaggatctacgtgcagccaggcctccgtatctgcaagttccacgtcagcagattcaaccaactgtggatcnnaaanntttggagaaaaataaaaacaataaaaatancagtacaataataa

SEQ ID NO: 534603 - DNA, 1010 bp, Homo sapiens
  misc_feature (898)..(898): n is a, c, g, or t
ccaggagaaagaaagagggcgcacgagagaacacggcaggagcagggcgggggggatcctggacgaggggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534604 - DNA, 437 bp, Homo sapiens
tgcctgccttggcctcccaaagtgctgggattcaggcgtgcgccacctgaatgctcagcttttctttcttttcctcttactggttgctaaagagcaggcatcccatttgaggaatttctctcctaaattctctgggacttccttaatagaaaacatcttccaagtaatctcttttccttcactccctacataaaatcagagagattccctcctctctgcctggggggagttagatgattctccaaagagccagatccttcagccagcagtaacccacccgcttaggcttctctcacactcatcctcagcctctctttgttcaagtcttccccagagcccagagctgttaaggatcatcatttctttctttctttctttctttatttttttcttttggaaacgggcccttggctctgacccccaggttggattgcagt

SEQ ID NO: 534605 - DNA, 221 bp, Homo sapiens
cgtgctagcggcatagtgaacgcgtcatctgatgacgtggatgatgtcctgagggctcgtcgcgtcaaagtggtcgagtcccatccttctgccaccagggtagcctgagtacctgctcttccgcttggggataggtggcctcgtgctcctccgcttggggataggtggcctcgtgctcctccgcttggggataggtggccgttcacttaatgccgctagcg

SEQ ID NO: 534606 - DNA, 902 bp, Homo sapiens
  misc_feature (12)..(12): n is a, c, g, or t
  misc_feature (24)..(24): n is a, c, g, or t
  misc_feature (790)..(790): n is a, c, g, or t
  misc_feature (792)..(792): n is a, c, g, or t
  misc_feature (800)..(800): n is a, c, g, or t
  misc_feature (804)..(804): n is a, c, g, or t
  misc_feature (808)..(808): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtccaaaaaaaaaaatcgagngntcaattcngggngggnaaagggggttgaaatggcaagggcaaatgttcctggccccttctgtcaagggggaactccggcccaaagggggaataataaacggaggtccgca

SEQ ID NO: 534607 - DNA, 895 bp, Homo sapiens
  misc_feature (12)..(12): n is a, c, g, or t
  misc_feature (24)..(24): n is a, c, g, or t
  misc_feature (817)..(817): n is a, c, g, or t
  misc_feature (827)..(827): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaataacaaaaaaaaaaaaaaaatcggggtctttattcgggggggaaagaggtttggaanggcatggctngtgttctgaccatttttgtcaaggggaactgcggcccaaggggcgaaaatcgagccgactataaaagg

SEQ ID NO: 534608 - DNA, 194 bp, Homo sapiens
aaggcaaggttcaggcttccagggtagcaaactgggaagaaacaaatggaagatcagagttgttttagtaaggttacttatgcagattcttctcagtcttcctggactgagtctagcagcttttcaccagtgattatcaatctaagatctgtttttaagccaaatgacaggcaaagcagtaggccatagtcctg

SEQ ID NO: 534609 - DNA, 541 bp, Homo sapiens
  misc_feature (11)..(11): n is a, c, g, or t
  misc_feature (21)..(21): n is a, c, g, or t
agacccatgtntgtcacaccnagtgatcaccattaatgctgtacacatgttagccagcagtcccaatagcatcaatttggatataccttaatgactgcatttgtttcatagttttagtttcttcatactaacttttttttttttgctttagtgttattaacgtttattttcttagtgtttcttagacataaatccagtatcgtttgccaaaggtaaaagtatgtgtaaaagtctcaaaaagagctaaacagagccaagcacgatggcaaacacctgtaagccagcacttgaaaggcagaaagaagtacagggatcaggagttcaaggccaacgtcagctacattgagacttctttttctcaaagtgcaccaacaaaacaaatgtaaaaccttgttcggaaagcccaggtgttcttctctcctaagccctgcccctgaggccagcaacactgatctcgttccctggtctgtgttgtgaaaacagatcacaagtgtcaggtttggaatgttcaagtggccctagacccaggcgcaggcttcct

SEQ ID NO: 534610 - DNA, 961 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactgaactaaaaactaaataacaaaaaaacacacaacaacaacagaagatacaccagaaaaaaaaaaggaaagagacacagaaaacaaaaccataaaaaatacaatgaaaaacgcgacaccacacagagaaaaaaggagagggagacaaaaaaaacagagagaacacaaagaaacacagaataaaaagagcagacaaaaagaaaaa

SEQ ID NO: 534611 - DNA, 413 bp, Homo sapiens
ggcacgagagtaactctctttcacaatgtgaccatacctgtgtatgggtctcttgggacttgggcttcatgctacaattcactgtgcattacctgaaggcaaagtaacagactggcattcattccaaccaaatggcactctctacaagaagtgattcattaatggtgactttgcattcaatatgtaccggagaggcactgtggagaaaccagatatgaacacatttcttttcccctgggagcaattctgcagatttgggtatagctttcctttggggcctggtgtaagacccaaactgagaatggggagaccttgggggtcaacctctcagacacttcaatggtagagatccaccatgggttccagaatctgagctgtgtactgagatttccgaaggaactggaattgcctgg

SEQ ID NO: 534612 - DNA, 817 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgaaaaaaaagtcgagcggccgttcacttagtagtagta

SEQ ID NO: 534613 - DNA, 110 bp, Homo sapiens
cactcaaccagttcaaatttcaccacaggggcatttcagcagggttctagtgggccacatttcacacagttgcaactcaagcattctcatcatatggcacccacccagct

SEQ ID NO: 534614 - DNA, 128 bp, Homo sapiens
gactatacactacatgcagaagagccgcctggtcatggacccggattcggagactgacgtatacacacattcctcattgacactggagaacatagcactgcgcattatccgaagggccatctgcgcgc

SEQ ID NO: 534615 - DNA, 949 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaatacaattcacaccccccaacccaccacaccaaaacccagggaccaacacgggtccgcaaaaccagctaagcaggggccagggacaaaacgggcacggacccaaaatgcggactcaccgggacaaccgccgggcacccatagaggggcgccaaaaacacaaagcaggtacgtgacagaccaccaccagc

SEQ ID NO: 534616 - DNA, 1383 bp, Homo sapiens
  misc_feature (12)..(12): n is a, c, g, or t
  misc_feature (24)..(24): n is a, c, g, or t
  misc_feature (1383)..(1383): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggggggggcgcgccgcacaaaaattctctcccccggggggcgcccccattggcgcgccgcgccccccctttttttgaacagaaggggcgcccccaaaagagaaggaggcaagcttattatgagcacagacgaagcgaagcgcggcgccccggcactattaaacaacagacgcacgaggagcggggaaataacagcctgcggcctcagcgggagcacaacattggggagggagaagcgaccccctaagacgggcggggggggcggagcagaacaacatgatggggccaaacacatcctcctctctgcgcgggtgttttttttgacgacccctccagaggagcggacataatattaaacacctttcaagcagggcttagtataaccgcggggggtacaacacaccacgcgggcaaatataaatgctgcgcggcgcggctcgggaaaaatttttcgctggccgcacggaggagcataatactttcaggaacaaaaattttttcccacgaggggacggcgtcgaagtagn

SEQ ID NO: 534617 - DNA, 429 bp, Homo sapiens
  misc_feature (300)..(300): n is a, c, g, or t
gttgcataaccctgccgggcgtgtttctccgggcctccctcctcgggctgtagcgaggggtaagggaggtcatacgccctgtggaacaccccaaagcctgggtccctgggatgcatccacagattgtaggcctgagtcttaacacactccatctggatttcaatgacttctgcctggttccagtgctgggctgtttccctgtctgagctttggtggcttttgattgacccctttcctgccccagcatgaaggtggagtagccagaaggaagggatgcgggtgtataaagatgtcatcggngctgtctgtggatggtgggtgagacagcacctgtcatggtggaagggccacaggaagcgtggaggctgtttctggggccaccttctgcctccaggagggcagggatcctcctgttggcatcttggtccc

SEQ ID NO: 534618 - DNA, 1030 bp, Homo sapiens
  misc_feature (12)..(12): n is a, c, g, or t
  misc_feature (24)..(24): n is a, c, g, or t
  misc_feature (785)..(785): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgaaaaaaaaaaaaaanaaaaaaaaaaaaaaactttttgggccgcgccttgaggcccctgaaaagagcttcttcttagaccccatttcgttgtgggcgccggcggcccccagttggtgttatctgtgtgaccctgtgcgcccctaggccgtgttgccccgaggaaaactgcggcgcccggaacctgggtgcttggggttttctccgccgagtttaaaaacgcccgggggggaaccccgagcgtttctcgtgcaccaattgcg

SEQ ID NO: 534619 - DNA, 139 bp, Homo sapiens
ggacccacgctgtctggagagacaaggagaagaagaaggagaaggagaagaaggctgaggacctggacttctggctgtctaccacccaagttgccagcagaggtgaaacgatggaaaacaatatataactatgaaacag

SEQ ID NO: 534620 - DNA, 1007 bp, Homo sapiens
  misc_feature (10)..(10): n is a, c, g, or t
  misc_feature (110)..(110): n is a, c, g, or t
  misc_feature (121)..(121): n is a, c, g, or t
  misc_feature (126)..(126): n is a, c, g, or t
  misc_feature (129)..(129): n is a, c, g, or t
  misc_feature (179)..(179): n is a, c, g, or t
  misc_feature (192)..(192): n is a, c, g, or t
  misc_feature (222)..(222): n is a, c, g, or t
  misc_feature (250)..(250): n is a, c, g, or t
  misc_feature (269)..(269): n is a, c, g, or t
  misc_feature (278)..(278): n is a, c, g, or t
  misc_feature (295)..(295): n is a, c, g, or t
  misc_feature (326)..(326): n is a, c, g, or t
  misc_feature (339)..(339): n is a, c, g, or t
  misc_feature (345)..(345): n is a, c, g, or t
  misc_feature (349)..(349): n is a, c, g, or t
  misc_feature (356)..(356): n is a, c, g, or t
  misc_feature (369)..(369): n is a, c, g, or t
  misc_feature (380)..(380): n is a, c, g, or t
  misc_feature (382)..(382): n is a, c, g, or t
  misc_feature (408)..(408): n is a, c, g, or t
  misc_feature (410)..(410): n is a, c, g, or t
  misc_feature (421)..(421): n is a, c, g, or t
  misc_feature (425)..(425): n is a, c, g, or t
  misc_feature (433)..(433): n is a, c, g, or t
  misc_feature (439)..(439): n is a, c, g, or t
  misc_feature (441)..(442): n is a, c, g, or t
  misc_feature (446)..(446): n is a, c, g, or t
  misc_feature (448)..(448): n is a, c, g, or t
  misc_feature (451)..(451): n is a, c, g, or t
  misc_feature (455)..(455): n is a, c, g, or t
  misc_feature (457)..(458): n is a, c, g, or t
  misc_feature (758)..(758): n is a, c, g, or t
atacattacngtgctaaaaatgaaaatctaacccaagacatgacattcttagctgtaacttaactattaaggcctttcccacacgcattaaatatccccatttttctctngccatttgtanctttnccnattttcttattggcacatgggtggacacggatctgctggctctgccttanacacacattgcancttcaacttttctctttagtgttctgtttnaaactaatacttaccgagtcagactttntgttcatttcatttcaggntcttggctncctgtagcttccccagntggcctggaggtgagcaaagggaagtaacanacacacgatgttntcaagnatgnttttganactagaggctcantggtgggagananccctgcagaacccaccaaccagaacntngtttccctgangctntaactcanagaaanannctgngnctntctnannaaaatatagacactctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttcttncctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgcc

SEQ ID NO: 534621 - DNA, 407 bp, Homo sapiens
gatagtctgatgatttgcatcccattgaattcctggtctactctcaactgatcagagtctgtcaggatagctgtgacttacatagcaccaataatttacagcagggttccttcccttcttttatatgttaatgcatactactctattcaattaatgtaacaagtgtgtcactaagtttagatgtttcttaaaaggaaggtgtgtgacatgaacatatagaggggaacagcatacactggggcttatcagagggtgatgagtgggaggagagagagaattagaaaaaataactagtaggtactaggcttaatgcctaggtgatgaaataatctgtacaacaaatctccatgacacaaatttacctatgtaacagacctgcacaagtactcctgaacttaaaagttaaa

SEQ ID NO: 534622 - DNA, 748 bp, Homo sapiens
catgaaggtcgaacggttgcatgtattagcggcgtatcaagatctatgcccgggacacggagaaggcagcttcactgactcagagatcgatcggtgcaatggtgatctccgatggtgatctctgagagtcgcgatacactgcgagttcgtggtttctcttgtactcatagtacggatgtcgcgtccgggcaatgcaggtacaactggaactggtccgtctacatgaagggaaggagagactgcgggacatgtgcgcggaggacattctatcaagataataggacatcgcgcgtctgaggcagtatcaatagttccatgatgggcgatgtatactggggtgaatttctcatttggattgatataactggggtcgaagagtgaagtcgagaaaaccatgataagtaaatgaagaaggatcaatgggagagaccacaagcgttatcaggggacgtgcttaaagtgaaagcaaagatgagtgtataagggacgcttttaggactgacttgtggactggtctcgtgtagtctgaatggcaagctagcagaggggagacattcttagagggacatagaggatttgtcgacagccttgtgggaaaacgattctcgaaggcatgccactgtgaagctttgcgtgggaatataacagcataaagagttgtgtaggaattagactttatttagaactagaagggatttgtgcgactaactgtgatttcccaaattgaaggccaagccctaataaggca

SEQ ID NO: 534623 - DNA, 159 bp, Homo sapiens
ccgacagatgattacccagaaaaaaaaaaaagagataatctatacctcataaattcactaaaactgggactatctgaccggacttggcagccttggggcggaaggacgtagaaaatatttttaaactggcctaccttatattccatacatcatatattg

SEQ ID NO: 534624 - DNA, 976 bp, Homo sapiens
  misc_feature (38)..(38): n is a, c, g, or t
  misc_feature (88)..(88): n is a, c, g, or t
  misc_feature (90)..(90): n is a, c, g, or t
  misc_feature (110)..(110): n is a, c, g, or t
  misc_feature (116)..(116): n is a, c, g, or t
  misc_feature (119)..(119): n is a, c, g, or t
  misc_feature (122)..(123): n is a, c, g, or t
  misc_feature (126)..(126): n is a, c, g, or t
  misc_feature (146)..(146): n is a, c, g, or t
  misc_feature (250)..(250): n is a, c, g, or t
  misc_feature (628)..(628): n is a, c, g, or t
  misc_feature (683)..(683): n is a, c, g, or t
  misc_feature (729)..(729): n is a, c, g, or t
  misc_feature (823)..(823): n is a, c, g, or t
  misc_feature (863)..(863): n is a, c, g, or t
  misc_feature (896)..(898): n is a, c, g, or t
  misc_feature (913)..(913): n is a, c, g, or t
  misc_feature (917)..(917): n is a, c, g, or t
  misc_feature (926)..(926): n is a, c, g, or t
  misc_feature (944)..(944): n is a, c, g, or t
ttccccggcgccttcgccgccgccgcccgcgcccgggnagcgcgcccttctctgcccgcggatcggtgcgctcggccggagggccgcngnggaaggaacccagagaaggngacgcnggncgnnggngctcggggcttgcccgcggngagggaggctgcgcccaggtccccggccccgcgccgcgcgcccagccgcgccatgggggaggcgcccagccccgcgcccgcgctctgggactgggactacctgngaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcatgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgcccttggccctgccgcntgagcctgggcccgtgctgggctctgtgggttgctgtcccgaaggcttcagccancatccgggggccacagcggaggctgctagcgagccttgctgcaggnaaatactgagatcctcggctacctgctggggtagcgttgctgccttggctcctgggcttctcggatccccctctctccagaatttgccgggggnaaacatttcctccatcacctgttgaccggctcctgtcggncctggtgcctctctatgctcggcattgtggccnnngacggaccctgagtnctgntgcggccancctggttctgactcctcnggcgtgcggactggactcgctatattttcttt

SEQ ID NO: 534625 - DNA, 912 bp, Homo sapiens
  misc_feature (38)..(38): n is a, c, g, or t
  misc_feature (88)..(88): n is a, c, g, or t
  misc_feature (90)..(90): n is a, c, g, or t
  misc_feature (110)..(110): n is a, c, g, or t
  misc_feature (116)..(116): n is a, c, g, or t
  misc_feature (119)..(119): n is a, c, g, or t
  misc_feature (122)..(123): n is a, c, g, or t
  misc_feature (126)..(126): n is a, c, g, or t
  misc_feature (146)..(146): n is a, c, g, or t
  misc_feature (250)..(250): n is a, c, g, or t
  misc_feature (564)..(564): n is a, c, g, or t
  misc_feature (619)..(619): n is a, c, g, or t
  misc_feature (665)..(665): n is a, c, g, or t
  misc_feature (759)..(759): n is a, c, g, or t
  misc_feature (799)..(799): n is a, c, g, or t
  misc_feature (832)..(834): n is a, c, g, or t
  misc_feature (849)..(849): n is a, c, g, or t
  misc_feature (853)..(853): n is a, c, g, or t
  misc_feature (862)..(862): n is a, c, g, or t
  misc_feature (880)..(880): n is a, c, g, or t
ttccccggcgccttcgccgccgccgcccgcgcccgggnagcgcgcccttctctgcccgcggatcggtgcgctcggccggagggccgcngnggaaggaacccagagaaggngacgcnggncgnnggngctcggggcttgcccgcggngagggaggctgcgcccaggtccccggccccgcgccgcgcgcccagccgcgccatgggggaggcgcccagccccgcgcccgcgctctgggactgggactacctgngaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcatgctgcctcctgaccagtctgtgtgacaccgtcggggctcttctggccagacagctcacaatccagtctgtggatccaaattcaagtctaattcagatcgggaagcccgagagaggaagaggaggcggcagctcagggccagtgtgtttgcccttggccctgccgcntgagcctgggcccgtgctgggctctgtgggttgctgtcccgaaggcttcagccancatccgggggccacagcggaggctgctagcgagccttgctgcaggnaaatactgagatcctcggctacctgctggggtagcgttgctgccttggctcctgggcttctcggatccccctctctccagaatttgccgggggnaaacatttcctccatcacctgttgaccggctcctgtcggncctggtgcctctctatgctcggcattgtggccnnngacggaccctgagtnctgntgcggccancctggttctgactcctcnggcgtgcggactggactcgctatattttcttt

SEQ ID NO: 534626 - DNA, 848 bp, Homo sapiens
taataaacttgatttctctaggagcactcctttggttagagggatgcaagaaggagaggtgaaggtggcgtgtggtggctcatgcctgtaatcccagcactttggggaggcgaggcaggcggatcacttgaggccagcagtttcgagaccagaccatggccaatcatgatgaaaccccagtctctacttaaatagatacaaaaaattagctgggcatggtggcaggcacctgtaatcccagttacttgggaggctgaggcaggagaattgcttgaagccaggaggtggaggttgcatgtgagctgagattgtgtccacatgcacttcagctctgggcgatcagagtgagctctgtcatacaggaaaggctaaaatccggaccctggtagctctgtgggcccgtgattgcatggccccatcgcctgtgtgatcgagggatgagtcagacttggggagccacttggtcgatgcctgcatggctggtacatcaggaggttgagaaagagcccttgaagagttgtgaagcactgagcagatactaagtgttggttaattttgtagaaattaactttcccatctggccgtttatctccaaagttggtcattgttgctccacgcagaactgcagtccggttttcttatggtgactttgacaatgcaaagtgcaagagataggaagagggccttcccgagtcccagatatcaccatgccttgggggaccatgttcaagcagtaaacatcgcgatgtagttcagttcatctggtgtcttcgggagtgactttttgaaggcagatgatctgcaggttgagtacaagtgttcgtaatttgtacatgatggtgtgtgtg

SEQ ID NO: 534627 - DNA, 954 bp, Homo sapiens
agcgggttgccatagcgacgtgcacgcagtagccaggcctgacccgcaggtcccttgctggcgggaggaaggaggcggcaccatgagccacgcagtaactatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctccagaatatgtagtatgtcaggactcaatccctgagctcttgaccctggctacgcttacttggggtgagttggtaaatctcctgactattggcagatgacgatgctgataaccacgcatgctgttcaaatggcccatgtacaggcaattgtggtttacagtgttgctatataaagtgtcttagtacagcaacttcatagactcataatttttctgatacttctggtcaaataaagatactatctttttattgtg

SEQ ID NO: 534628 - DNA, 532 bp, Homo sapiens
atttgttaaaattaaggtaattttcaattttttaaaattataactcatgcttcactgaatactttggataaaaagctttctgaaggataaatgtgttatatccatgcaatgggacattattcagccattaaaaggaatgaagtactgatacataccacaacatggatcaaccttgaacatattatgctaagtgaaagaagccaattacaaaaggccacatatttcctacacggctgatggaaacgtaaaactatgcagccactttagaaaacagactagcagttctgcaaaatattaaacacagagttaccatacaacccagcaactctactcctaggtatatatacccaagataaattaaaacaaatccatgcaaaaacttgtacatgaatgtccatatttatagcagcattattcataactgaaatgtgcaaacaacccaacgtccattcactgataaatggacaaataaaatactgtataagcattcaacagaataatattcagacataaaagagaatgatgggcctgg

SEQ ID NO: 534629 - DNA, 120 bp, Homo sapiens
aagatccttagacagcggaccccgttctcagagaggttcagcacagaggagaagagcagctcacagccaagcagctgttgttctgaccccagcaagccggggggggggccggctgtctga

SEQ ID NO: 534630 - DNA, 623 bp, Homo sapiens
cacattgtctgctgagcattgggctaagctggcttcagaactctacgaatgatagagagcgccatgaccagcacagcagctaggggataggatagtaaggctgccacagttagtaagatccgcagagcgatagcgatacttgtcagcttcattaacagtctgatctgatgcagggaatatatgctctgcaatctgaatttccgcaatggcagtagctccagtgactgcaatcgcgattccaaatccgtcaattccttgctgactcactggggtattacagtctctatctttaccatatttgtctcgcaagccaacagtgcatctaaagactccaccaacagcaacatcttcaccaaatattactgcagtaggatcctgagttagcccgtactaccggggctgcggatctggctggaaagtagcatgagccacctgccgcctgtgggccgcatcctcgacagtctcggcggggtgcaaaaagcagcgcgccagctccgcgccaggaagccgacgccagtgcccctcagcccctgccgccctgagcctgagtagccagccggcagccgccgctacaaccgccatcgccgctcacctgcgggattctcaggctatgcagccgcacg

SEQ ID NO: 534631 - DNA, 94 bp, Homo sapiens
gttcaatgacggtgggtacactggtgttcttttattgttactctttacacacaaagaacagataggtcctgaagggcccttctgtcgtcttctc

SEQ ID NO: 534632 - DNA, 295 bp, Homo sapiens
  misc_feature (44)..(44): n is a, c, g, or t
  misc_feature (76)..(76): n is a, c, g, or t
  misc_feature (83)..(83): n is a, c, g, or t
  misc_feature (107)..(109): n is a, c, g, or t
  misc_feature (122)..(122): n is a, c, g, or t
  misc_feature (140)..(140): n is a, c, g, or t
  misc_feature (143)..(143): n is a, c, g, or t
  misc_feature (150)..(150): n is a, c, g, or t
  misc_feature (156)..(156): n is a, c, g, or t
  misc_feature (165)..(166): n is a, c, g, or t
  misc_feature (171)..(171): n is a, c, g, or t
  misc_feature (182)..(182): n is a, c, g, or t
  misc_feature (191)..(192): n is a, c, g, or t
  misc_feature (195)..(195): n is a, c, g, or t
  misc_feature (227)..(227): n is a, c, g, or t
  misc_feature (288)..(289): n is a, c, g, or t
ttttggtcaacaccctgcttactgcgcacggccaatcctatganaactcagcatcccagctcatctgagcagatcnggaagtnatttctgcagctcaggattttttnnntaagctacattgnaaaatataggtttatttnttnttcaggnttttcntttatattnnttttntgcacaaaggnggaggattnntcnacttactcatatcgaggccagatttttaaagncagctaaggcagcatcagctgtgcgggatttaaagcctatagctcagctgaaaaaaaaggnngggggc

SEQ ID NO: 534633 - DNA, 513 bp, Homo sapiens
cagctcttaccccttttggccgtctttgctgctgctttttcattaggaagttcaatgaaagcttttcctttcatacgaccttctttcatcaaacgtatatcaaacatgatccgctgtgtttctgatgaaaagtcaacatatcttccaaaaatatatttaaggtccttttcttgaacatgtttagctaaattctttacataaattctacagtttggttcacccggttcataacttctgaaaactgaaagtgtttccatttcttctctagaaattctgcccttttccaattcccttctagaaatacattctgaaggcatttcatcagagacttctttaatctcctctgtgatgtccaaattaggtttggggaagattcttccaaatcctatattggatgcatcaacttcagtagcaggtcaatcatgattcctttcctcacaattttggatccttttctaaatctttcttaaatgcaagctggcatgttcggttgatatatggaattcaaattct

SEQ ID NO: 534634 - DNA, 353 bp, Homo sapiens
atgtaaatgagagggtcttgttcaggtctcggagagcacatgaatgagggggtcagaagtgtcccggggctgagaatagagggagagcccacagaccactatttccttgtcagaagtcactgccaatcagcaccgaatggcggtgcctgggttgcaggcaaattgcacagctctttggaggtgaagtccatgggcaaggctagctggtgagtcaagcctcggagcagtggccccaggctggggagggctagttggccactggcaaagcccctctgccaggcttctctgctcaactgtaggtgcttccttgggcatttgatccccatggcaaaccacggaggcaggatatccat

SEQ ID NO: 534635 - DNA, 690 bp, Homo sapiens
gcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcacttgtacaagataaaaattcctataaattgattacacacttaacttatattaatactatataccaactcaactatacactctaaaataattaataatataaatcttatctttattttaccacactttgttttaaaacattataaacaccatttcccattatataaatcaatactaaaaaaaacatactccacagtaacatatatttattaaacacattcataactaaaattaaataaattatctttatttcattaattgtaatatcatttaacatattaatttacacttctgattttcattatataaagtcttactcataccatttcacaaacattataccttagattccaaagcctttaaataaaaatttaataatataaactgcttaaaaaaataaat

SEQ ID NO: 534636 - DNA, 112 bp, Homo sapiens
gggggttgggttgggttggggggggggggtttttaaccgggaacccccgcaaatttttggtttttttttgggttaaaaaaaaaaaaaaggggttttttttttttccccccca

SEQ ID NO: 534637 - DNA, 103 bp, Homo sapiens
acagggcgtacgaatcctcctcctcctggcgaatagtctactcctgtttgagccaaccaacttcatccacaacaatgggtccaccttacgacgcaggtgatca

SEQ ID NO: 534638 - DNA, 396 bp, Homo sapiens
acgtgttcattggggtagggtttactagacgccgggaagaggctcatcggtggcagagcgtggtatctccgggtgctagggttccaggcacagaccaggcttcctggcgtcacggagtgtcctgattgaagctcacggatagctggggtgagcaggaatgagtcagtgtggatggaatgagccttcctcaaaaacccccaccaccgctcttagtaacccggaaaatgctctgaaatagttgacatatacaaagtctagggcatatggggagaaaaacgttctttttttggccagatttccagcatgaagcccaagggaaatgtccacgggctcagcacagtggtctagcatctcaaagcagtgcttggcctgtgtggaggccatggctttcccatc

SEQ ID NO: 534639 - DNA, 254 bp, Homo sapiens
gaggaaagcagaccttgacctctacaagagggcgggagaactcactgagtgatgaggtggaactgtgtgatcaccatatatgcatgaatccactgccagtacaatgatcccagactggttcttgaacatgacagaagtgatgtaaatggatggaaaatacagccatggtcctatgccaattggtcttggacaacaatgctcctgtgaatgaccctggatgctgactgaatgaagattctgggcccaatagatgg

SEQ ID NO: 534640 - DNA, 155 bp, Homo sapiens
attacaatttctttggataaaagacttattagatctgcctgtattatctgttgtctttattacagaatcactatgtctagttggtctgtgtgccacatactgacaaaactttaaacagtacttgatgccagctctctactctgtatgggggatct

SEQ ID NO: 534641 - DNA, 704 bp, Homo sapiens
gggattaaaaagtgttactgagcatttttagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccacaaaaccacacaaactaaaaactagaccaacctaacccaaccacacccaaattaaacctacattgcccaatccccccaatccagattcaaaccacaaaacagggtcctccaactcaacaactccccacactgaaaaaaccttgacatacccaaactaaacccccttgcaccaaaaccccatttcgccagtcgccaaaatcccaaaaagcccccaacccaccgcctttccaaaaatttggccaacctaaaggccaattgaaaacttaaccgcacaaaatttccaaaaaacaccctttaaattttggttaaacaacttatttcttaaaccaaaaagcccaaaaacccaaaaacccctaaaaccccaaagtataacccacgaaaaagctggaacattgatccatttggaaccaaaacccccttattaaaaaactgcacctcaccccaaaaggccaaaaaaccgctaaaggcgcaataaccaattactgaacaatcccctaaccaaactttttgggaccaagtcccctaaaagcccaaaatgaaaacctaaagggccacctataacaactgcgcg

SEQ ID NO: 534642 - DNA, 828 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacagaaaaaagacccccaaaactatttagtaatattggctgatctaggatataagttttttcaag

SEQ ID NO: 534643 - DNA, 1200 bp, Homo sapiens
  misc_feature (12)..(12): n is a, c, g, or t
  misc_feature (24)..(24): n is a, c, g, or t
  misc_feature (889)..(889): n is a, c, g, or t
  misc_feature (1200)..(1200): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataccaaaaaaaaaacaaaaaacaagaaacaaaaaaacactctgtgtggggcgcgcgccctgaggccctccagagaaaggctctttcagagacaccctctgcgcggttggggccgcgcgggggcgccgncgagttggtgtcaggtgtacacaagtgggcccaacgagcggtgtgttcccataaggagagagactccgggcgccaacgagactcaagtgggcgcttgggtctttcctcccccctattataatagagaagcgccgcgcggcggggcaccaccgagagaggggggtctcttggtggacacaattctccgagagagtgggccgactcccgagggggggcccactcgacgggggccctttatctaccgcgggggggtccccgaggggaggaactctccgaagattcaaatttgtgccgcgctcccggggtggtan

SEQ ID NO: 534644 - DNA, 233 bp, Homo sapiens
actagttgctcctcttcagtagcgggactacaggtgccgcaccacgccaggcattttttgcactttagtagagacgggttcaccatgtttgcaggatggtctcgatctcttgacctcgtgatcatccatctcagcttcccaaagtgctgcgattacaggcatgagccacccacgccagccatgccatttcttaagatccaggtgctcccctccccgggcggagaaggacctcc

SEQ ID NO: 534645 - DNA, 1058 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaaaaaaaaaaaaaaaaaaaaagagttgaaaaagacaaacgcgacagtcaaactaaaaaaagactgttgtccggcgcgccagtggaccccaacaaaaaggtctttataaacccattggcggggggggccgggaccccaaatgatatgcgcacagaggccaagcggcaccagggaaacccggccacgaacaagggctgtgtttccaccccaaaaaaaacccccgggcaacccaccgtcgtaaccaccccaagagatcgaggccacggcaccacaacaggccaggagcgagtaat

SEQ ID NO: 534646 - DNA, 921 bp, Homo sapiens
taggctaggtacgaggcctgggtgttaattcggccgatggggacctcagtgcctgtgatgctccgggccccgcgggcggtggctggtgtgcgtggagccgttgggctgagtctgtgtgatcggggacgtcgcccgatgagcgtgggacgagtgaggtgtcgggcgctgggttcgagcccggtgtctgtgtgctggcgtgaacttgttcgccaacgacgtgcagcttcctgtgatgcttgttcaatgctggaatgatgtgatgtgatgtggatgcatgctggcagctgtgcatggatgtgatgcctgcccccgtggtccgcatgctgaccctgaccatgtctgtgcctgccgcctgcttggccccgtgtgtgatcctgaatgatggaatgtgtgctggtcctgtggctccacacttatgcttctgtgtgtgcaaactgcagatgtgctgggaacaaactagccctcaagacggtgaatagtatgccaatgaagcatgaagactggagtgatgagtgtattaacaagtaaatggttgactgcgttggggccaatgtacatatgcatgaatgtgaaaaatgtacaaatgctcaccagtgctgagtgacgattgataaaactcgtgcccctggtgaaatgacgcccctcccccacctgcccatggcctgggactctctgcgatgtacataactatttaatgcagctggcagcggcgacagccttccctgagaggacttaaaagcgaaggaaaccgagatgcttcccgcaggccgtgacgatcctccaggactctttatttaccttgagcactttgcctcgtgagacttcttgacagtgtttctgtcccccttctacctcctcatctctctggtcttctgtttctttttaacctctcctccctagctactttggcagtaggactgt

SEQ ID NO: 534647 - DNA, 150 bp, Homo sapiens
gtgtcaagtgaatagtgcaattttagcgttggcacagctgcagagtccaccccggatgtaagcctcttatgcaacattgaagacactcagggtattgttttagtctcagcgggatgtcaatgtaaaacctacgcctgaaatcttgttagg

SEQ ID NO: 534648 - DNA, 388 bp, Homo sapiens
agaaaatgaggccaatagcttgtgaggatttttccccagtttgctgcccgatgtgtaaaaaaaagttttttctgtttccattcccaaacatttttcaatactggtatgaaatgagaatggatcccagctggagaatgaatgagtaaaggagctgagttcggattcagagtcccagaggtaacaaaggaagtaaagcccctgcatatgggaagctgatatttgttttccaaaaggaggaaagattttgaaagggtaggggtttaaccaaatatggcctttaactgtagctctagggtttactgtttgtgtgaacttgagcagcttactcaacttctttgaaccccaatttcctcatgtaaaaataaaaattgctgttgttagggtttta

SEQ ID NO: 534649 - DNA, 1530 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaccaattgctcaaaaaaacaacaacacaaaaacacaaaaacaaacacacactgtgtcgggccggccctccggccccgcgcggacaagagctctttcagcagaccctcgtgcggttgggcgcccggggcccaatagggtgcaaagcgagaacaagagggccacaacaggcgtgatcacccaaggagagaaaccgcggggaacaggaaaagaagagcgccggcgagattcttccaccaacgccaaacaaaccgccccaggagggcacacacaccgacggcgtacacagagacacaaaatcccccaagaagtggagcgttcaaagggaggggaaaaacaacagccggcggcacactacgaccacaagagagggcacccaaagcgagagaacacccacaagcaaacaaagtcataaaaacgcccacgacgccaacgcgggcaaacagtcgggagcagcgggacagcgacgtgggaggatggaggagacaagcggggaggggggagggaggtggtagacgggagaggggggaggggggacgacagggaagacgggactaagcggagaagaggaaagtctagcagaacggaccggcagagggacggagcgagtcaagtgcgcgcgacggacgcgcaaggacgcagactggagacgataagcgagcgagggaggaggggcatcggggagggtcgcgggacgggaagcgaaagggggatgtcaggcctagatgacgagcgaaaacagagcgagcgtaaggggaaacgaagcggcg

SEQ ID NO: 534650 - DNA, 387 bp, Homo sapiens
  misc_feature (6)..(6): n is a, c, g, or t
  misc_feature (15)..(15): n is a, c, g, or t
  misc_feature (33)..(33): n is a, c, g, or t
  misc_feature (355)..(355): n is a, c, g, or t
cttttncccttaatnattaccccaaacaatacngtataacaacctatttatatagccccttatattgtatttggtattataaataatcctagaggtgatttaaagaatacaggaggaggcccaggcacggtggctatgccctgtaatccctgcactttgggaggccgaggtgggtagatcacgagatcaggagatcaaaaccatccctggctaacacagtgaaaccccatctctactaaaaattcaaaaatttagccagacatggtggcactcgcctgtagtcccagctacccaggaggctgaggcaggagaatcgcttgaaggaagcggaggttgcagtgagctgagattgtancgctgcactccagtctgggcaacagagcgaga

SEQ ID NO: 534651 - DNA, 347 bp, Homo sapiens
gcattttgtagatgtgggcattatcttgtggtcaataaaaagacactgaagaggccaggcatgatggctcatgcctgtaatctcagcactttgggaggctgaagtgggaggattgcttgagcccacaagtttgagagcagcctaagcaacatggtgagaccctgtgtctacaaaaaataccaaaaaagttggccaggggtgctggcacatgcctgtagtcccagagactctggaggccgaggcaggaggatcgcttgggcctgggaggccaaggctgcagtgagtcatgatggcaccaccacactccagcttggacagcagagtgagaccctgtttaaaaaaaaaaa

SEQ ID NO: 534652 - DNA, 1345 bp, Homo sapiens
  misc_feature (12)..(12): n is a, c, g, or t
  misc_feature (24)..(24): n is a, c, g, or t
  misc_feature (1345)..(1345): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaaaaaaaaaaaaaaaaaaaaaaaaaaaaaaaaaaaaaaaaaaaaaaaaaaaaaaaaaaaagagaggggggggcgcgccgcacaaaaattctctcccccggggggcgcccccattggcgcgccgcgccccccctttttttgaacagaaggggcgcccccaaaagagaaggaggcaagcttattatgagcacagacgaagcgaagcgcggcgccccggcactattaaacaacagacgcacgaggagcggggaaataacagcctgcggcctcagcgggagcacaacattggggagggagaagcgaccccctaagacgggcggggggggcggagcagaacaacatgatggggccaaacacatcctcctctctgcgcgggtgttttttttgacgacccctccagaggagcggacataatattaaacacctttcaagcagggcttagtataaccgcggggggtacaacacaccacgcgggcaaatataaatgctgcgcggcgcggctcgggaaaaatttttcgctggccgcacggaggagcataatactttcaggaacaaaaattttttcccacgaggggacggcgtcgaagtagn

SEQ ID NO: 534653 - DNA, 906 bp, Homo sapiens
  misc_feature (12)..(12): n is a, c, g, or t
  misc_feature (24)..(24): n is a, c, g, or t
  misc_feature (768)..(768): n is a, c, g, or t
  misc_feature (785)..(785): n is a, c, g, or t
  misc_feature (790)..(790): n is a, c, g, or t
  misc_feature (792)..(793): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaanaaaaaaaaaacacaaanaaaanannaacaacaacacaaacaccacacaacacacaacacaacaaaagaaacacaccaaaaacccaccctacaacaaacccgcggcgcctccttctcgggggggcgaccacacagatgg

SEQ ID NO: 534654 - DNA, 249 bp, Homo sapiens
tctgctcaggtcaagagattttcctgctcagctcccgagtagccaggattacaggcaagtgccaccatgcccagctaatatttgtatttttagtagagatggggtttcgtcatgttgcccaggctggttttgaactcttgagctcaggcaatccaccaatctcaggctcccaaagtgttgggattacaggcgtgagccaatgcccctggccaaggctccttttaatccttgtaaccgagaggaccattg

SEQ ID NO: 534655 - DNA, 900 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaacaaacaaaaaacaaagaaaaaaaaaaccgggggtttattgggggggggagacagggtaagcaaggcctgggcaaggggtccggaccgtttggcaaggggaatatgggccaaagggggaaaaagaaacggtac

SEQ ID NO: 534656 - DNA, 820 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaacggatgcgcgccgatttgccctgcccctctctccatcccgcagtcacaattcgaactccatctc

SEQ ID NO: 534657 - DNA, 898 bp, Homo sapiens
  misc_feature (13)..(13): n is a, c, g, or t
  misc_feature (16)..(16): n is a, c, g, or t
  misc_feature (786)..(786): n is a, c, g, or t
ggcagagatcgtncancagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534658 - DNA, 1401 bp, Homo sapiens
  misc_feature (92)..(92): n is a, c, g, or t
  misc_feature (512)..(512): n is a, c, g, or t
  misc_feature (1289)..(1289): n is a, c, g, or t
cacacttattcgacgtgtcacagtcaggaatggcagaccagcaagaagatcagccatagctgacggtggacaactcggaataagtttgactngtgttttatcttaagccaccagatcattccttctgtagctcaggagagcacccctccaccccatttgctcgcagtatcctagaatctttgtgctctcgctgcagttccctttgggttccatgttttttttgttatttagtttttatttcataatcataaacccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatcccataaagctcatgttaaccagcatctgcgcacggtaggtaagcaatttttctcgatggtacacagtgactaaaagaacagctgtttacccctgatcgtgcagcacgtgctttgccgtgntttcccctttaagcacaattctcttctggcccttcatgctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534659 - DNA, 182 bp, Homo sapiens
tcggatacaatgaaaaggatggcacagcttctggatcaagtcggttgatgagtccgaagccatttctctaaatctagtagttaacaagaccatctttgctaaaggtagacagaattagcaggaatttatcaacttccagagacccaaggaatccaaataattttattaaatgactggtctca

SEQ ID NO: 534660 - DNA, 119 bp, Homo sapiens
ggtgtgctctgatatagaagcgtagacatgcagctaaagccagtgcctggaaaactatctttgcagagcatctgtggacaggtgttctggaacatgctctgggagacatggttgtatcg

SEQ ID NO: 534661 - DNA, 151 bp, Homo sapiens
ctcaacgctttatacttctccatcaaatttatcccagtaggactatttgtcacctgatctcttatagaatagcttgatatataaaatcagatcctaacattgaactcgatttttcgacatatttacgtatttggctcaccagagtattaat

SEQ ID NO: 534662 - DNA, 454 bp, Homo sapiens
  misc_feature (16)..(16): n is a, c, g, or t
  misc_feature (79)..(79): n is a, c, g, or t
  misc_feature (94)..(94): n is a, c, g, or t
  misc_feature (419)..(419): n is a, c, g, or t
  misc_feature (439)..(439): n is a, c, g, or t
gggaccgcgggggacngggagcgagtatgtccgctctgactcggctggcgtctttcgctcgcgttggaggccgcttatnagaagcggctgccanggactgctggagatggtggagtccgtcatgccggtggtggtgtgcacattgaagcccggtatagacagttcccccagctgaccagattcccaggtgttccagagcgagttcttcagcggactcatgtggttctggattctctggcgcttttggcatgactcagaagaggtgctgggtcactttccgtatcctgatcttcccagtggacagatgaagaattaggtatccctcctgatgatgaagactgaaggtgtagactcagcctcactctgtacaagagccaggtgagaatttcaaggattatcgacttcatattgcacattanagttacaaattaaagtggcntggtcaagaatgaga

SEQ ID NO: 534663 - DNA, 377 bp, Homo sapiens
atagcaaatgttttatatccgggctggtgtggtaaaaacctgagtctgtccaccgctaggaataactatatctgtatgtataatactgctcctacaggttcttctgacttctataaaagatgaagtcatggaattaggacaggaacaggaaaaactaatgtcattatctcataaagcctgatggtttcaaatattcatataaatcaagcatcctgatacctacgttgagaaaaaatgatctctgaaatagagctgggcttttgaatctcctacaagacctgctgggtggaatgttcaacctaacagggcctctgcaggactttcctccagctttcctatttctgggcactctctggtttgggtactacgctttggca

SEQ ID NO: 534664 - DNA, 361 bp, Homo sapiens
cgagtctcctcttcaatagtgcgtagggggcaggacgcatggtagtgtggggggcagcctggtaacatctccgcttaataggcgtggttcagcagacgatactagggactcgctggcagaagccccagcctgatcgttcgaattgtactttccttgccaggcaaggctgttggccagggctcgcttgacatactcctcctgcgcagccttcaggttctccttcttcccgctcccaggccttcagggcagagggcctgcagggctcggccgtaggagaaggtcagcgcccagggtttcagcagtgggcacttgttaatggcattgaggttgatggacgcctcctcctcactctggcctccag

SEQ ID NO: 534665 - DNA, 429 bp, Homo sapiens
tacagcctagcatttgggtggactagatgtgtcagagcctgcacgagtcagtcctgatggtataaagagaaccattgaagccaggatactcattctatccagggtgacgagaaatgagacagggccctatcaacgtgaaatacgggaccgatatggtggcatccgaagtagcccagtcaccctgaatgtccgctatggtccaggagctccccagaatttagccttgattcacctattaccggacaggagagacccctcgatcttgtgctggtttgctggaatcttagcccaccgggagagtatgctgggacaactagtgggaagtttcggctatcaggacaaaagctcggtatcccccagattactacagatcatagcgggctctatgcttgctgctgtacgtaactcagccactggggaggctaggat

SEQ ID NO: 534666 - DNA, 302 bp, Homo sapiens
tagtggagttggatcttgtaactctcttttctcactttcttcccctttctctaacacgcctttcccatcctgctagtagacttcttgattgtcagtctgtgatcacatccagtgattagtttaggtttctagttccctttctagtgatccatgaaagggcatttatttgaccatgccacactagacagtagacagagaagctgatagattcaagaggcagattttatacgtagagtagtctaaatgatttcttttatcgctatgtattatactgtgattctcttttacttaatagtctatat

SEQ ID NO: 534667 - DNA, 584 bp, Homo sapiens
aatcccccaaattcacaaccggggcccagtattagctgagttctatgagtagctctatctaattattgaactccaaaaaggatatggtagtcctcacgttttaattagcatcatgagaaatgtatatgggcccatggagtttgagcctggcatctgccgtaaggacagtgtgggactgagtcagggcctgtgctgacactgggtggtgtcagaaataaaatgttagacaatgagttactgttatagaattgcattgcttacagtgcactgcaaatttggtgccttaaaaaagatactggggcctgacctggaataaaactctggatgtctgggaatgggacgctctgctctcctgtacacaggctgtcacactgcccattgtcctgtgatttcagttctcccagggtgagagaggactgaaaaattagagaataggagctctggccgggtgccgtggctcacgcctgtaatcctagcactttgggaggccgaggcgggtggattgcctggactcaggagttcaagaccagcctgggcaacgtgggaaaaccccgttctttgcaaaaattgtgttgtagaattaa

SEQ ID NO: 534668 - DNA, 1289 bp, Homo sapiens
tcactggacaaagacacttttatttctttttaatggacatttaaacacaagctgtgcatacaggggaaaaaacatgtgattaaagaggaggcaccaaatttgtgagacaaattagtcggatttagaaattaaagcattctcattttggagttagagagcaggggaaggtggttctataaagtgggtgactcgtgggatttaggccctcaaaaacccttttggggttttcgtgcccgtgcccacccttctgtggaaaagggtgggcacgtggatttagttataacagaacaacacgtttacttgagcgagtctcaactgtgtggactcctcgcggggcttgtggggttttaaacaagacaccaccacgtgtgttccccacatatgagcgtttatagagagaatcaagagagttgtggcccgtggtctcacacgtgtgagagccagtgtttcacgtgacacgagagagggggcgcgtatagtgggggggtagtatatttttctcgtggtgataggaaatatagcgcgatgtgtgtcacataaaagcgcgagggcccttttgtgaaatatttacaatttcttttataacaaaagccaaaaatttatttagaaaaggtttatacagatttttataatctcgacacattttgggatagcggggggtatcacaataggcgatacaatctttactaccagagaaatcttgtgcgtgtgatatagagcgctctacaaagcgtgggtttcactataacctttctgtgcctccttgtgagaaagagaaagattggggggagacccagggggggcgtggggaggttcccaaaaacactctgtggttcacattgtggctgaatcctgcgaacgtggtccttggcggtctaaagaacctgtggctgcggaaacgacatttcattttcttaagaaccttctacactaacctaaaggggcaattaaaaacccccaaacctttttattcccttaacatttgcatcctaacccaattttcgtgggcaaccacgagagataggagactgtgtgaacaagggccaagctgtgtgaggttcaccacttgtggcgccagtgcgaaaaacttctatattggcgccctgattcacactgtgtttcccacaggtcaattataatccctagtggtgtaaaacaagcggtggtgtatcgcggcccaaagagcgcttttataaaataagcgctacattataatagacacaataaacatagagaagaaaccacagcagataaccacataccattaacaccactatcactctatcagc

SEQ ID NO: 534669 - DNA, 116 bp, Homo sapiens
aaattaaaaaaatcttttcttttctttgttaatataaaacaatataatcacaataccagtaatatggaactctacagtttattgcctactggttactgcaggtatcaattttcctc

SEQ ID NO: 534670 - DNA, 380 bp, Homo sapiens
aatatgggggccctaatgggttccgccccccccaagtttctcgatagtgaggagaatgagaagtagcccacagctcccagaacctttttttcctttttggcctaacttttccagttaggatttagaactttgcctttttttttttttttttttttttttgagatgggttctccctatattgtccagggtagagtgcagtggctattcccagatgcgaacatagtacactgcagcctccaactcctagcctcaagtgatcctcctgtttcaacctcccaagtaggattacaagcatgcgccgacgatgcccagaatccagaactttgtttatccctctccccaacaacctaaatgtgaaaacagaataaacttcacccaga

SEQ ID NO: 534671 - DNA, 225 bp, Homo sapiens
  misc_feature (46)..(46): n is a, c, g, or t
  misc_feature (198)..(198): n is a, c, g, or t
agcatctcatggtgctgggctcttgtggtctgactcctgtcactcntgatttggtagttcctttagacttggtcctgatcctttttctcttctcgtgctaatttttttccatggctttgaatatatacttattgactccatatttagcaccaactcaatcctctcttctcaactcagtccaataccaaatgctttcanaggcattccttacttaaatgccaggta

SEQ ID NO: 534672 - DNA, 888 bp, Homo sapiens
acctggccagtgaccctctctcctcgttgggctggtcgtcctcccccccctcgcctctgttaattatacggcgtccccgcccctgtttctgtggtaaacaccgcccaccttatatacactgtggccgtgcccccctttggcaccagaacgttcccccgtggcccaaagtgggctgagcccccccccaatgggggggatggcccccctcctcgcccctcgatacccagctggtctgcctcacacaacgtgtgtcctccacacggacgcatcgtcctgacccaatatgctggtcatctccacatggggcactcttcaccacaaatggtgttacttcccccctacgtcatggtaagccttgtgtaggaccccccgccgtcaggagccacacacatacccgcgggcgcaacccaccactgccggggacccccccctatggccccacttgtatcgccgcgccctgacaatggtcagcgccagccccgttacgacccccaccgcccagcagactcagggcccgacagcgtcccagtgctgggcaccccaccaggcgcaaagtgtgcgcgggcggcacacagcagcaagaccccacatactgagcagtgaacaacaacacacaacagcgcctgctgacacaagacaccgcccccaacgagggacctcagacacatactatcacggatgccgcgagccgaacaatggggcaaccaccggggcccactcgcacctaggaggcacacctcctgaacaggcccccgcacccacggcacccaacgcaggcacctatgactgaaccgcgaacaccggagaccgcactcgtggcaccaagactccagagcccgcaaaaccatcttgaatatacaaaggccatccgacccccccacatgacaa

SEQ ID NO: 534673 - DNA, 358 bp, Homo sapiens
atgtgatcccacacacttaaccagtcccgaactgtgactgacttaagcaacccatatacaaacgtaaactcagcgccggtgatgtacactcctgctggtacaccactacctgcaccagaaacctgtgaaggtacgaaacagctagtgtaacctgtattaatagtaaagcgtagttcaataactaacctgctatattggatcgaatgtaacagatgagagctatagtatcacataactcaacagtaagtgatatgtcaagtgtgggaacactgacagacttctgtaccgtatccatggccactccagtgccaacagtcaattctactgctaaagccacagttcagccctccccttctac

SEQ ID NO: 534674 - DNA, 82 bp, Homo sapiens
ggatttgctggtgcagtacaactaggcttaatagggagctcgaattcgagcctcgaattcgagcaaaaacgttagaagcttg

SEQ ID NO: 534675 - DNA, 969 bp, Homo sapiens
ggacgtgaagatcctggtgatccccatggtgccgttcgaccatcccgctagtaaccggtatgttagtaacaagccgatactcgaaagtctcgtcattctgccgaggttgtcccctgatgtcgcgcaggattcggaactattgatgacgctggggcggaataaggcgaaagctgtgatgagtatccagagttatgtaggacagctagtggttgtcagactgaatagtgaccacgctagtcactctcaaagccctggagaggctgggccggaacttggtgctcggctgaagagtagcaatagggagaaagacgttgtgggaaaaggaatcgcgtttacatagtccgggggtagcgcgtgccagactccatatccatcggtcgattccgcaatcaacagatcgatttggttagtctcctgatgcctgagggcctgtacagggactccaagttcaggggtccatgacgatgtgctgttctgtgtgtgcagaaggccgcgcagcgcccagcgtgttggagcgaggggtgttcaccaagttgcgcgcatacgtgttaatcaaatgatcgcaagtgccgtcatccagagtgcatggcgggaacccataaggcacccacagtgttgtacctttgaccgcaccatgtcgtcatgggcacatatgcatgtccaacgtattctcactgtgcgccgggcaaggaaagaaggtcctactacctcttcagaaggagaagtggtgggttatcagggcaaaggttacagaatgccttgatttgacattgggacaagatgagtagggtggactggacaaaaggcagggtacaatcaacgcgaagttgagcttgttgccgtgtcaaatgtacgttccccgcaggtgtgtggatccgtcttgggaccacgtggtagtggtcctggaatttcatgaggcgttttcaatgttgctgccccccctcttaataattcaccaataaaattttg

SEQ ID NO: 534676 - DNA, 1265 bp, Homo sapiens
  misc_feature (1258)..(1258): n is a, c, g, or t
cccggcgcgtccaggcccccgtaggaagcgcgaggcgaggagagtgctggggttgcgacgagcaggcagtgggtcctggcacgaggaagagtatatcgaggtgcctccagacggtcatccaaagggatttctttcctgatgtggagaagctccaggcacagaaggagtacctggaagccgaggagactggagacttggaacggatgcgccagattgccatcaagtttggctctgcctttgggcaaagatgtcccggggagcccccgcaaccctatgtgactccagccacattggaaacccctgaggtgcatgcaggcactggagtggtgggcaaaaaagccgcaggcccctgaggccgaggcctgggaggatggcagaggctggagaggcaggagggagaaggaagccgttgcccaggctagattgtcttcctgaagccggtacacgagtgaggacaattgcctcctttccagcgaggatccatggagggttggccaaggcagagaagcccgggcacgccaacgctttgggttctaccaaggctgagggaacagttggacgacgagggcagaacagataatctcggaaattcccggtcagcaaaagcaaccaaggcccttcgagaagcagccaaggcccaatgttgtggagaaccttggacagttccaaggggccaagaaattcccgtcattgtctaattccaagagggttgtcccttgaagaggagccactagttaaagaaaggcccccggtgcaggttggctacattagcaagcagggcgctatccattaaagggaaccactttatgtcaaagccctgatgcacggtgttgacaagctcactagaagtgaatacgtgccctaaatgtcccacgcacaaactcggggccaaggtgggccccccgattggcaagagacgtgattccccaggagctcccctgaagggggggggaattggacttgtatgaccagacttttaccctgcccttgtgtgtaaagataccccgagataacacgggcgagggttgaaaaaacctggagtggagaggggggggaacccacttggggaggaacggccggattaataagagatgaccggcggacgggggtaaagaaacgggtgtaacggaggacatagtggtggataatataaacgcagagcgctagtgctcggagtcgagagggagtatatacctaggacaacgccccgcgcgttcattccctcctttgcgtctggttgctgctacacaaaaaaaanaaaggcc

SEQ ID NO: 534677 - DNA, 774 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggatgcagagtaagttatgattatgtatttactatcttatggtttttcttttccc

SEQ ID NO: 534678 - DNA, 230 bp, Homo sapiens
taaattacttagtccttattatcaaaaaggatgaggtcaacctaggtctttcttggcattacctatactataaatttctcaaatgagactttttacactgggggcaatgaactataagcctaataacacactagagtagattattaaagtggtgcttctgaagtgctataatcatcatcttcaccagggctttgtaaattatttctttccacaggatttaaaacttcaat

SEQ ID NO: 534679 - DNA, 948 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagtaagtttatgattttgaatataaattatatacaacaaaaaaaccacactcaacaacaaaaaggcgggcgctctctacatttacccgggggcacactccgcccacttttttcacaaggcgccaaagaacattacacgaacggcgcacaaacgagcggaaccgctcgtctgcgaagcacactggggcacggaccacagacagcggaaaatgtctgaccac

SEQ ID NO: 534680 - DNA, 287 bp, Homo sapiens
ggggccccaaaaccccccccccgggggggggggggccccccttttttaaaattttttgggggcccccccggccccccctgggggttgggcctggggggcccccccccaggaacccccaggtggggggggaaaagtttttttttgtttttggcctttttccccccggggggggggggggcccccaaaattttttaaaccccgggttttttttgggggggggccttccccccccccccttttattttttttaaaaaaaaaaaaattggggtataaatatggttttccca

SEQ ID NO: 534681 - DNA, 85 bp, Homo sapiens
  misc_feature (34)..(35): n is a, c, g, or t
ccctacgctgcgggcccgtatcccgtgggaaccnngaggagggggagggtggagacgaaaaagtgatgatatacctcccctccca

SEQ ID NO: 534682 - DNA, 765 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggatgcgagtagtttgattgataaagtatatcacaaaaaataataa

SEQ ID NO: 534683 - DNA, 400 bp, Homo sapiens
  misc_feature (9)..(11): n is a, c, g, or t
  misc_feature (279)..(279): n is a, c, g, or t
tacgttgannncgctgatgacaccccggatcagtctggcatagaggatcgtggggatgacgtgcatcacgaatgctgccgcgatgaccaggaacatcgataccatgatgaaccagtcgttgatgttctgacccttcatcgggccacctctccatgtctcgccatcgcttgggtgtcgatgtgcagtccaacagataactgcgcggagattgagagaggggtgggagtcccgctccgctcgcctgagaatagtgtagcgccgacaccacggaattgggancaggtgtcggcgctacgcagagatcactcgatgataccggcggccaccagctccgatcggatccgacgggtcagggtgtcggagttggcctgcaacagcaggcgtgcctgacgggcacggt

SEQ ID NO: 534684 - DNA, 785 bp, Homo sapiens
  misc_feature (12)..(12): n is a, c, g, or t
  misc_feature (24)..(24): n is a, c, g, or t
  misc_feature (759)..(759): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggatggagagttaattttttgattatggaataaaaacttntttcccaaaaaaaaaaacttccgccg

SEQ ID NO: 534685 - DNA, 374 bp, Homo sapiens
tcgagctcggacctgtgcagatggtgtctcattatggtttgactgggtctctgatgattagtgatgttgatcatttttcatatgttaggtgcttgtgtttcttctttgagaagtgtctgttcatgtctttgctcattttttaatggggttatttttctcttgtacaactgttaaattcctatggattctagatattagacctttgtcagatacatagttggcgaatatttttccccttctgtatgtagtctgtatactctgttgatagtttattttgctgttcagaagctctttagtttaactaggtcccacttgtcaatgtttgctttttgaggacttagtcataaattctttcctgagaccccgtctccaca

SEQ ID NO: 534686 - DNA, 174 bp, Homo sapiens
cctggtgtatatcaatgcttgatctattgataaatttgcctgatctcgatactgaattggaacattattaattttgcattttccgttttcggaattctgtaataaaatttactaatgttatacggcgaacattaacattcccatatccttgataacttttctctgggtcatatg

SEQ ID NO: 534687 - DNA, 1500 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattggagagttaaagtttaatgaatatgaggaattaaaactctaatatagcaaaaaaaaaaaacaaaaaaaaaaaaaaaaatggtgtgcgggacgagcccgcggcccctgcgaagaagagttctacgaagaacaattcgcgtggggcgccgcggggccccaaggagggtacacgtggaacagcgggtcacaaacgcggtgatccccagagggagaaccgggggccagtgacacaataggcgcgcggggagatatctctctcaacaccaatatacacacaaaccgcgccgcgggcgggagacaaccgcgagaagcggtgttccaagagacacacaaaactccccaagagtggcggcgctccctagggggggccaccaattacccgcggggggaccctctaactacacacccgagggggaggttcccccacacgcgcagaaggccactcgccgagagatactcacgaaaaattttacagcgccccccgagctgaggggggcgggcaccccacccgcgacgcacacggcgacagaagacgcaaactagaaagaccacacgcacgagccacacaaacaaccgcaaaaccgagagcaagtagcaagcgaggaccacagacgacgcaagcgaggcacgagcggcagggcgagcacggcagaggggagagcgccgcaagcgggacggaggcgcggcaggcgaacgcggaccaaaaagacagcagagagccgacggagagacaggagacgaagagaccagacgcgaggaagcgcgcggccggaccgc

SEQ ID NO: 534688 - DNA, 214 bp, Homo sapiens
  misc_feature (9)..(11): n is a, c, g, or t
  misc_feature (171)..(171): n is a, c, g, or t
  misc_feature (175)..(175): n is a, c, g, or t
tacgttgannncgctgatgacaccccggatcagtctggcatagaggatcgtggggatgacgtgcatcacgaatgctgccgcgatgaccaggaacatcgataccatgatgaaccagtcgttgatgttctgacccttcatcgggccacctctccatgtctcgcctcagggtancganctcgattcgtttatattccattgggtccattaggcttgt

SEQ ID NO: 534689 - DNA, 778 bp, Homo sapiens
  misc_feature (12)..(12): n is a, c, g, or t
  misc_feature (24)..(24): n is a, c, g, or t
  misc_feature (733)..(733): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggataagagccacncgaagtgccacacaacgagccacgcgacgagccacccacgtgccg

SEQ ID NO: 534690 - DNA, 746 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttctgtagctcaggagagcacccctccaccccattgctcgcttaactga

SEQ ID NO: 534691 - DNA, 370 bp, Homo sapiens
atagctcgctctagaggatccacccgcggcgagttcatgcacgcttccactcacggggagtgcggcaagttccaaagactagtcttaccaagtcaagccaagtcaaaaccagaacaaagatgtcaatacaggcacaccgtgggtgatcaggccatgcttccactcacatggagtggggcaagttccaaagactagtcttgacaagcttcagatgtctggacttcaagtgccatttccttcccggtgttcagccagtgttaatccttctcgggagcctgctatgcgctgctctggcaaggcgttccaccggggccatttcctacccgggagcgctctttggattgcgtcactcaggcttggccgagtcctc

SEQ ID NO: 534692 - DNA, 212 bp, Homo sapiens
cctgtgaagatcaaaatgaagctgttagaaaaatatacctcaggagctcaacatggaacagagaaatccaaagaaataaaagaggttgtggggtgtttttgaaaaccttgcaccttatgtaatagcagataaaatttctaattgtaaaatgttaaattgtaaaatctaatttgcaaaatgttctcaataaaggcctggcctcgttggcctca

SEQ ID NO: 534693 - DNA, 145 bp, Homo sapiens
gtctggagtctatgctttctccattatctcaaagccatacaagagaacaggtagatcacagaggccatatagtatagtggctagactttttaccttcagatcccagttttcttaccttctgattggttaactaatgtttagtgcc

SEQ ID NO: 534694 - DNA, 914 bp, Homo sapiens
  misc_feature (9)..(10): n is a, c, g, or t
  misc_feature (802)..(802): n is a, c, g, or t
ggttttttnntttggcagacgccaccgcggaaaaccgtgtactattagccatggtcaaccccaccgtgttcttcgacattgccgtcgacggcgagcccttgggccgcgtctcctttgagctgtttgcagacaaggtcccaaagacagcagtttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534695 - DNA, 497 bp, Homo sapiens
tgactctacaggagtcttttgctttgggacggcgacagtgcacattggacacgctggctccagctcggactcgcctctgtctactctttgcccgtgtctgccggaagccggctcgggttgccggagccctcgggctttggagatgaaggcaggcccctgctcctgccgggaaggaggggggcagtgggctcatgggtcggtgcctttgcagacgacagcacgccttgcgggccctggggatcttcctgtgccccggggagaccctttccgcctcactgcattggaaccccattcccgatcacccgctgggatccatcatcggaccccaagaggagtccgcgcagcccagccggcaccccgaagctcctccttcagtgggaaccgaagcagaagagcgatcaaggaggtcctcaccacaggactcctatgggtccgaccctgggtctcccgcaggcccctctggcagtcctctcccaacccgccgtcccaaagcacag

SEQ ID NO: 534696 - DNA, 605 bp, Homo sapiens
cttttcccctcaaacaataaatggtgatcaacaaaccaaatcacatagttacatagtgacccaaaaactgcttaaagaggagtacggtttaataacgcttgaagaaaaataatgcaaactaactttagtcattataaatcttacagtcattcttcattctaagtttaatataaataaattgatatatttggtaaatatgtatgaagtaaaggctcagaacttggggaattttcaggctggaattcattgtaccatataaaggttcctggccgggcgcggcggctcatgcctgtaatcccagcactttggaagcacgaggcaggaggattacctgaggcaggagttcgagactagcccggccaacatggtgaaacttccgtctctactaaaaacacaaaattagccaggcatggtggcgggcgcctgtaatcccagttattcaggaggctgaagcaggtaaaaaaaaaaggaaatctttaaacagtgtaaaccaaaactatctgagacagatctcaatcaatttagaagtttatttggccaaagttaaggacctgcctgtaggaaaaaaacagaatcacagagacagtctgtggtctgtgcctttc

SEQ ID NO: 534697 - DNA, 1024 bp, Homo sapiens
  misc_feature (912)..(912): n is a, c, g, or t
gcttgctattacgattagtccggcgcgcgggaccacctgtgtacatattaacatggtgtcactaacctgctatcggtatgcatactccctgttgccactgactacgtgctatggcacttcgtcgaccaagttatcacatatcggcacgtgggtgaccgagaggttctgaaagaaatgccagatgattgttcgtgacgcttcgattactggatcatatcaggattggaggtccatagacggagtctcctagtcatcacaactatgaacatccactcgccacgtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534698 - DNA, 1185 bp, Homo sapiens
  misc_feature (277)..(277): n is a, c, g, or t
ttcataccaatctagagtaatgagacgagaaggagcaacgaaacagtacctgaagcctaggacatcagcctgtacaactagcgccgatctagatggataatgatactcgcctgagcgagaagtcaatcacctaataacaaatagataacggatgcgacctcagaagtagataatgaacaacaatcaagcctggtcgattcatgaaggatactatgcctggaatataattctaaacggacgattccagaagaggaataactcataataattaacaaangaaaatggacaaaacaaaaaacataacaataaagagcaaccaaagaaaatacacaaataaaatccacaccaaataaataaatcaataaaaaacatagatcaaaggacctactcgacgcaaaacaaaatcagcgcactccagcaacccataaacacatgacatgaagatccccagccagtcagacaaaaaggacaaaacactaatagctacatccagggacacgcatctatatatcaaaatagaaaaaccaaactaagcgaacaactactaaaaatcccctaataaaaaacatactaattacaaataaacatcccaaagataaagacctaatatcaatacaaaaattaataaaatcatataataccatacattaaaaaacgaaacgtaagcaagctggaatatacaaaccaaaacaagaagagaaattcacaacaaaccccatctaagaaaatccaaaactataaattaaaccaaaaatatgagacccgaagactagaatgagaaaaagctatactaaagccgatctaaaaaaaaacctctccccaataagcaaccatttaactaaacaatctctctcaaaataatcaaaagatcctaattaccctaaaaataaccctaaaatgacaaccttatagactatgacataataccatgaaccattctaaacaaattaccaaagacagaacgaacaccccccataaaattcaagttaaatacctacgagagcccgatagaccagaacaggaatccccacaatagcagttataacaaccaaaatttaaactccccaaatgaagtcagaagctacctatctaaaaaattaggcaaacgcaatgaccaacagagaattgtaccacgcgacactcatataggccaacacaaaactggtgcaggaaaaataatcagag

SEQ ID NO: 534699 - DNA, 146 bp, Homo sapiens
caagggtccgcaagagagggcatcaaggctgtagtctagcagtgacttaatctgcaagtcacaccagacgggtatttagtattcattcatatgtcacatccagaccaacgagacagtacactcaagcaaggctcctggatgctcca

SEQ ID NO: 534700 - DNA, 705 bp, Homo sapiens
  misc_feature (12)..(12): n is a, c, g, or t
  misc_feature (24)..(24): n is a, c, g, or t
  misc_feature (644)..(644): n is a, c, g, or t
  misc_feature (652)..(652): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcaangagccacncaagacccaccatgagccacgcgatgagccccgcaacgagggtaccgagctcg

SEQ ID NO: 534701 - DNA, 618 bp, Homo sapiens
ccgttgacgatgcctgaccgagtgcgcgggcaaacgcggcaacatcgtggtcagggtgttttccgcaatggccacgcagatcagctcgacagcagcctgaggtgcgcgggcgccatggccaatgcctggggatgaacggctgagctcgatttccgctggcaaggtgatgggttcgatgcccgtcaactcgatggtctgttgcatgtagtccatcgccactagcgcgtgatagtcctcatcgacgaccacggtcatcgcgtcgtaacggcacgcaaacggaaagcggatagcgaagttatctttcgcaatgctcctggcggtcttgtcgacaatttcggtttcgaaaatcaccacatcattaatgaacttatacaagctctgaacgagaacaaaatgctgtaagtgactacactcctgcataaaggttgcgctcatgaccaatggttgacgactggccggagatagtaaacttttcgtcatcttccaagcgtcgtctcgggcgcgtccgaatggtcgccctttcctcccacgactcggaaaacgatagatatgcttcagctctcatgactacttcctttattcatgatactcagtagtagtgcacttcaaacacaggca

SEQ ID NO: 534702 - DNA, 271 bp, Homo sapiens
gatcttatcagcagcccgacagcaggacgcagcaggtacagcagcaggctgcagatttccagcccggagggccgggctcggacccggtggcagggggatttgggggaccgactctcgtggacacgttggcagtggagaacgcagttgggagggaggtgaaggctgcccagggtctgggtgtcgtcgcctagcagttgccctttggaagatgagtcgcaccttgctgttccccggccgggaaactgtgccctattcaaggagccaatggtgt

SEQ ID NO: 534703 - DNA, 110 bp, Homo sapiens
ctggtcccttgcttgagctagtattgtgcctattgccatactagtctttgcgcctgcgaagcacggtgggctagccctactagtctcaatctccaacacatatgcctagt

SEQ ID NO: 534704 - DNA, 816 bp, Homo sapiens
tggtgcctagtgtacaagattgttaaagaataaagttattttagcacaaagtgtaacccatttttagtcactgatcatacgcactgacagcttagctgctgatctcagttatgggtctaacaataaagcacaatattccaaaggtcagagatatctaggccacgaaatctggagtgggtagagctggaattctcaagagttttgtatacagagattcagtactcgtaggaatcacagcaggggacccaggcctcaagttagggtggaggtgctggggggtacgggagagcaggtacttgcatataagattgattggaatcatctgctacttttaaagaccatgctggttctatgtcagaggtatagcgttgtcaaggtgattcgatgggtcagatggggaaatgtacgccccttattttgccagtgtgaagcagataccctgcttttctttacagtagcggagtcagcttaagagctttaaaggtcctaaacttcaaaaacattacagtgccccatcctccgccttaatgtattcaaaatacaaacaatactaaactgtaacaaataacatgtaaccaaagaggtcccaatttaaaggttttgtatttcgtcttttctccatggtcaaaataacatagcaaactgcagcgtcagaaccacagctttggtcgcggcgcttcgggcccctcaagaaagccttcctggggccattctttttgtcgcccggccccattaggacggttccctgggcatcacgtgttcctagagacccggcacgacagggttggtttccccaggtaaacggggaacgggtcg

SEQ ID NO: 534705 - DNA, 3470 bp, Homo sapiens
gggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaaa

SEQ ID NO: 534706 - DNA, 3359 bp, Homo sapiens
gggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatc

SEQ ID NO: 534707 - DNA, 3126 bp, Homo sapiens
gagatggagtctcactgtctcccaggctggagggcagtggcatggtctcaactcactgcaagctccgcctcccgggttcacgccattctcctgcctcagcctcctgagtagctgggactacaggcgcctgccaccatgcctggctaattttttttgtatttttagtagagacagggtttcgccgtgttaccaggatggtcttgatcccctgacctcgtgatccgcccaccttggccccccaaagtgttgggattacaggcttgagccacagtgcccggccagcatctgcttttaaacagaattttacaatgttcctatcttcacctccaccttcacttccattctgaggtgtagctagcattgtagatttctgaacttgtctagcaattagggacacaccgctcctagcctccttcaacagctatgtgaagtgttagaattccttcactgtcatgttggtgagatttttggagtatatcaagccactgtctttaactagaagcctccctttttcaaacttctctgtatgaatagcatcaggatatattttccaagtagattgcctgttgtctgtaaatcatttattgatctgctcagcctttccccattgatttaaaatatctttaccatgtactaaattttcatatatacaagatccaattctaaaatatctatacctttgctttagtcagtagatctcttcttgatcatttcataggtgtatttactacaactttctttttttttgaggcaggagaattgcttgagcccgggaggcagaggttgcagtgagctgaaatcatgccacttcattccagcccgggcgacagagtgagactccgtctccacaaaaaaaaaaaaaaaaaaaaaaaaaaaaacccatccaatttttaatgaaaaccaaattgcactctcaggtaacagagaaagcgttctgatcatcataatgcccactaaatagccccaaagagcagaggctttgtcttagcattttaaaagctcaaacctgcaaaaaaaaaattgataatttcactgtatttgtaggatttttttttaattcaaaattgaccaaaatacttaatctggactccatctattttgaatggaatcaaatgtgtttaatgcaacttttaaagaaatacagccatttctttttcttagaactaagtatcacatttcagcaataagcattgcctatcctatctggttgtttaaaattattagttaggttttacatttcttttgggtacttcctggcatgttgagttgatcagaaaattgtataatacttattttaaaaacgttttagttgaaatttctgagacagtgtgaatgagttgatttacttctcatgattcctactggaaggatcaggggaatttattatgtgataattttacttacggttttacccttaatttctccgtattttatcctcttttccctcaagctagaacctcagaacctctgcataatgttcaggttttaaatcaaatgataacatcaaaatcaaatccaggaaataacatggcctgcatttctaagaatcaggtaataatgacatttgtagcttgtgtggaaactgggaatggtattgaatggccagcctggctgccttctacatccactttgacatctcatttctttgatctttctcttcatggctctgagctccatgtcagccacctgctcctgtggcaacttcctgggcctgttattctcccacacagctcacctcaaatacaatttgttgtctaacccagaggccctcaccacacggcctcctgtctttactctccccaccagcttttcccttaccaatgtcctttcctctgttctgctggcctctgcataggctctggaaatccctactgggaatggatccacctgggggcttctgagcctggctttcaaaactcagagcctcaaagattgctgcctgttacctcaagtaacagggaggtctcatactcccaggcaatgggtcatactcccaggcaatgggacatgcttccagtgtctgattcactctttatgttttgtgtatctcttatgtttccaggttcactctagcgccaaactatagtgattttagacttcttttcagtctcttcaaacttgggacctcgctacctctagcctctctctcaggaacttcaaaaatactatttcaacagatagcagatgccatcaagtgacatctatcagttttctgccaccaaccaataaatgtaactgcatccttccctgtgagaaaaggtggccttctatctgtgcttgtccttatcctcatcaaggtttttgccctgtggagatctcttctgcctccatggtgtatcaacatgggaaaatgctcaagtctctcttcttccctcagcctcccaaagtgttgtgattacaggtgtgagccaccacgtctggtctgaatgttctcctttattgctaactgctatagtttgtatttttccagacttattgtgtatgaaaacacataaatatgaatacaatagaacgttctacataaataagacttattttctgctttttctacctaacacctctgatagatctttcactgctattgcatagatatctaactaattctacttgcagcatagtcttctgtcataccttataaaagggagtgtatcatgtagaaactgttagaaatcatgctacctttcaagtgtatgtacctaaaatgctgtcagtctgccctctataaacttcggacagtgcactcacattaacagtgtgtaaaaggacttgtttcttgtacacatttggctaacattaactatactaaatcttttcaagcacctgatgtagtttctttaattataggtagatttggacattttttggatacatttcgtggctgtttaacttctttcctttaaattgactgaatggctttgtccatttttctattgagtcatttcattttttttctgatttgtttggatttctttttgtataatttatattttccctggatagttgcaagaaattgttaataaattgttctccctggctcctttcctgtggtatatccctggttcccatgtcgttatctctccttactgtcctcatttcgaaggcacactttctccagtagcttattta

SEQ ID NO: 534708 - DNA, 760 bp, Homo sapiens
ctcttgagctctctcctgggcagtccaacctgtctacttggtcctggtgcatatgcagttaggcttgacagaagcatttgtccagattatccaattctagcagtattgtatgtatggctagccagaagcagatagtttgggtttttatttaaagggagagagagaaaattttttgacttgcagtattgctaaaagattacttatcttattttttggaacaagatgtataagacagttaattgggtctttaatctctctcatgtataatagatatagtgtttccatacttgctgcattgtattgtgtttaggtgagagttgttatactaaactgtccaagcctgtggaagtcagatgcaggggtggggttatcctgcatattgaaggctacattttagccattatttatgctttgtctttttcaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaaa

SEQ ID NO: 534709 - DNA, 649 bp, Homo sapiens
ctcttgagctctctcctgggcagtccaacctgtctacttggtcctggtgcatatgcagttaggcttgacagaagcatttgtccagattatccaattctagcagtattgtatgtatggctagccagaagcagatagtttgggtttttatttaaagggagagagagaaaattttttgacttgcagtattgctaaaagattacttatcttattttttggaacaagatgtataagacagttaattgggtctttaatctctctcatgtataatagatatagtgtttccatacttgctgcattgtattgtgtttaggtgagagttgttatactaaactgtccaagcctgtggaagtcagatgcaggggtggggttatcctgcatattgaaggctacattttagccattatttatgctttgtctttttcaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatc

SEQ ID NO: 534710 - DNA, 552 bp, Homo sapiens
tcgtgagctcttctgatgggatgcggtcaggaagaggcgctcctcacttcctagatgggatggcggcgggcagagatgctcctcactttccagactgggcagccaggcagaggggctcctcacatcccagatgatgggcggccaggcagagacgctcctcacttcccagatggggtggcagccgggcagaggctgcactctcggcactttgggaggccaaggcaggctgctgggaggtggaggttgtagcgagctgagatcacgccactgcactccagcctgggcaccattgagcactgagtgaacgaggctccgtctgcaatcccggcacctcgggaggccgaggctggcggatcactcacggttaggagctggagaccagcctggccaacacagcgaaaccccgtctccaccaaaaaaatatgaaaaccagtcaggcgtggcggcgcgcgcctgcaatcacaggcactcggcaggctgaggcaggagaatcaggcagggaggttgcagtgagccgagatagcagcagtacagtccagcttcggctcggca

SEQ ID NO: 534711 - DNA, 235 bp, Homo sapiens
  misc_feature (97)..(97): n is a, c, g, or t
aaatttgggggggtttttttttttgccccaaaaaaagccccgggggcctgttaccccccccccggtccttaaaatttgggccccagggggggggggncctttattggtacccttttgggggccagggcccctgtcccccccccctaaaaggggcggggggtttgggggaaagggggggcccttttaagggggggggccccccggcccaaggggggttaaaaaaggttttttttta

SEQ ID NO: 534712 - DNA, 615 bp, Homo sapiens
gctaattgtacattctaagagcagtacaattagcctattacgtagggccctaatcttgttagtatagtgttgttgaaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaaaaaaaaaaaaaaaaaaaaaaaaaaaaaaaaaaaaaaggggggggggcggaaaaattttccggggggggcaattagggccacgtttttgtgaaaaaggggggccaagtggggggtgatttattattaaagtacactagggacggggggcgggtatttatataaaaaaatcgtgaagtaggagaggaaaacaagtgggtttacgggagagagattattgtgaggagaaagagagaacaaccattaatgctgtgggggggggggagacaaataattgggggaaaacacatcttccaaaagaaattataaagcgctgaggggaaaagtaatagaattgactgacggtgctatcatgtgggttaaaaaaagggatgtatgtg

SEQ ID NO: 534713 - DNA, 529 bp, Homo sapiens
ggagaaaaaaaatgtaggggtggacgtggtggctcatgcctgtaatcccagcacttggggaagcggaggtgggtggatcatgaggtcaggagttcaagaccagccgggccaacatagtgaaaccccatctctactaaaaatacaaaaattagccggcggtggtggcatgtgcagtccaacataataggttagggtaataactagaatagtaagttagggccaggcgcggtggctcacgcctgtaaccccagcacttggggaggctgaggtgggcagatcacctaaggtcaggagtttgagaccagcctggccaacatggtgaaaccctgtctctactaaaaaaaaaatacaaaaatggaccgggcacaggggctcatgcctgtaatcccagcacttggagaggctaagactgggtgggatcacctgaggtcgtgagttggagaccagccggcccaacatggataaaccgggtctctactaaaaatacaaaattagccaagggtgggggcgcatgcgtgtaatcccagct

SEQ ID NO: 534714 - DNA, 645 bp, Homo sapiens
gcgtcgccaggccgagccacatcgctgagacaccatggggaaggtgaaggtcggagtcaactggatttgcgtcggtattgtggcgtcctgtgtcaccagggctgcttattaactctggtaaagtggatattagttgccatcaatgacccctttcattgagcctcaactacatggttgacatgttccagatatgagttccacccgatggcaaatttccattggcaccagtcgaggctgagcaacgggaacgcttgtcatcgaatggaagatccgcatcacctatcttccacggagcagagactccactcgcgagaatcatagtggcggccgatgcctggtcgctgtgagtaccgtcgatggaggtccgactgggcgcgtcttcagccacgcatggaggaacggctgggcgctcattttgcaagggcgggaagccataaagggtcagtcactcgtctggcgcccctcgtgctgatgtcgccccatgtgcgctcatgggtagtagaaccatgagacagtattgacaactagcctcgagatcatcagcgatgcgctcctgcacacactcaactggttagcacgccctggccaaggtcatccatgactgagctttggtgatcggggacggactcagtgaccacatgtcca

SEQ ID NO: 534715 - DNA, 4271 bp, Homo sapiens
gagatggagtctcactgtctcccaggctggagggcagtggcatggtctcaactcactgcaagctccgcctcccgggttcacgccattctcctgcctcagcctcctgagtagctgggactacaggcgcctgccaccatgcctggctaattttttttgtatttttagtagagacagggtttcgccgtgttaccaggatggtcttgatcccctgacctcgtgatccgcccaccttggccccccaaagtgttgggattacaggcttgagccacagtgcccggccagcatctgcttttaaacagaattttacaatgttcctatcttcacctccaccttcacttccattctgaggtgtagctagcattgtagatttctgaacttgtctagcaattagggacacaccgctcctagcctccttcaacagctatgtgaagtgttagaattccttcactgtcatgttggtgagatttttggagtatatcaagccactgtctttaactagaagcctccctttttcaaacttctctgtatgaatagcatcaggatatattttccaagtagattgcctgttgtctgtaaatcatttattgatctgctcagcctttccccattgatttaaaatatctttaccatgtactaaattttcatatatacaagatccaattctaaaatatctatacctttgctttagtcagtagatctcttcttgatcatttcataggtgtatttactacaactttctttttttttgaggcaggagaattgcttgagcccgggaggcagaggttgcagtgagctgaaatcatgccacttcattccagcccgggcgacagagtgagactccgtctccacaaaaaaaaaaaaaaaaaaaaaaaaaaaaacccatccaatttttaatgaaaaccaaattgcactctcaggtaacagagaaagcgttctgatcatcataatgcccactaaatagccccaaagagcagaggctttgtcttagcattttaaaagctcaaacctgcaaaaaaaaaattgataatttcactgtatttgtaggatttttttttaattcaaaattgaccaaaatacttaatctggactccatctattttgaatggaatcaaatgtgtttaatgcaacttttaaagaaatacagccatttctttttcttagaactaagtatcacatttcagcaataagcattgcctatcctatctggttgtttaaaattattagttaggttttacatttcttttgggtacttcctggcatgttgagttgatcagaaaattgtataatacttattttaaaaacgttttagttgaaatttctgagacagtgtgaatgagttgatttacttctcatgattcctactggaaggatcaggggaatttattatgtgataattttacttacggttttacccttaatttctccgtattttatcctcttttccctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatc

SEQ ID NO: 534716 - DNA, 469 bp, Homo sapiens
caaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaa

SEQ ID NO: 534717 - DNA, 2782 bp, Homo sapiens
  misc_feature (225)..(225): n is a, c, g, or t
ataacgacgtgtactttgtcgaccttttcccaaaattaagtaatgaaatagatatacttaaatgctgatacaactatgagacttgttatttcagtggttagaaattattagctgctgatggtgtctgtggttcagaagctacaaagcatccattttgtagagtggtctttttgttgttgactgtacatttcagaatgcttgaagaaggagtatggggaaacttcnaggaaaaaggaatccattgaagacagatgccatgctttgagaagatgtaatgcctgattagtagtattctggacttcatggttttgtttttgttgtttgtttgtttaatatgaaaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaaa

SEQ ID NO: 534718 - DNA, 852 bp, Homo sapiens
gctgtggcgtgggacagagtgaccccgtgatgtgaagtgtgtgagcaacattggggatgtggttgacgatgagtgaatgcaacatgaagctccggccgaatgacatttgagaactgcgacatgtgtgaccctgtgccaagagctggttcctcacctgagtggagcgaaagtgtgctcagacggagtgtgggtgccggatttgcggacacgctcggttggtgtgcatgaccaaccatgtcagcagcctgcccctggagtggctgtgtggaacaactgtgcggcagaggccacccatgtgacaacgtgaccctgcactgtgtgcaatggtggagtgtgttttgcctgtggcatactggagtcacgtgttccatacgagattgtgggacgcgggacgcaagcagagggaggtgcttagtgtaaagacaagaatgcaggacacctattgaagttgtacggacgcccctcgtgaatgtacgttgtcactgggaggaaaagcgccgccaggcaggcgaagtcctgtcgagcgtcaaaggcctttgccgggggccaaagtggttacaggcgaccggacatgggaggcatgtgttcccagcgacgcttgcgcaggggtggtctatacgtgggtcacggtggaccgtgtatggcgtgtggatcctggtacctgacgttggcacagatggaacgacgtaacagtgaaacgacatcgtgtatgaaggccctcaggctttgaaaactcagaacagaagcagacgggaactccgattggtacaacccctataagggaacgtggagtgtcccttgagaggacagacatgaacaacgtgcgaggggaggacgtactagcacgctgaa

SEQ ID NO: 534719 - DNA, 3558 bp, Homo sapiens
gggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaaattataaatatttcaacggatgcaagcatttgggagaataattcagacatgagcattctctagaatcactttttaaacactgacctggt

SEQ ID NO: 534720 - DNA, 368 bp, Homo sapiens
  misc_feature (218)..(218): n is a, c, g, or t
  misc_feature (241)..(241): n is a, c, g, or t
  misc_feature (266)..(266): n is a, c, g, or t
  misc_feature (317)..(317): n is a, c, g, or t
  misc_feature (326)..(326): n is a, c, g, or t
  misc_feature (350)..(350): n is a, c, g, or t
tttttacaacagtacactgatctacaaaaattttaaaatgagccgggcgcggtgactcacgcctgtaatcccagcactttgggaggccaaagcaggcggatcatgaggtcaggagatcaagaccatcctggctaacacggtgaaaccccgtctctactaaaaatacaaaaaattagccgggtgtggtggcgggcacctgtagtcccagctactcgggnggctgaggcaggagaatggcgtnaagccgggaggtggagcttgcagtnagccgagatcacaccactgcactccagcctgggcaacaaagcaagactctnaaaaaaganaaaaatttttttttaaatgagctngggtgtacttgcatgcat

SEQ ID NO: 534721 - DNA, 163 bp, Homo sapiens
tgaatgtacactggctcacattcatgccatggagcctgagaatccggtaccatacggagccactcacccagagtggtgaatggctttctggcagaaattccaaactgaccagctctgagatcattatctgggctatctggagctaataaggagggatgagcat

SEQ ID NO: 534722 - DNA, 1393 bp, Homo sapiens
gggcccaggaggtcaaagctggagtgagctattaccttgccacagcaacccagactgggcaacagcaagaccctgtctctaaagaacaaacaaaaaactactacaacttcacctctgtggtcttccccccaaaatccaataactccaaagtaaccacaagaaatgtatcaaacaaacccaatttgagggccattctacaacatacctgactagtactctttggaactgtcaaggtcatcaaaaacaaggaacatctgagaaactgtcacagtccagaagtggctaagtggacatgatgactaaacataaagtatcctagaacacaggcaaaaactagtgaaagttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaaa

SEQ ID NO: 534723 - DNA, 216 bp, Homo sapiens
cctcccagatctcatttctgaaacatacttttcagttttcaaaattttattgagatgttggagagaaacagccaacatatacattcctcattttgtcgcaactggcattttacccacatgataggctcttctctggcattgacctaacttcaggtctccttggtagtcctccttctgttctctgttgctgcctggtgtccttgaagtctaccaggg

SEQ ID NO: 534724 - DNA, 316 bp, Homo sapiens
  misc_feature (305)..(305): n is a, c, g, or t
gtacgtgcaacgtcgaacacccactagcctaaaaaatcccaagcatataactggactgctcaccccaattggccaatctatcaccctatataatagctaatttatataataacatgaaagacattctcctccgcataacctgctgcagattgaaaacactgaacttgacaattaacagcccaatatctgacaatcaaccaacaagtgcattattaccctcactgtcaacccaatacaggcatgctcataaggaaaggttaaaaaaagtaaatggaactcggctaatatcttaccccgcctgtttnatatattatat

SEQ ID NO: 534725 - DNA, 402 bp, Homo sapiens
  misc_feature (92)..(92): n is a, c, g, or t
  misc_feature (95)..(95): n is a, c, g, or t
  misc_feature (126)..(126): n is a, c, g, or t
  misc_feature (133)..(133): n is a, c, g, or t
  misc_feature (170)..(170): n is a, c, g, or t
  misc_feature (174)..(174): n is a, c, g, or t
  misc_feature (191)..(191): n is a, c, g, or t
cctttgggtcgcttctgttcgtatataagcagccagttcggtgggtgtcataaaacagtgacaagaaggctgctggagcggcaaggtcccangtntgcccgaaagtcagaaggttaaagaatttanccctaancccgccccccccctcttaatcagtggggaagacggtntcanaactgtttgtttcaatnggccatttaagtttagtagtaaaagactggttaatgataccaatgcttcgtaaacccttcagaaggaaaggagaatgttttgtggccccctttggttttcttttttggggggggcagttttaagttattagtttttaaaaccaggactttttaatggaaacaacttgcccaaaaatttgtcccagaattttgagacccattaaaaaagtta

SEQ ID NO: 534726 - DNA, 382 bp, Homo sapiens
ggcggcatccgcaagaagccgttctgggagccgtagcgcttctgcagcgcggcgcggcgtggccgtctcgaagacctcgtgcacggccttccttggtcttgtgccagagcactcgaggtagtcgtaggcttggatgcgcacggccattgcgcggcgttcatccgtgcgcacggtttcctgcttcatgcgggccaggctctgtgcggacatgctcgtcgctgcgcaggtctttatttgtttggccaccaggatgatgggcacatatgggacagaagtgcttcacctctggggacccacttctcggggaatgtactccagcgagtccgggcttgtccaccgagaagcacatgagaatgactgtcggggtgtccgggtagggaga

SEQ ID NO: 534727 - DNA, 405 bp, Homo sapiens
cagactatggcgccttactcaacattgggaaggggggttccaactcttttaaggtctcatcttcagcacttctaaactgtgggaaactatgtgaaaacaaatggagtggccaaacacaccattcatcactgtgcttctggacagctgcaagtccatacgtgttctgataattcaatacaagaaagaagatttgcttgggaaggtctgaatggccctagctttgtttgttaaccataacctctaccagctggaaacacaatgccccactaatactaacagtgcctgcttgtccaaacagcattctggccacttacagcaattgacacaaattctaacaggtagatggggcaaagcattaccttgtgtaaaactgctgctaaaatatattcctagtgagaaaggtca

SEQ ID NO: 534728 - DNA, 359 bp, Homo sapiens
  misc_feature (11)..(11): n is a, c, g, or t
  misc_feature (19)..(19): n is a, c, g, or t
  misc_feature (22)..(22): n is a, c, g, or t
  misc_feature (41)..(41): n is a, c, g, or t
  misc_feature (271)..(271): n is a, c, g, or t
gctcggaccangcttagtntgnaatacatgtcaaaattgangcagagactgcaggtgatgtgtccaccagccacggaggtgccaaggcctgcccacgatactagaagctaggagagaggactaggcagcctttctctgggagcctccagaagaaactaaccctgccgacactttggtttgggacctttcgcctcccaaactgtgaaaataaattcctgttgttttaagctatctgataccttgtggtgctttggtaaaactaacttgtganactaacacaaagtaagtaataaaggaaaagaggaatacaaaataacaaggcctactaagcttcttcccctactcatcgcactaattta

SEQ ID NO: 534729 - DNA, 104 bp, Homo sapiens
atagtacatgactgttccttaaataaatccgttgcgtattcgctaagccgagttagccttgacgctgcttgtgacgcgggtcggtgcagataacgcgcaccacg

SEQ ID NO: 534730 - DNA, 158 bp, Homo sapiens
tgtaagcagagaatggtcagagaatgggattccgattgggaacttgtggggatgagagtgacctcggttgagctgggaagtggaaaaaggatgtttgagtcattgtgcacctattagagcctggcccgctgattccgtaggatggctggcgagacacc

SEQ ID NO: 534731 - DNA, 303 bp, Homo sapiens
aaagagacccacagaatcaccacacttgttgcccaggctggagtgcaatggcgtgatcttggctcactgcaacctccgcctcccaggttcaaccgattcttctgcctcagcctcctgagtagctgggattacaggcatgcgccaccacgcccatctaattttgtatttttagtagagacagggtttctccatgttggtcaggctggtcttgaactcctcacctcaggcgatccgccacctcggcctctgtgtttcctgtgcttcttagctctttccactgagaaggcttcagtgtggtggacg

SEQ ID NO: 534732 - DNA, 732 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatactatcgcgctgctccctgcacttccctccggcctccatcactcccgtcacctcactccccaccaccggtatcctccc

SEQ ID NO: 534733 - DNA, 3679 bp, Homo sapiens
  misc_feature (3567)..(3567): n is a, c, g, or t
ctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctgtgtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaaaaaaaaaaaactcgtgccgaattcggcacgagtttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534734 - DNA, 418 bp, Homo sapiens
tggtggagtatataaactttccaaaattctcattttgctttaatttatcactgggcaaaaatagttgttttccttggaaaattttcaagaaagcatctgccaaatacccaagtctaaataacgtactttgttggttattctttcatcaagtaaaaatgctgttctatgaagaagacaactagttagctggaaacccaaataactgtaaaagtacttttccttagacaaccacagtacttcaatatataacagaagtgttttttgagtacttcccattttatcacacaaaatattcaaaagccaagtactaaaaggtcaagattaaataaaattaatttttactgcttcatcaagaacattcttaaatgaaactttttttttttttttgggcaattttatacggcttgacattaaaaaa

SEQ ID NO: 534735 - DNA, 3625 bp, Homo sapiens
  misc_feature (3513)..(3513): n is a, c, g, or t
ctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctgtgtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaaaaaaaaaaaactcgtgccgaattcggcacgagtttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534736 - DNA, 356 bp, Homo sapiens
tcatggcgaaacctatggaccatgattcatccagagcacaccgcagtttgcgccaggagagggttatcgaatgccggctttatatatattcctatctgctaataacccgggaagacaaactggtggggcaaggaagagggggaagatgttccccatcaatgggcaccgctcacgtcacccaggccggagctgttgtctcgcgtggttcgaggtgggctcacccagccaggcagcctgcaaattattctctggagcctcccggggacaggacaccgcctcccacctcacacacctgtgctgagggcttcctcccagttgggaggggtgtgcctgctcctggctggattctgtcccca

SEQ ID NO: 534737 - DNA, 1002 bp, Homo sapiens
gagcgcagccgagcccagacgccccgacacttttctgagcagacgtccagagcagagtcagccagacatgacctgagctgcctgctgtccccattctctgactcctgctggggccccacgcatggagaccccattcctgacgacatggatacccgcatatgcctgacctctatcgacacaggccattcggagcatgcccctgtgcttgcctggagtgagttggtcagcacgtggtatacggcagagcacgacaagcatgtgccaagggcataccgatgcagcaccacacatgaacacccacgacacagaccaatcagaagaggcaccaccgcaaggtggagccaggaagaccacagaccataacaagaaactgcagacggcatcacagaccgagcacacatacagacacggcgggcggtccatcagagcagaatcccggacaacacctcgcgggaccagcataggcaggcgatagtccccatagcgcatgtccaacccaaagttcagacccccgagaacagaaggcaatgacggggtcaaagaaccaagaggcatcgggcggttgggttgagaaggaattccaaccgagccaactgcaccagaaggggaagccgagcacggcaccgacagccattggccgtacaatcatcccacgaggaaggcatatccacagacggaggacacataaccacacggccgtgcacccgcccgaggatggtagaggaaccccacaaagcaacagaagagcgtaacccgtacccattcaccccagtggatcacccccgactgcatgcgggcaagcacgcgtggaaccactggatggaagcgagacaccacccaaatgcacacaacaagcgaaagagcccaagcgccaacgacccacaagcggacgcagccaacacaagatcgccacaaggtccacacccatcacagacagatcaggccgagagcccccagcgcttggggagggcccccaggaacagagatggccaaaagattccg

SEQ ID NO: 534738 - DNA, 1778 bp, Homo sapiens
  misc_feature (1666)..(1666): n is a, c, g, or t
ttagtgtatgtgtttaatattagaaaattggcatatgtactaagggtaatctttttttgatgtgtgacttatggtcaaataagctactatataaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaaaaaaaaaaaactcgtgccgaattcggcacgagtttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534739 - DNA, 849 bp, Homo sapiens
  misc_feature (45)..(45): n is a, c, g, or t
  misc_feature (56)..(56): n is a, c, g, or t
  misc_feature (737)..(737): n is a, c, g, or t
agataaaacacaagtcaaacttattcgagttgtccacagtcagcnatggtgatctncttgctggtcttgccattcctggacccaaagcgctccatggcctccacaatattcatgccttctttcactttgccaaacaccacatgcttgccatccaaccactcagtcttggcagtgctttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534740 - DNA, 185 bp, Homo sapiens
aacgtgtcatactcgggggagtgggaggagtcaattccactcccaagctttcattaataaagaccacatcatgttacctctcaagacctctttatctatgtatactgaattaatccatcttagtgtgagtagaaagagtgaagaaagcccaggactaaggcctaaaaatctgcagtattgaggaa

SEQ ID NO: 534741 - DNA, 163 bp, Homo sapiens
atgccgtggtgcagagccccgaattcctacttcatggatgtgacaatgcccaggatgctataaaatcaccacggtctttaaccatgcacaaacgagtagttttcgtgtgattcgctgctccacttgtcctcttgccagctctaccaggaggcacaaagcaagg

SEQ ID NO: 534742 - DNA, 333 bp, Homo sapiens
cccgggggggggggggggggggggcccccctcccccccccctgggtaaaaaggggggttgggggaaatttccccccatttggggggggggggccgggggaaattcttttccccctttttggaaaaaaaccctttggggaggaattttccaaaaaaaaagccccctttcccccccgggtttttcccggttagggttttgtttttgtttgggggcaaaaacggggggaaacccaagttttggggttttttttttcccaaggggttttttttgggggggcctttttggcccctttgaaccccccccgtttttgggaaaaaaagggtttttttttta

SEQ ID NO: 534743 - DNA, 513 bp, Homo sapiens
catccgtaccgtagactttccaagtgcatgaagagcacggggaaatattgtcaagcaacaaggtaggaaaacaaagtgtgagattgtcacattcaggctacggctttgttttttgccctgagggagaagcagcaaatgtcccaaagaacggacgcggctgccacctccttgaggagatgggactgaaccccgcccggagcctggactccgctttcgactcctcccgacaataaattatggaccgggtgtggtggctcacgcctgcaatcccagcactttgggaggttgaggcgggtggatcacttcaggtcaggagatcgagaccacggcgaaatcccgtctctactaaaaatataaaaaattagccgggcatggtggcgggtgcctgtggtcccagctactcaagagaggctgaggcgggagaatggctggacccgggaggcggagcttgcagtgagctgagatcgcgccactgcactccagcctgtgtgacagagcgagactcgtctcaaa

SEQ ID NO: 534744 - DNA, 623 bp, Homo sapiens
  misc_feature (12)..(12): n is a, c, g, or t
  misc_feature (24)..(24): n is a, c, g, or t
  misc_feature (592)..(592): n is a, c, g, or t
  misc_feature (621)..(621): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggaagttgcttggggtttatcttaaccccagatcattctttgactnaagagagacccctcacccttggtcgaganct

SEQ ID NO: 534745 - DNA, 252 bp, Homo sapiens
ccatgcctcactcatgaacaccaaccacccaactatctataaacctagccataattacccccatactccttacactattcctcatcacccaactaacaaatattaaacacaatactaccactctacctcacctcaccaaagtcccactaaaaataaaaaattataacaacaccctgccgaaccaataatgaacgaataatctgtatcgctatcattcattggcccccatcaatacctaggtccatacccgac

SEQ ID NO: 534746 - DNA, 566 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccagatgcagccagcagaggtaccatcctgactttgaactgatagttcctgttttatttaccca

SEQ ID NO: 534747 - DNA, 935 bp, Homo sapiens
  misc_feature (690)..(690): n is a, c, g, or t
ccacgcgtcgcggacgcgtgggtcgacccacgcgccgctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgaaaaaaaaaaaaaanaaaaaaaaaaaaaaactttttgggccgcgccttgaggcccctgaaaagagcttcttcttagaccccatttcgttgtgggcgccggcggcccccagttggtgttatctgtgtgaccctgtgcgcccctaggccgtgttgccccgaggaaaactgcggcgcccggaacctgggtgcttggggttttctccgccgagtttaaaaacgcccgggggggaaccccgagcgtttctcgtgcaccaattgcg

SEQ ID NO: 534748 - DNA, 1536 bp, Homo sapiens
  misc_feature (1)..(2): n is a, c, g, or t
nncaagacgcgtgggggcgcgtcgtagtatttctcgctgtcttagtcatttcgtcgggttattttctgtttatgcgcccccctgtcgtcttgtgtcgctgaggcgttgattcagctgtccctgttcgtgttgttattcttgtttcgtctgttcagcggtgctctctcttttttgttcttggtttgtgttagtctcctatcttcttgtttttgttggcctgtgtttgtggtcttttatttttcctcgaaatcgggtgttgatatgtcttctttggtttctttcgttctttctctcctggttgctcgcctatatctgttgttgatccgatttctagtcctttcgctgtgtgtccatttcgctgtttgtggggggtgcctctcttcatttgtactgcccttgtgttgtcatatgtctttgtgccttttattgttgtctttattcgttactatgttttcctggggtgttctccttttcagtgtttctgtatgattctgtctctggctccttttgctttatgtccttgtgcttttgatgttgttggtctatcttcattctggtgtattcttgtgtggtgttactgtggttcttttcctccttgtggttgtcttgggtgtgtctccttgctgtgctcctctatgggcccttgtgattgtgatgcttctgtgtttgttgctggtgtgttctagtagcgttgtaatcctatctaccttgctctttcttagtacatctcttgttctcttggtagacctgataggttgcctatcactcctcggtcggctctgtcggtctttgggtgcatccatgccgttaacttcctctgtacagttcacgtgtaggatgtacttcctggagtatgttgtgtgacttttattagtatgataggtggtcatactattggcattatgagtgtgtatagtagtctatagacttgcctatagctctctaggtatgttcaataatccttgcctgcatttaaggatctcttagattactatagtctagctgtctgtgccaaacctctaggctatactgggtgtgtagctagtttgtcctagggccttctccctatgccttggtttttgaatgagctattgtataggctacactgtggtatatatgatggcctcacagatctcatatagttactcgtcctttcccccttaccattgggcctagtgtatatatagataagccttgtcatagttattcttggtgcagggacgggtaagacctcgtcactttagtggtcaagatgcacaggatataagtcgtcccgttccctagaatttgttaattcttgatgtatagtaatctttttcatgatgttcctttatttgtggctaaacaagacattagaatggagggcaccaaggcacatattcatgttgtgaacacccagtcatgactctacagtgtgcagtagtacgcgtccatctttcattggggaagcttgaggagtgcacgtctagttacaacgtagcgggacaagagtgggtaagcacattaacctcaggcttactctcattgagtaccccc

SEQ ID NO: 534749 - DNA, 291 bp, Homo sapiens
  misc_feature (263)..(263): n is a, c, g, or t
gtgctgtgctgggtgatctaaggatccgagctctctctgtggggatctgggtcgtaagaagagctgaggccctgcaggccggggggctcttcctcgggctgacagctgtctcttctgcagctgccagtcgccgctccaggctccacacgcgtttggccaggcccagtgtcagcgcccgcagccggggggctgcctctgggcctggtacctgggagcaggtcaaaggccagggccggagggcccccacagaagagcgtcccccnacagagcagagggtcgggtcaccgagct

SEQ ID NO: 534750 - DNA, 3625 bp, Homo sapiens
  misc_feature (3513)..(3513): n is a, c, g, or t
ctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctgtgtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaaaaaaaaaaaactcgtgccgaattcggcacgagtttgaagatgagaacttcatcctaaagcatacgggtctcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534751 - DNA, 422 bp, Homo sapiens
gtcgacaatgagatgtaagagcgtattataccatagccgcctaattaaagatatactcgcggcgagatactattgactcagtcgatgggggctacgatatgggctccagtgcgagtcataagtggatatccgtaagacgaggtatctttactataaaagctattgtgttagcaagccatataaagttgttcgctcaggagtttgatagttcctggccggtggcatgtgagtcgtacactgtttcgtgagcctagggtgtcgtgactgtgaatacctgggcggagtaggggaagggagcctactagggtgtagaataggaagtatgtgcctgcgttcaggcgttctggctggttgcctcatcgggtgatgatagccaaggtggggataagtgtggtttcgaagaagatataaaatatgattag

SEQ ID NO: 534752 - DNA, 185 bp, Homo sapiens
  misc_feature (67)..(67): n is a, c, g, or t
cttagaggaccccttaaattggcacagaaattatttgggctatgtggagcaagctgtcttgcataanaaagctatattggcgctctagagaaagtgagaatggcaaagaatttgagagatacgtgagcaccaaaaaaaaaaatcacacaacttaaacattgtgcaataaaacacgatgacagaat

SEQ ID NO: 534753 - DNA, 983 bp, Homo sapiens
  misc_feature (12)..(12): n is a, c, g, or t
  misc_feature (24)..(24): n is a, c, g, or t
  misc_feature (477)..(477): n is a, c, g, or t
  misc_feature (871)..(871): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtcggcaaacgtgaaagaggcatgaatatgngtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534754 - DNA, 958 bp, Homo sapiens
ataggtgctagaagtgccggacgtcgggaaggtctagatcaacttgaagaagtatgacggtcgaccaaccattcaaaagaaaggtatgtggacgggcttatgagccgcgtcagaccaacaagtgtctgttacgagctaccgatggagaagaacaagatcagcactgtggctgagctccataggaacgtgcactcagtctaagatggagttcttcaaacctccttagagctaaacatgcgaatgggttgaagcgaaggagagaccactcaagaccaacccactacggacgaaccaaaactcagaaggcagaaagcaagcaagcagcagcgaactgcccgggcagaaacgcaaacaagacagcaaacgacaagagtcacacaacagcgagcacagcagcaggacacgaaagagggcatacatattcgctgcgttacaccccaaatagacgacacagacatgcggatatcctcagaccttaggcacacgactagccaggttctcctgcgtgcccccaaacgcacgtgcacccacactaacgaataaacggcctcgcggcaacgaacccagctcgcaggtgtaacagaggatcagacagtgaaacgaactcagttactccgcctgccgcgccacctgaccctgcgcaagactggacactactccacatgaatcactgaagccaaaggtgcgtggcgaccaccctgagacaaaagcagcaccacttacacactgaagacacccgcacggcacaatcgtgcacgcccacccaccgaagaggccgcgaccacccaccatgcaacgccggtgccgcagaggcgccccaagcgctcggacacaacgcaagcccccacaacgcgcacagagagccaccggacacacagcgcccaccgacgccaatccccccgccacggcacagcacaagaacgccagacgggacgacggcgagaaacacgaccgcccc

SEQ ID NO: 534755 - DNA, 217 bp, Homo sapiens
acaagaggttggacttccaacccaggcatgtgtagtctatgcacattgggatgcagtctagaggtgtggctgataagctgaatgtagagatggtatctaaatagtagtaaccgcactgtctggatcccaagattactttaaaaatttcaagaagtagatgtgtgcaaattcttagggataagttaagaatgaaagttccaggcggggcgtgcagggg

SEQ ID NO: 534756 - DNA, 156 bp, Homo sapiens
ctcgattgctcggctgctccccgctggctgcagtgctgggggtgagtgcagaagccactggatgctgctggcctgtgctgcccctgctgagctcagcactgtggttggggtccaggtacgtcgcctgccctgcaggcttgtcgggctagtctgggg

SEQ ID NO: 534757 - DNA, 448 bp, Homo sapiens
aggagtttgagaccagtgtaggcaacataatgagaactctgtctccacaaaaaattacaaaaaaattacccaggcatggtggcacaggcctgtactctcagccactcaggatgctaagctgggaggattgcttgactgcagctggttgaggctgcagtgagcagagatcatgccaatgctctctagcctggttcacagagactgaccctctctgggggggaaagaaaaaattagaaaacaactgtcatgctgggcgcagtggctcacgcctgtaatcccagcactttgggaggccaaggtgggtggatcacctgaggttgggatttgagaccagcctgaccaacatggagaaaccccatctctaacaaaaaatacaaaattagccaggcatggtggcgcatgcctataatcccaggtacttggaccctaaggcaggagaaccacaatg

SEQ ID NO: 534758 - DNA, 388 bp, Homo sapiens
cccttcgcgcctgtactccttgctgttccgcagaacttccacctttgccctcaccatcgcagtgggcgccctgttcttcgagcgagccttcgatcagggcgcagacgcgatctacgagcacatcaacgaggggaaactgtggaaacatataaagcacaagtatgagaacaaggagtaacaccctgcccctgtgggacccgaaggaacagtcgccggtcagctgtttgcctggagttggggcctcagcctaaggatgagtttcaagttgccgttcaccgaccgccagtgtgtgggcaagctatggctccactgtacaaacagactcacttctgctgtgtttgagtacagctgtcagcaaataaatgcaaagtgctcatgccaaaaaaaa

SEQ ID NO: 534759 - DNA, 731 bp, Homo sapiens
gctccgggaagatggcggccgtgcaggcggcgaggtgaaagtggatggcagcgagccgaaactgagacaagaagtggtggtaatcattagttccagggtgctctgccatgttgacgcaagcgtgctgtaaggcttgttgaacgggggtccctgcgcagaaacctcctgggcatgagtggggtcgacagggaactgcgactgggtcacacgttgcgtccgtttcacgaggccgccctcacgaagggacaaggtcattttctgatcaacagaagtgagctgataggaggcgcctgcaacaagcgtgagaagaaagttagccagagaaggaggccacacagaaagagctcagttgagaaacagctaagacgcaagccttctgcatgtctgccaagcaaacacaccgagctgatagatggtgtgggtcctgaggaagagaggcgtgggaacccaggatcaagtactacggaagatccgttggatcatgcaagttcatctagggctagacatgtgctcccctgggggaagcacccacaatactggccaccacaagattgccatgtcaagaaatctgcactctactgacttttatgccaaaaattttagtcacctgacatatctggggatcacctgcattgtaaatctccttaaaggtgggcaggtaggcatccatgacccgaaagaagtcttctgggggaaagctccctcttctatgaagtcttcgatgatagggg

SEQ ID NO: 534760 - DNA, 274 bp, Homo sapiens
  misc_feature (33)..(33): n is a, c, g, or t
  misc_feature (139)..(139): n is a, c, g, or t
  misc_feature (180)..(180): n is a, c, g, or t
  misc_feature (196)..(196): n is a, c, g, or t
  misc_feature (218)..(218): n is a, c, g, or t
  misc_feature (234)..(234): n is a, c, g, or t
  misc_feature (249)..(249): n is a, c, g, or t
caggaacaaaaggttaagaacttcccagttcanaacatgaccaccattggggcccccgagctctctctctctcccttgattaagtgggccccattaatccccagtccaaactcccaaaacaaacctctaaccccaaccncataggtaaacatttaaatgaattagatgttcccattaaanggcatagaccccctgnaaaatgtagaagtgtccagtgnacatgaatttttaatnaaccaaaagggcaanaaagaagagatctaaaaaaaaaaaa

SEQ ID NO: 534761 - DNA, 574 bp, Homo sapiens
  misc_feature (1)..(1): n is a, c, g, or t
  misc_feature (66)..(66): n is a, c, g, or t
  misc_feature (102)..(102): n is a, c, g, or t
  misc_feature (120)..(120): n is a, c, g, or t
  misc_feature (194)..(194): n is a, c, g, or t
  misc_feature (208)..(208): n is a, c, g, or t
  misc_feature (257)..(257): n is a, c, g, or t
  misc_feature (262)..(263): n is a, c, g, or t
  misc_feature (277)..(277): n is a, c, g, or t
  misc_feature (316)..(316): n is a, c, g, or t
  misc_feature (320)..(320): n is a, c, g, or t
  misc_feature (325)..(325): n is a, c, g, or t
  misc_feature (368)..(368): n is a, c, g, or t
  misc_feature (574)..(574): n is a, c, g, or t
nattcaaaaagatatcaaaatactaagaaagccagcgaaaacggccacctaccaacagcgcaacanaacagagatacctgggaaagggaagtttaaatgaanggtagcattaactgttcncctacatatataagcaaaaaccctcctgaccacacatgatcataaccaactataacccaagcctttatacttangtccctatcaaccngaggctaaccacccaacagttccaggcaattccctacctgagcttcttntcaanntatccttctcccanagaaagcagctgcttatggggcctggagatgagcccccnctgnccccnccggccctccttgccaagccattcctgggtgagttcaggcctncgggagccacacattcatctccacctggacacttgagccgcatggccagacccctccacctgatgcggtggtgcgtgtgatttgtcaaaagaaagccttctggatgctgttaagatgtacccttctaggtgaacctggtatcagacccacagtacttgctgtttgagaaaaaataaaaacaaaaaggtcacctgttctccagcccn

SEQ ID NO: 534762 - DNA, 739 bp, Homo sapiens
  misc_feature (489)..(489): n is a, c, g, or t
acgtatcattctaatccatcaggaaaatgagctgaatggcccagctatcatccaagttgacacattctaagaggaagtaaaaacatttcttatcacttagattgttttccaaggctaagtgctacaatttgctggagctgcagaggatcgctgagtggggtactgtgtctcatagacatgcgccactccatgtgagaacaatgggtgaaggtgagggaagccccatcagccttgggtcttttcgctgtgcctcctatgtatgtctggttggcgtgggaagcagtgattaatgacgatcttaacatattattaaaaatagagcaattgtaagatcgctattatacacttatccagatcgtgtagtctggtgcaactaaacacaggggtaggacctttacatttgcactagcaggagatactatgcagtactaagttgattacatttttccaactatacaaagaatagaaagacgcagttcctagtgtgtnacttcccttgtaggaacccgagtcgttgaattccggtaaacagaagagttggctcattctatatctcaattaatttgataagacaccccaaacagagaaaggtcagaattgggtttgggtttcacttatatgtctaagggcctacacatttatggaaacgttcccaaattggacaggtatggcgattacggggttagttatcaaccgcgtggttgctagaccccttggttcgcccttcaatttttcgccg

SEQ ID NO: 534763 - DNA, 364 bp, Homo sapiens
cgatatttgagggcatgctgccaatgcaacccgcacatactactggggttgtctgtccacctctaacatgtctaagcctggcacagataacggagctgttgctttgacactcagatatgccatgctattccccctcctgtgataccagctcttatgtgtgagacctcacagtggtacccaatatgatggggctcgtgttgcatacattctagttcacgctaagtctcttgcctacagagactacgtgcgtatgatagcacgtctaaggcactcttacagcccagatagctcatgtgactcgtgtgaacgagcttgttccgcttgggcaccaccaccggaccgaacggttcctggcgtcacgtgc

SEQ ID NO: 534764 - DNA, 481 bp, Homo sapiens
ctcctattttagacttccaatttcttgataacctgttttattactccaggcagatgtcagctacatagccctaaatttgcatattaaagggccaactcttgtgaaaaatcagatagtgaaatttatatctcaaggtacagagagaaagagtctggtggtactacagggagattaaaaatggatgccaagtcaaacataaaattacagaaatctatcatagaattgtataaggaaaccaattttatttagataggtagttctaaatttagtctctgtcttttaactggatctgtgaactctgggcagagcccacactgaatcctgggtctccaaaaagagaactagtatggggctagaccacgtgacgctttcatagtgcactttttttcaaacaaagacatttctctaagtgtctaaactactctctttcttactttaaacaccccagagtaatctctgctacaaataaaaaaatagtcca

SEQ ID NO: 534765 - DNA, 104 bp, Homo sapiens
taagacaggacagaatctaggtcttcctgatgtcccacatacacacgtcctatccatttctaggcatctaaagtagtagagatctatctacatatttgcagtct

SEQ ID NO: 534766 - DNA, 407 bp, Homo sapiens
  misc_feature (348)..(348): n is a, c, g, or t
  misc_feature (383)..(383): n is a, c, g, or t
  misc_feature (407)..(407): n is a, c, g, or t
aaagacctgtaggaaattctaagatgaatcagatagattgtacatcctttatgaaaagctaagacaagttcataagcacctgtactttgccatagaatgggttcagggtctcagaagaagaagccaatatttcttgtcggagaaatcagagaaggcttccttgcaaaggaggcatttcatgagttgtttttactggattcaggactactgatacaaatttgggaagtggttatgggagtagatgaactttttgcaaagaaagttgaggttgctgactccatttgtattctccagggtggacctattcttagtgttgcacacaaacatgttttcattaagggaaatgcnttaagattcttctctgttcagggcatgtgcccacngggattctttctcacacatacatn

SEQ ID NO: 534767 - DNA, 380 bp, Homo sapiens
cctcctacattttatatcaagtatcaaaataggtacatggtaataaaatcaaagagtagacctctggcatagccctgatgtagagttagttgaaacggtcccagcgaaaaacagggaggacaccttgtgctgtgggaccacttatggcataggatagtgtactgagcatgctacgctaaatatacaaacaacataagaacgataaactaccaaccaaacaaaaacacaaaataacagctcgacaccccgaacccccacaaaccaaccaaaaaaaactcagagggttatcatattactatacgagattcattctaacacctagcccctctaccactgaaaaaaataacacgcaataatctacaacaaaaactcctcatctt

SEQ ID NO: 534768 - DNA, 375 bp, Homo sapiens
aaaaaaaccagggggtttttttagggggaatttttttcccgcccccccgggttttccttttttgttgggtgggggggtttaccaaaggccccagtggccccccctttgggaaggcccccctgggggggttttttaagggccgggccattttgccccccccctgggggaaggttttttaagggggaaatggttttttttggccggggccccccatgggccgccggttccctggttgggaagggaaaggttggaacccctttggttatatggtttttttcccttggtttgggttttaaaatttttttccctttccccggcccaaattccccggttttggttttggggatttttgggtttttaattttcctttcccta

SEQ ID NO: 534769 - DNA, 348 bp, Homo sapiens
ccgtgtggacaacgtgtcagcagagagagtctctgatacacagaccatgatgaacccataaggagtggagatcaatacgcgaaggatgtgtggacaggctgcagagacatgacgtgccgatagtgtccgagcatcacgtgtggctccagcccttgtatctgccagtgtagacacctctgtactgacccactgtcctggggtcgctcttgggaggcacaggcatgggtgtgtctggcctcaattctgtatcagtccagtgtgttcctgtcatagtaagtgtctcccaggcaggccatggtaggggcctcgcaggggccatagaggagcacagggtcaggctactcagag

SEQ ID NO: 534770 - DNA, 547 bp, Homo sapiens
gatccccgaggtctcaagaggggtgtcttcagagcccccaggctatctggaaattcagctccagtgagaaggatcttatactctgccgagtttatcaatttcctggtcttgagacctcttccgggacttgtgagtagtatccagctggtagttcgaagtgagtcttaatgccccgtgataccatagtcttgtgatccactcctgggggtcgttcgctcccacagaatgacatagaagagactgatggaagctcgtcagatcatgcgagaaccataccccacgtggtacagctcttccctcctagggtccgtccgcttctgttgtgcggaatgctgtgtggtgtccatctgaatcccctgcatacgactgctggctggtgtgctctcccccctttcccttaatcatggtggcccgtgccttcatgggtagatgtgggagcccgtgtggaggcgttcccccatgtttatgctgccctattctagggggtcattctccttgggtcaagctctttgtctctgtcggagctgttgtggcccttttggctttg

SEQ ID NO: 534771 - DNA, 683 bp, Homo sapiens
  misc_feature (6)..(6): n is a, c, g, or t
  misc_feature (142)..(142): n is a, c, g, or t
  misc_feature (158)..(158): n is a, c, g, or t
  misc_feature (213)..(213): n is a, c, g, or t
  misc_feature (230)..(230): n is a, c, g, or t
  misc_feature (239)..(241): n is a, c, g, or t
  misc_feature (243)..(243): n is a, c, g, or t
  misc_feature (272)..(274): n is a, c, g, or t
  misc_feature (288)..(288): n is a, c, g, or t
  misc_feature (313)..(313): n is a, c, g, or t
  misc_feature (322)..(323): n is a, c, g, or t
  misc_feature (339)..(339): n is a, c, g, or t
  misc_feature (367)..(367): n is a, c, g, or t
  misc_feature (374)..(374): n is a, c, g, or t
  misc_feature (388)..(388): n is a, c, g, or t
  misc_feature (410)..(410): n is a, c, g, or t
  misc_feature (428)..(428): n is a, c, g, or t
  misc_feature (498)..(498): n is a, c, g, or t
  misc_feature (539)..(539): n is a, c, g, or t
  misc_feature (568)..(568): n is a, c, g, or t
  misc_feature (571)..(571): n is a, c, g, or t
  misc_feature (585)..(585): n is a, c, g, or t
  misc_feature (594)..(594): n is a, c, g, or t
  misc_feature (605)..(605): n is a, c, g, or t
  misc_feature (613)..(613): n is a, c, g, or t
  misc_feature (618)..(618): n is a, c, g, or t
  misc_feature (641)..(641): n is a, c, g, or t
ttttcntttcactaccaggtaattttcaaccaataagaaaaaggaaccaacactcagctctgtagaaatctaccttcttttagaaacctcaggcctctgcacccctttagacaactcatttacaaccacaaccttccatggnttctcacatgccagcnagggcagggtaaaaacggcaatttcttacaccgaaaggtcctttttatgtaacanacagacctccccaaacnacaactgtnnngngctattgatgactcgcatgggatcaaatnnntagtgtcccctgantgccccgacaggtctaggacaacanaggttaaannggacagcagggtcgtncaactcccacactgcctcaggtgttttntcaaagnacgacaattctgcnatggggagttacacgtgggaangggtcagactgtgcaggnaccctcagtgctctgcgactaccggctcaatagcttgagctcagaggatcaagtgaagtgtctgtgtcanttttaatctagcacacaagagggacaactgagggggtacanggtattggggcatgcgacaggtcattggnaanagaactgagttagnttaagggtncattaaataantctttgtngttgngtagaaatcacaaaacagttggngaggacaggtctgtaggctcagctttacatccaggtttttat

SEQ ID NO: 534772 - DNA, 318 bp, Homo sapiens
gcacttacaggtgaaaatggtttgttagagagcaaataaataatgcattttagatcattagggagcgggggtgaacaaatgttagacgtgcgtttaagaagttgttgtcagtgaaaaagtcaggctatttgatgagagataattgataagttcaaggaggattttaaatacaaataaagtgtttttcatgtgtttcattgagatgatttgaggtatcagggccaccagaagacaacagagtgggttttggtgagtttctttttctctaggtttaattgaacagtttttttttttttttttaatagggttaacgaacct

SEQ ID NO: 534773 - DNA, 414 bp, Homo sapiens
  misc_feature (162)..(162): n is a, c, g, or t
  misc_feature (295)..(295): n is a, c, g, or t
agtttccacgagttacccctttttagaggtcttttctcccccccggggggggttggggtccccccggataaagggtggggccccttggaccttgtggagtgcccggttttttttccccccggtttgtgggtttccccctgtcgggaaatttttgggtgggtnaaaaaatttttctcagggtcaaaggggcctccccccttgcgagggtgcaaaaaaaattaggggcctttcttgggtttttttcccccttgggggaaagggaagggggacacccaccctttcctttcccccccgnccccaggggccttaatccttttttttttttccccgttttttttaatttaacaaaaagggccctttattccgggcggggatttgggggaaaaaagcctttttaaaactggggttttccca

SEQ ID NO: 534774 - DNA, 102 bp, Homo sapiens
caggcgtgagcacttgggccctgcctgtatttttaatcagccacaaatccagcaacaagctgaggattcacctcataaaacaggcttggtgtcttggtgatc

SEQ ID NO: 534775 - DNA, 402 bp, Homo sapiens
ttcgcactgtgggctcagagacggcttcagttccagtgctctacgtagtgagctcagaagctttcagcttgaagggggggttctcacgtatagactgcttaggaagccagagggtcaggcagaaggcagggctccagcattgcagggcggagggctcactcagctcaacactgcccagctctgagtgaggccagagagttatggcctcccttgcctgtgggtccggggcacaacctagggaccatcctcagagcccccacacctgctgctcacagccagaatgtaggacccgcttagctgctctcagaagagtcctgttcagcaagccgtttaaactcactcctcccataccacccaggccatcgcctcttccattccctgagctacacttgatagttgtaa

SEQ ID NO: 534776 - DNA, 188 bp, Homo sapiens
gacatttcaaaatcaaccttgcttacccactgtgacagggacaaaaaaaaaaaaaaaaaagggcaccctttttcgtgggaaaatccaaaggggtaccttttcaaattttcccccctcaattggaaaggttccagggatctttcaaggcccaaaccttaagttccaccgccctttggaacccccccaag

SEQ ID NO: 534777 - DNA, 143 bp, Homo sapiens
acccaccccacattatattaacccctatttcacccaacaattgggcgaagtcctttttcccccccgggggggggggccccccccctgggagaaaacacctcggcccgcctcggcctctatatacccccccatcatgaacacaa

SEQ ID NO: 534778 - DNA, 155 bp, Homo sapiens
atttggggaaaaaaggagaaatttaaaaaacttttgtctttttaaattcaaaaacggccaatttaaacggttttttttttatcccatcaagctcaaaaattttgaatgtctcattattattattcaaaattaaaagtttcccagcttacccttta

SEQ ID NO: 534779 - DNA, 616 bp, Homo sapiens
  misc_feature (387)..(387): n is a, c, g, or t
  misc_feature (496)..(496): n is a, c, g, or t
  misc_feature (545)..(545): n is a, c, g, or t
tgtggtggctcacacctgcaatttcggcaccttgggaggtgaacgtgagaggatcacttgagcccaggagtttgagaccagcctgggcaacatagtgagaccccatttctacaaaagaaaggtgggaggattgcttaatttcaggagttcaatgctgcagtgcgttatgattgtaccactgcactgcagcctgggcaacgaagcaattctaaaacgagaaaaattttaaaatatatacaacaaacaaattatatattgattgtgtatgttatcagtgaggcttccagtcaacagtaggctactaataattaagctctgagggagtcagttatatgcaggttttttgactgtgtggggagttgacaccccaacccccacactgtacangagtcaactatatacattcaggaatcccaatgaagtccaggtgtggtggctcatgcctgtaatcccagcactctgggaggccaaggcaagcagatcacttgaggtcggnagctcaagaccagcctgggcaacatgggacaatcccatgtccactacanatacaatagcccggcgtggtaatgcacacccgtaatcccagccactaggaaggctgaggcatgagtcctcg

SEQ ID NO: 534780 - DNA, 851 bp, Homo sapiens
  misc_feature (12)..(12): n is a, c, g, or t
  misc_feature (24)..(24): n is a, c, g, or t
  misc_feature (477)..(477): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtcggcaaacgtgaaagaggcatgaatatgngtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcaatgagccccagctatgagccgccccacgagccacacaatgcgccggctcgtggtgggaagattacttggggccaggagttcaagaccaggctgggcaacataacgagaccccatttctacaaaaatttaaacaaacttagccaggcatgatggcacttgcctgtagtcctagctacttgggaggctgagataggatggatcccaaacgg

SEQ ID NO: 534781 - DNA, 193 bp, Homo sapiens
gtgtatggtcgtcgtacttaaaaggagggcccaggcactttctgtatgaacccctgtcatgatcacagtgtcagagcacgcgtcctctttctatggggaagttgaggagtgcccttcaaagccagtagcaggcaggggtgggtaggcaccctccttcctgtatttatctaactacaattgctaacctgcacaa

SEQ ID NO: 534782 - DNA, 716 bp, Homo sapiens
  misc_feature (12)..(12): n is a, c, g, or t
  misc_feature (24)..(24): n is a, c, g, or t
  misc_feature (477)..(477): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtcggcaaacgtgaaagaggcatgaatatgngtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagcgccaccccacgagccccacaaagagccacgcgaggagccccacaatgcgcccccaacgagccacactatgag

SEQ ID NO: 534783 - DNA, 2617 bp, Homo sapiens
aagcagtctcaagcctgccgcagggagaagatggcggtcgccgtgagaactttgcaggaacagctggaaaaggccaaagagagtcttaagaacgtggatgagaacattcgcaagctcaccgggcgggacccgaatgatgtgaggcccatccaagccagattgctggccctttctggtcctggtggaggtagaggacgtggtagtttattgctgaggcgtggattctcagatagtggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccgacgaatatttggcttattgatgggcactcttcagaaatttaaacaagaatccactgttgctactgaaaggcaaaacaggcgccaggaaattgaacaaaaacttgaagtgcaggcggaagaagaaagaaagcaggttgaaaatgaaaggagagaactgtttgaagagaggcgtgctaaacagacagaactgcggcttttagaacagaaggttgagcttgcgcagctgcaagaagaatggaatgaacataatgccaaaataattaaatatataagaactaagacaaagccccatttgttttatattcccggaagaatgtgtccagctacccaaaaactaatagaagagtcacagagaaaaatgaacgctttatttgatggtagacgcatcgaatttgcagaacaaataaataaaatggaggctaggcctagaagacaatcaatgaaggaaaaagagcatcaggtggtgcgtaatgaagaacacaaggcggaacaagaagagggtaaggtggctcagcgagaggaagagttggtggagacaggtaaccagcacaatgatgttgaaatagaggaagcaggagaggaagaggaaaaggaaatagggattgttcatagtgatgcagagaaagagcaggaggaggaggaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgacgaaaaagaagaaaaagaatctgagccccaacctgagcctgtggctcaacctcaggctcagtctcagccccagctccagcttcaatcccagtccgagccacagcctcagctacaacctgagcctgctcaacctcagcttcagtctcagccccagcttcagcttcaatcccagtgccatgcagtactccagtcccatcctccctctcaacctgaggatttgtcattagctgttttacagccaacaccccaagttactcaggagcatgggcattttctacctgagaggaaggattttcctgtagagtctgtaaaactgactgaggtaccagtagacccagtcttgacagtacatccagagagcgagagcgaaaccaatactaggagcaggagtagaggtcgaactagaaatagaaccaccaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagcagcagcagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgatgaaaaaggattacctttccttgtaaagaggatgctgccttaagaattgcatgttgtaaaaaatctttttggaagatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttcaattctgtatcatacattgct

SEQ ID NO: 534784 - DNA, 970 bp, Homo sapiens
  misc_feature (9)..(10): n is a, c, g, or t
  misc_feature (464)..(464): n is a, c, g, or t
  misc_feature (858)..(858): n is a, c, g, or t
ggttttttnntttggcagacgccaccgcggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtcggcaaacgtgaaagaggcatgaatatgngtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534785 - DNA, 951 bp, Homo sapiens
tagtgtgtgccgcggcggcggcgggcatcgtatcgggcggattgacgggcgcctccaccttgctccctccctgtgcttgccggcttcctttttgtctttcttgggcggctgatgagctgcaggttttctttgcgcagcaagctgcggggcgcaacggaggccctgagcttgctagtacactcctacacctgtgacactacgggacagcgacatttgatcaccacggaggcaggaccagagaccacctgtggggacccccagacgtgagatgacatccgcactgatcggtggacagaccagaaaacatatagaaggagcaacagggagaacagcccctgggacaggaaaccagagggtaccaattgacatacatcgtgaatgccacaaaggaggagcgagacaaaatggtggatcataaagatggggcacccccaacgtattcaaatgtgaacacagcctcaggataaaaaaaaccaaactatacaccacctttgtagaaaaggagagatcatgtactataggatatccccacaacaactagatagcacagcagtttccagtacaagaggaacagccataagccctgaacacttttgaggattacctcatcctctaaggagatatgtcatataggactgttcacggtgccacgtggatgctgttaccctagatgagtgacccagtgacacacacaaatcaatgtggagctagggcatcgagaaacgcgcacaaagtgcaacgaagtcagatacgttatcacaaacattagtctccgttttgtgtatggtgtgtgccacacccgcatagaatacgaatgtgttgttgaccttatatggatgcaccaggattggacaacaaaccaccctatgtgaacgcggaagtggtgagtaatcgatacaggacgacaaacgcagggggagaggatgttgtcgacacagcgtgggacaaccc

SEQ ID NO: 534786 - DNA, 241 bp, Homo sapiens
ggttttaacttttccccttggggggggggggggcaccggctccgggacccccccccagtgggggggttccaggggaagcggttttttgggggtttttttggggccccgccccggctcctgggccccccccccccggggggggggggggaaatcagggttcgggggcccgtttttcccggggggcccccccgggaaagaaatttttgtttgaaacaaaaggggggggggtttttttttttta

SEQ ID NO: 534787 - DNA, 645 bp, Homo sapiens
  misc_feature (45)..(45): n is a, c, g, or t
  misc_feature (56)..(56): n is a, c, g, or t
  misc_feature (533)..(533): n is a, c, g, or t
agataaaacacaagtcaaacttattcgagttgtccacagtcagcnatggtgatctncttgcttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534788 - DNA, 771 bp, Homo sapiens
  misc_feature (12)..(12): n is a, c, g, or t
  misc_feature (24)..(24): n is a, c, g, or t
  misc_feature (502)..(502): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagttttgtttcatcctgtcagctgccaaggacttgacgtggtctggatggcaatgcactgtggtgttttggcaaagtgaaatgaaaggcaatgaactattgtatatgngtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttctgtagctcaggagagcacccctccaccccattgctcgcttaactga

SEQ ID NO: 534789 - DNA, 463 bp, Homo sapiens
  misc_feature (12)..(12): n is a, c, g, or t
  misc_feature (24)..(24): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagttttgtcatgcctgctgtcactgtgccatacacaacatgcatgcaagactaccactcacctcttgaa

SEQ ID NO: 534790 - DNA, 575 bp, Homo sapiens
  misc_feature (463)..(463): n is a, c, g, or t
gctctagcaggatctcgaggttgtggcaggcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534791 - DNA, 1127 bp, Homo sapiens
  misc_feature (92)..(92): n is a, c, g, or t
  misc_feature (512)..(512): n is a, c, g, or t
  misc_feature (1015)..(1015): n is a, c, g, or t
cacacttattcgacgtgtcacagtcaggaatggcagaccagcaagaagatcagccatagctgacggtggacaactcggaataagtttgactngtgttttatcttaagccaccagatcattccttctgtagctcaggagagcacccctccaccccatttgctcgcagtatcctagaatctttgtgctctcgctgcagttccctttgggttccatgttttttttgttatttagtttttatttcataatcataaacccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatcccataaagctcatgttaaccagcatctgcgcacggtaggtaagcaatttttctcgatggtacacagtgactaaaagaacagctgtttacccctgatcgtgcagcacgtgctttgccgtgntttcccctttaagcacaattctcttctggcccttcatgctgtttgcagacaaggtcccaaagacagcaggcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 534792 - DNA, 692 bp, Homo sapiens
  misc_feature (42)..(42): n is a, c, g, or t
  misc_feature (48)..(48): n is a, c, g, or t
  misc_feature (444)..(444): n is a, c, g, or t
  misc_feature (450)..(450): n is a, c, g, or t
  misc_feature (453)..(453): n is a, c, g, or t
  misc_feature (469)..(469): n is a, c, g, or t
  misc_feature (532)..(532): n is a, c, g, or t
gaggcattgaggcagccagcgcaggggctttctgctgagggnggcagngccggagcttggaggaaaaaccggcgaggataagttttgtttcctcttgtgggacacagatcaggagatttaaatacagacgttacctcttcaaaaaattattaggtcccaaaattaaggggcctttaactaagggattatgtggcgttaggcgggtttacacgttttttaaaccggctaaacttcttctaaaaattataaggccttttaaaaggaattctcttaaaacggcagcacaaaactctattggcaacaggcacctttagcacacgcaggtcagccaatggaggcacacggccaacacaggcatcacacacaaggggttctttcctttaaaaaaaaaacaaatttggaacggggggcaaggggttctgggcaaggcactcggaaacggcntttccnttnttccaatggggcaagntaacaaaaaacagtggtcatcttcacaacacgacacaattgcgcagacgcaaacagggacttnaacagaaaggccccccccgaaaaatataattaaacccaaatttaaggaaaaggggggccaaatgtgagctatattaaggattctcaaaaacattggagaaagggctgaaacctttaaaacaagggcttttaaaaaggttttaagctttttaaaaaagtta

SEQ ID NO: 534793 - DNA, 1329 bp, Homo sapiens
  misc_feature (12)..(12): n is a, c, g, or t
  misc_feature (24)..(24): n is a, c, g, or t
  misc_feature (1329)..(1329): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtctcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggggggggcgcgccgcacaaaaattctctcccccggggggcgcccccattggcgcgccgcgccccccctttttttgaacagaaggggcgcccccaaaagagaaggaggcaagcttattatgagcacagacgaagcgaagcgcggcgccccggcactattaaacaacagacgcacgaggagcggggaaataacagcctgcggcctcagcgggagcacaacattggggagggagaagcgaccccctaagacgggcggggggggcggagcagaacaacatgatggggccaaacacatcctcctctctgcgcgggtgttttttttgacgacccctccagaggagcggacataatattaaacacctttcaagcagggcttagtataaccgcggggggtacaacacaccacgcgggcaaatataaatgctgcgcggcgcggctcgggaaaaatttttcgctggccgcacggaggagcataatactttcaggaacaaaaattttttcccacgaggggacggcgtcgaagtagn

SEQ ID NO: 534794 - DNA, 2973 bp, Homo sapiens
ctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctgtgtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaa

SEQ ID NO: 534795 - DNA, 1291 bp, Homo sapiens
gcaagtttcagactccgactaactacgctggggactccgaggctgctcagaaaaatgaagcctgaccctggccctgcacccgagtggactgctccaatgatgggcgtgagtgttgcatgtggatgtgtgcccctgccacacattctgctgtgtaactgcaatgccatgtgctctgtgtgctgtgaatgtggctgtgcctgtgatgcctgactcaaatgtgcttgtgcctcctgtgtgcatgtggtgcatgctgacggtgatgctgatgtgtgtgtgaagcatctcctgcatgtgcctgtgatgtcccctgtgatggatgtgccataactttgtgatgcacgtggcctttccaatgtggtcactggatggagactgcctgtgtgcaaatgaccttcttaatgtgatcgctcgtttcctgtgtgctctgcaaatgtgcatgtgctgtcgctccctgaaaccgtgcttgctgaaccccaatgccaaggaacaggatgcctgtgtggctgtgtgtgcctgtgtggcctgtgggtgcctggtgtgtgcctgagctctgtccgaatctttctggcctgagtggctcggcgaagtcgcccccaatcgctcctgtcctggggtgtccgtccatgcccctgtgtggcctgactcctggaacacatggcctgatgctggactcctgtgaaagcatgcccgacgaagggacccctgtgaacgctgtgttgctgctcccggtcacccatgtggcatgttgctgggaattcctgcctgttttgccgctcgatgggcgcactgggctgtgcacgctcgccgcccgtgttgtgctccgccggaccgaacctgatgcagctgtgtcgtgctgttgtcgcgcccgtgtgggcttgcatctcgtgatgggacctccccgtgtccccactgtgccctcgtgggccgcacttgtgtcgacgggcccggacgatcaacggggttggcacgttccaaggaccggcgcctttcacgactgagcttgagagctatggccattgcgcgcctcccatggctgcacgccaagcaccgggggtcaggccccgagttggtaacagctggccgctgtctgcgccccgcagaggtgcaacaccgcgacatcgagcccgcgcacatggccctccaaggtccttgtgtgtcccctgcgacgacccgtccccccccgggcacgctgtcccccaggcagggccacggttggccctcgcagaggacgggcacaatcctccgcaaagggcttcccacctcgccgctgtgaacacgccaattccgggca

SEQ ID NO: 534796 - DNA, 890 bp, Homo sapiens
gtttttcttcttagaaaaaggtggcgaggtgcagtgactcacgcctgtaatgccagcactttgggaggccaaggcacgtggattgcttgagcccaggaatttgagaccagcctgggaaacatggtgaaacctcctctctgcaaaagtacaaaagttagccaggtgtggtggagtacacctgtagtcccagctacttgggaggctgaggtgggaggatcacttgagcctgggaggttgaggctgcagtgagcggtgattaagccattgtactccagcctggacaacagagcgagaccctgccttaaaaaaaaaaaaaaggatccaattaccgggaacacactggaacactgagtgtatttctcaaagcgtgaacatacgcgggtccaaacgtaaaccagtcacccattctggtgaaagcctaaggaatgtccaaatccctgtaaatctgaactacatcactcaactcccgggaagacacagggctctggcccctgtggcccaggctgggacgtgcaagcgggtacaggctccggctcactgggaacctccaatgggtcccaagcagattctttccgggcctaaggcctccctgagtacgcgggggcattcacagggtacaccaccaaagcaagggcccaggactaaaattagggggacgatacaggggctacgaacgacaccaagcggggtttgggccaggggttgggcccagggggccgcacggagataggcgcctaagagagagcccggagagacctcaagacgggggatcccgggcctggccctcgcgacaacgctcgcgaaagaaggagcaggggaagaagtcaccacaggtgatgtagaggcagcacacacgggccccgaagcctcacggcaagtgtgcgccgaga

SEQ ID NO: 534797 - DNA, 173 bp, Homo sapiens
ggcaaactgattatgatcagtgtctagaagtatttgccaatttctatgaaactgtgaacgtaaagaaaggcctgtgagtcataagtacaggagaggaaattaactgcaatatttactgtgcagattctgattcactactgttttgggacaaagcctggttgcttgttccgctg

SEQ ID NO: 534798 - DNA, 383 bp, Homo sapiens
ctgaagcagttttaaaatttcccctcccctttgcagagcggtggggtttttgataaggggccttatttgcggcccactttaacatttgaatttggtattagaaattggagcagcatatcccataccctttttgcagtttttgctgtgtactttgcccctgaaaaaaagtgattcccccaagcttatcccttgctccaagtttagaaatcaggggagaagaattattgaaaagtgtgacccaataatttttgtaaaactttttctccccaattttttgtgatttccccaaacagggcaaaattcctgtgatttgatgtgaaatgaaagcccagcccagtgctgagtgatgagatttgaacggggaataaaatatgcttgaatta

SEQ ID NO: 534799 - DNA, 193 bp, Homo sapiens
ttgttttggaaattttaagtttaggcttattaaaagaatcccccctctcaaaaggggtccgggttagaggattaatttaaagtccccccatttaaatccctcatttttttggcattatttaaaggttttttatttgaaatcccccattcatttttttaacagcgggaaaattaaaaattttcatgatttggga

SEQ ID NO: 534800 - DNA, 206 bp, Homo sapiens
  misc_feature (40)..(40): n is a, c, g, or t
ctcggacccgcctcgtgagactggatcatgttattacacnctttttcaaataaaagtagtacaacagcaggagtgaaagccagtgtaagctatgcactttggatgataatgacgaatccatgtagttcatccttagcaacaaatctatcactctggtgtagaattttgatggtgcaggaggctgtgagtatagagtctcacggaga

SEQ ID NO: 534801 - DNA, 148 bp, Homo sapiens
  misc_feature (50)..(50): n is a, c, g, or t
  misc_feature (89)..(89): n is a, c, g, or t
cttttgaaatttaagccttttttttttaaaaaacaagggtaatagacatntaaaattcccctcctcataaagcttttaaaatggtttcnttggatataggccttaagaaatccctataaaatgccaataaagtttctccaatttgtga

SEQ ID NO: 534802 - DNA, 361 bp, Homo sapiens
aaccacagtggcctcaaagaactcaaatgaaaggaagacttgcaagtctctcactttaagtccagagctagaaatgattaagcttagtgaagatgcagaattttcatagctagagagaagtcaacgcttggcttcaaaacttcaaaggatgggctgactctctttgaggagcactgcagctggtgactttaagttacagccagtgctcattgaccactctgaaaatctcagggcccttaagaattatgcaaaatctattctttctgtgctctagaaatggaacatcactgtctgggtgacagcacatctgttaatagcatggtttactgaatattttaatcccactattgagaactgctca

SEQ ID NO: 534803 - DNA, 162 bp, Homo sapiens
ccccaaggacgggactggggaatttccggggttttcaaaccccaaggttttttttttggggtttttaattttcgaaactgggggcaaaaaaaggggcaaaaaggggcccctttttttatgaaagggggttttggaaccccaaaaattttggttttaaaccca

SEQ ID NO: 534804 - DNA, 536 bp, Homo sapiens
aacgaatgtacccttgtgcatgctgacctcagcgagtataacatgttgtggcatgctgggaaggtctggttgattgacgtcagtcagtcggtagagccaacccatcctcatggcctggagttcttattccgtgactgtaggaatgtttcacagttcttccagaaaggaggagtaacggaagccctcaatgaacgggagctgttcaatgctgtttctggcctgaacatctcggcagacaatgaagctgatttcttagctgagatagaagctttggagaagatgaatgaagatcacattcagaagaacgggaggaaagcagcctcgtttctgaaagatgatggaagcccacctgtgctgtctgccgactagtacagcggtgacggacggcagctgccatagccagcgagtggaggtgacctgacataccaaagcaggagtggacagtgctgcttctgggcttctcacttgtgacccacgtgccagatgtgtgcaatttttaactcggcattgaaagaataaaatgtcactacctctca

SEQ ID NO: 534805 - DNA, 430 bp, Homo sapiens
  misc_feature (93)..(93): n is a, c, g, or t
gtggaagccaagtctattttatgatgatatgatgacatcttctctctggtatcagctaagcaacccaaacaaaagccgtctgccaggcgcacntgaacaagatttgacacaagtgtccacatctttatgatccctgaatgccttggagccagtagagcacacagggatccacatgtaccctgcagcaccattgtgaagtaagtgataatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgt

SEQ ID NO: 534806 - DNA, 402 bp, Homo sapiens
actacaataaatttaaaaggcatctgcatcaccccccaaaaaaatcacatacccattagcagtcactgcccatttactcccaacccttggcagctactattctactttctggtccatatatttgcctattctggacattccatataaatggaaccacacaatatgtggtctcttgtgactggtttctttcatttaggaagtttgaaaggttcatttatatggtagcataatttaatagttctttttttattaccaaataatattccattggtatggatatgccacacttttttatccattcatcagtggataaacattgggtttgtttccattttttggttattatgaataatgctactagcaacattcatttacaacttatgtgcacaactggtcgagatt

SEQ ID NO: 534807 - DNA, 230 bp, Homo sapiens
  misc_feature (44)..(44): n is a, c, g, or t
ccccgggttttttaaaaaaaaaaaaaaaaaaaaaaaaggggggntttttccccctttttttgccggggaaaggggtatttccctttggggggttagggaaattttcctttgggggcctttttaaaaaaagtttttaaaggggggttttttttttaaacccccccccggccccccttttttttaatttggggggccccccccgggggggttaaagtttttttcccccccca

SEQ ID NO: 534808 - DNA, 269 bp, Homo sapiens
  misc_feature (2)..(2): n is a, c, g, or t
  misc_feature (5)..(5): n is a, c, g, or t
anggntgcatgcactccagcctgggcaacaagagtgaaactcagtctcaaaaagaaagaaagaagagaaagaaagctctgcaggtcagctgtaagtaaatgccaggcacggtgtgctcacaccttgtcatcccacgcgctattgggaggctgatggcagcagggcgtgatcactatgacgtccgaggagtttcaccgaccaggcctagggcaacgtaggcaacaacgcctgtactctaacaacaaaatacaaaaatatagccaggtagt

SEQ ID NO: 534809 - DNA, 384 bp, Homo sapiens
acggttagtccttaacaccgtgtgttaaaccggctgtctggtgcggaatctgggatgagagagccttgcctcggctgcaatgactcgaaagctgccgctctcgctccaaccggcgccgctcgggccacccgcagcttcctggcagtcggctcttctttcctcccatccgtcccccgtttctggaccgcagactacgctcctgttccagcccacctactcgtcttctgccccatctgctacccgtctctgaaccaattcgtccccgtcactaccccgtcttgggcatgccctgccgagctcttcctgcctgaatcttcataagatctgcatctgccgcctcatgtccgttggggccccaattccatacgtcctccctatcgtagg

SEQ ID NO: 534810 - DNA, 319 bp, Homo sapiens
aagaacctcatgatgtaagaaattttgactatactgctcgaagctaggacctcgagaatctcccaaacaatttctgcatgatttggtcaggaagaatctacccaagagtccaaatccttcctgtgaaaaagttccagtaggtagatactcgaaatgtagggttagggtaatcaagtctgaagatgatcttctgtagtatgcctacaatcttaacagaagatggcatcaagctcagacctaggagctacttagcccttaccgttagttaaggcagcagttcatcagatacttcatcctatccgatgttgctgatggactc

SEQ ID NO: 534811 - DNA, 1607 bp, Homo sapiens
  misc_feature (587)..(587): n is a, c, g, or t
gtgctattgtaagtcccgactgcattggatttgcaagttatggtacgataaagatgtacttgtaacgaactcccgttagatcatcaccgctagccacagggaaacaatgtataagcttggggacagagatgccttttttcatcattgcctggacgagtaacacatctgagacgcacctcattggtgtgcgcaagtagtatgttatcatcgccttgagctctcacgcttgcgctagcactaatttagtcccatactcgcatctcttggcgcaagagcacttcgcacgcgtcatcacgagagagaggacgagtcctagtggatatttgcaatcaagtcagagaataacctagaaaaaatagaaagtaggagatgaccagagacatgtccacaatcaaccatgctcgtgacatataaggggttggtcaattatagttcgatttatggaagaatgaacctcgacgatcgagtcgttcgcatatacaagtcatagggttatatcagcgtgtgttgccttagagcagtgtgacaccattgcgccagggaagacatcctttatgtaaacagcactcttacctcagtgtgtgtcntgaatgtcggctcgcaaatttcacactagtcgtcggtgtgacaaaatttcgtcgcggggcgctcgcacctttttattgacaagttgggggcacacggatcgaatggtcgcttatcacaaaggcgcgcaattgtgcgcaccaaatgtttatatacacaccacttatatttccccgtggtggccttcgcgctgaggtaaggacctttctttgcggaataatcgaacgtactttcgtggaggacgcatttttgtgtcccctccaaatccatgacctccatataggagacgaattatcctaaccatattggtctcaccgttaaaccttaaaacaaccgttttttccccattccccgttttgggaaggagggggcacaccatatgaaccagacattggagacacccagccgtttatatcccttgcgttgggaagcctacatttaatgtattaaccttttttgctggcacaaatttggagcgggaaggccccacctgtattacatgatcccgaaaaatacacttttgacccggacagttttccctaggaagcccttggatttgctaacgcgaaagatagactcatatcaatctcaccgttgtaaaggcccttatccaaagttcggtttaaccaacattagggggaacttccgcggcgggttacaacgcgcaacctcttcttttttttctcccaatatgctgggcggacattttagcggtgggggcaacaaacatggcaaatatcagatagggttatattattaatccactcggtaccattagacggcataacacaagcggtattggctccctcttccgctgtatttcaaaaggccctaatatgagatacatacggttagggaggcagcactggaaacccaaacccgctattcatgatggcacttccattacaccccctcttgcgatatggttacccaatgcaaacaacaggtcctcgatggcagccacgcgcaaatatctttcattcatgcataaggagcgacactcaacaaagtctttcgggtca

SEQ ID NO: 534812 - DNA, 425 bp, Homo sapiens
tacctcttacctgtaacctaccttatcatgtggcttttaattggcagtcactcgccatttctaagcagatatagtactacctctcagaactcacattggcaagtgtacaaagatgacttaaggtgaagtgacggacaaacatcacacttctgcatactcaccctattttctttctccctttaaggtgctaaacttgcacctcatgtccactcagtaacaagtattgggacgtagagcacagcctcactcagctctgaaaggtaatacaccctgtgaggaagtgagccagcagtgcgccctctgcactctgctcggatcttaagctctgctctcagcagatcccagctgtaaccacttcttaactgtactgaaggtgtgtcctcaagaagaaagtgttcaaattaaaaactctgctgccaagtaaa

SEQ ID NO: 534813 - DNA, 3137 bp, Homo sapiens
  misc_feature (3070)..(3070): n is a, c, g, or t
  misc_feature (3076)..(3076): n is a, c, g, or t
  misc_feature (3092)..(3093): n is a, c, g, or t
  misc_feature (3130)..(3130): n is a, c, g, or t
ctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctgtgtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagtttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactcttaagtgtgtgcttatgatttcactcaatttacttcaggaaattgatgaaatgatagtggtacctatgatatgaaaagattatacatttatatcctggttnactagnagtcaagtggcataannctgtaggaatttggaaaaataaaagatggtgttagtnttctaaa

SEQ ID NO: 534814 - DNA, 282 bp, Homo sapiens
  misc_feature (87)..(87): n is a, c, g, or t
ggggggcccccccccccggtaaaaacagttccaaataaattttttggttcaaggccccgaaaggaaggaagacggtggggccccctnaagtttaattttgggttttccttaaaaaaaatttgctttccttgtttttttttttaaagggaaaggttcaaaaaccatttgggttttttgccccttccccccggattgtaaaacaaattttttttttaaaaccccggggggcagggtcataaggggggagggttttccggggttttttaaaaacccctttggtta

SEQ ID NO: 534815 - DNA, 1328 bp, Homo sapiens
  misc_feature (92)..(92): n is a, c, g, or t
  misc_feature (1328)..(1328): n is a, c, g, or t
cacacttattcgacgtgtcacagtcaggaatggcagaccagcaagaagatcagccatagctgacggtggacaactcggaataagtttgactngtgttttatcttaagccaccagatcattccttctgtagctcaggagagcacccctccaccccatttgctcgcagtatcctagaatctttgtgctctcgctgcagttccctttgggttccatgttttttttgttatttagtttttatttcataatcataaacccgccgaggaaaaccgtgtactattagccatggtcaaccccaccgtgttcttcgacattgccgtcgacggcgagcccttgggccgcgtctcctttgagctgtttgcagacaaggtcccaaagacagcaggcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggggggggcgcgccgcacaaaaattctctcccccggggggcgcccccattggcgcgccgcgccccccctttttttgaacagaaggggcgcccccaaaagagaaggaggcaagcttattatgagcacagacgaagcgaagcgcggcgccccggcactattaaacaacagacgcacgaggagcggggaaataacagcctgcggcctcagcgggagcacaacattggggagggagaagcgaccccctaagacgggcggggggggcggagcagaacaacatgatggggccaaacacatcctcctctctgcgcgggtgttttttttgacgacccctccagaggagcggacataatattaaacacctttcaagcagggcttagtataaccgcggggggtacaacacaccacgcgggcaaatataaatgctgcgcggcgcggctcgggaaaaatttttcgctggccgcacggaggagcataatactttcaggaacaaaaattttttcccacgaggggacggcgtcgaagtagn

SEQ ID NO: 534816 - DNA, 132 bp, Homo sapiens
cacgagggtcacactaacatccatctcctggtaactacatacagtctgagggatgccccagttgactctgttgcttaccatgcccggaatgggcctccagttcctccagagccacatccaaatgttcaggaa

SEQ ID NO: 534817 - DNA, 492 bp, Homo sapiens
gcttccctttgagggtaacccgacctttctctctggctgcccttaacattttttccttcatctcaactttggtgaatctgacaattatgtgtcttggagttgctcttcttgaggagtatctttgtggcgttctctgtatttcctgaatctgaacattggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattctttttttctctaaacttcccttctcgcttcatttcattcatttcatcttccattgctgataccctatcttccagttgatcgcatcggcatcctgaggatactgcattcttcacgtagttctcagagggggggccacggtacaacaattacacaccttatagatgagtc

SEQ ID NO: 534818 - DNA, 404 bp, Homo sapiens
aaaggagcccttttttttttttaaagtttttagtgaaacgcgtataagttttgcaggggcgaattaaaaaagcccattcccctttttttgtacattcaaaacctgaacacccatgtgaaaagggggcccttttttgaaagatgtgaaaccacagtttttttgtaaaaaaaaaaaaaaatctacccgtataggcatatatttatattttgtgttaaggggaaaggggcacatcacagtttgtgaaaaagggatcgccccctttgaaaggaacaaaacgttttcagctgatgtccggggaggtttaaattttgtagagtgttcccccccccgccccgttttgtccctttcacccccctgtttgcccgggcagtagtgggtgcccaaaaaacccctttccctgttta

SEQ ID NO: 534819 - DNA, 865 bp, Homo sapiens
gccgacggacggagcgcccccgcccccgtgcctggactggcgaccgactgccgcgatgcgccttctcagcaagcagtcagctaacgcgactgaagctgcacatcccctggcgaggacgagttccccgacctgaggcgcccacaacaagccagcatggccaaaggtgctgacccccagagactgtactgctgtgagcatgcgcgccaagtgaggcactgcctgaggacggcgttcagcagctaggagcatgagctgtcaagtccaggacatgtgctgtgtgacaagccctgggccaaccctgtacgagtcattagagcacatgtagagagccttgcagattggcctgtgagcgactgagagagaccgtccatagcgggagagtagttgttcaatcgtgagttctcattcagagcacaccaagtacagtcaggaagtgaagccaggccagccgtgactgtggctaaccaaaagcgccgcaggacagaatagaagacaacccagacgagacacctgaatccatcaagagtcaccctagaagcaacaccccagtagcgagaggggacaggagcaggaacaggaagccccattgagaaacccacacgacatacgttagccgggtagccattagaccggccaatccagagcaggagggattaggcggaccaacactagggaggccctaggcaaaggcacagtttcaccaggattaggcacttttcattgacgacttcacccaccacaactaggccaaccattggccacgcaccacggacctgctgttggacaggcctgcccctaagtgacacaagtctagaacagaaaatgcttcggctagtagttgcacaacgagcccccattgtacccc

SEQ ID NO: 534820 - DNA, 198 bp, Homo sapiens
cctctcagcaagagctgagagcagcagcctattagaggattgctgcaagaggaactctcgattctccgcccctggggctcattgctcaggtaaagatggtaaagcctgttgctagtcaagtattgagggtcttgggcgtttttcaataatcttcaaggcttaggaggtaaaggtttaaggaaggattcctaaatggga

SEQ ID NO: 534821 - DNA, 351 bp, Homo sapiens
  misc_feature (2)..(2): n is a, c, g, or t
  misc_feature (66)..(66): n is a, c, g, or t
  misc_feature (107)..(107): n is a, c, g, or t
  misc_feature (110)..(110): n is a, c, g, or t
  misc_feature (127)..(127): n is a, c, g, or t
  misc_feature (132)..(132): n is a, c, g, or t
  misc_feature (147)..(147): n is a, c, g, or t
  misc_feature (153)..(153): n is a, c, g, or t
  misc_feature (169)..(169): n is a, c, g, or t
  misc_feature (199)..(199): n is a, c, g, or t
angtcaatcttaactgacagatctcttctttcttactgggcgagtatttgtaaaataagaaaaacnggaggaaaagagaacaaacaagagagatgtgggatgacggngtnggggaaggagtcacggngaggngagacaatgtctgtngctgtnccctcagcgtctgggngaagagcccaagccctcccattgaactgangcgggaggaaagggccctcctgcggcctaccgcaaggaaacgatcgccgggcagacccgggactagcgccaaaggggcttggaagggcggcgttaagaaaaatgggccgtacctacaacttctttcggcagccctcgctgggcccggggagc

SEQ ID NO: 534822 - DNA, 775 bp, Homo sapiens
gacactctaaagataatgtgcactacactagttttcgtagaactattcatgtgtaggcactcaccttgagaagtaggatttttttttttacttaacgctttggtctcttaaagtattattatatatagttaactgtaaaaacattgagatatattaaaaatattataggacaggtaatacatattcatggtagcaagtgaaataatacaaaggtttatgaataaaaagttactactctcctaggtagccaatgttaccagtcttgcatatccttctgctgctttttctctgctcatacaaacatgaacttactcatgcatacacataggtgtttcaaagttttattctgaatacatcacgaacacaaagtggtataattacatatatcaatgtaatatataaacatgttataaatatgaatataaatgtaaaatgaaccctatttaaacatcactaagcctaagacacagaacattaccaatgagcctgaatattctcatgcgtggccacatctcttttctattccccgtcatagaaatcactccatcccaaattttacgttatttcttttctttacttgggtgcttataatttttaactatgctttactctttggctattaactgtatgtatcatgaattcatggttaagcttctatattttacataagtagtataatttggggattggtatttcattgagttccatattggtagataaatcggtagatgaatttgcagaaatggacttatatcatacgaaagcaaaaatatat

SEQ ID NO: 534823 - DNA, 713 bp, Homo sapiens
tcgcctttaagaaggttttcagggattatacctcaggtatttctgagggtcctatggtctaataggagaaatatcttcccgagctcagaattaaaagttctcctaaattatgaagatcccaaatcttatgtaaataaccttaggcatgagtccttagggagaagttaaggaccatggttaaagggcttttttagaaaaggtggtgctgtatgttctggattggacataaatgaatagacttgggcaaggggaggaaataagttaaaaggcagttaacaagagcctattccctataaggggtataattttcacacagtactcaaagctggttatcttttctgaccattttagtacagaattacgtactggggggttactaacatcaatctggtgactattctagaactaggcgccttagtgtgtttagggggccactttcttctgattgtcagatgcttgcagacctggtactccaaaggcaggccaacagcaggggcgcggggataactgaagcggcgcatggagaggacatccccctcagaggtggggacaaggtgcctctagggcagcggggggaatactattgctcgaaaccggggattttgacttgtgtcaaccagctcttggtggccctatctgttgttgtgtcaatgcgatccgttataaaacatgagtagttgaatttccaaaaacaaaaaaacaacacaaacggg

SEQ ID NO: 534824 - DNA, 401 bp, Homo sapiens
ccggaaattcggccttaatggccggggaaggttgatggaaagactgggggttaggaaaggccgaatgggattaacggggccttggttgaaggccaaaagggaacctgaaggttctttaaacgggttttgtccggggggaagggatcaagttgggcttgccaggaggttaagggggccttaacgttttttggttttttaacctgccaataaaactgttccaggacaccaccttgatttggcttggccatatccaatttagaattaaggtttaattcaggataaggttgggggtttaggaaatggggacctggttggcataattttaggactttaatggccggttttacattgggcttttaaggaagttggccagaagttcccggttggaaaggacagttcct

SEQ ID NO: 534825 - DNA, 466 bp, Homo sapiens
accccatctccactaaaaatgtggtgcctgtaatcccagctattcaggaggctgaaggaggagaatcgattaaaccggggaggtagaggttacagtgaactgagatcacgtcaatgcattcccaccttggcgacagggcaagactcttctcaaaaaaataacaacaaacaacaacaacaacaacaacaaatttaaggaaacaaattcctggttaggaaggaggagaatcgattaaaccggggaggtagaggttacagtgaactgagatcacgtcaatgcattcccaccttggcgacagggcaagactcttctcaaaaaaataacaacaaacaacaacaacaacaacaacaaatttaaggaaacaaattcctggttaggaaggtgggtgaaaaaaaaaatctatacatgtaggcaagcagtttgtgatatgtggactaatattccaaatctcactctagtaccctcg

SEQ ID NO: 534826 - DNA, 801 bp, Homo sapiens
agacaacatcgtgtgtctgtgactaccctatgtcagctccgagtatcatcccgagcttcctgtcgtgggctctgcgtgcaccaggctggctcctgcagtggcactgtggggtcgactgtcttccaaataaaaaactgggtcgggtcataagtgccatcccagccacacattcggactacatgacagatactggcctcgatcactaaaccccagaaaattgctagcaagtgcaattttctcacttgcagtagaaatatgcactttacagagaacaatgaagctatacagacttccagatgttaccaccgacttccaggcttttgagaccaatggacaccaaaagatatcaaagtcagctccgagaattaatcaaacacttacctgaagcagcttcccatctggctccagcatgatggcctgcagcagcgcaagctaccccaactcggctaccctcccccgatacagccaccattcatttgacaacgcaaaagcaagcaagcgaagaagcacccaaagcggaaccacactacgacctgactctaccactgaagacaactcataagcaaccaccctccaacgcgagaacgccacccacccactgctcccacacacgaagcccacaaagcacgccgtacttcccatactacccgccatcccaacgccagcagcaagtgcccctgcctggcacccccaacccacccgacgccggccacacccctaggaccacaaccccgccacaaccaaccgcacagcaccaccacaccccaccacgcgaccaccacaccgccacaccccacccca

SEQ ID NO: 534827 - DNA, 352 bp, Homo sapiens
tacctaaacagaagcaacacacaaacgcatgtctgcagctattgagacacgttccagtattaagttataccagcaaacagtgctgtagtgtctcttttttcctgtcagactatatagtagtattctgcagtcatattcttccttctttaatgtatagaatttttcaaaagatggatttgacacactcaccatttgattcatttccatgcaaaatatatttttgtgctgaaattatgtcaaatggatgtcatatacgggttggtgtgctgccttttgatggctacgtttcggatagagcaatcttcgctgtgaaacagtgtgtatgtgtattttattaggctgactcttacta

SEQ ID NO: 534828 - DNA, 245 bp, Homo sapiens
taacggagctagtcagtcggctgactggagacgtgaccaacctctgaagtctcccttgagtacccatcctaggagtcagtgttgctctagtggctcagtgtgtttctctgcttgtctttctttttagtgattattgccatcggttttaaatggtgcctctaatggtatcgggaactgtgacccaccttttcatccgttctttggcagggcacactgccctgtgtccaataactatcatgacagat

SEQ ID NO: 534829 - DNA, 393 bp, Homo sapiens
  misc_feature (79)..(81): n is a, c, g, or t
  misc_feature (85)..(85): n is a, c, g, or t
  misc_feature (91)..(91): n is a, c, g, or t
  misc_feature (95)..(95): n is a, c, g, or t
  misc_feature (125)..(125): n is a, c, g, or t
  misc_feature (168)..(168): n is a, c, g, or t
  misc_feature (189)..(189): n is a, c, g, or t
  misc_feature (203)..(203): n is a, c, g, or t
  misc_feature (205)..(205): n is a, c, g, or t
  misc_feature (210)..(210): n is a, c, g, or t
  misc_feature (245)..(246): n is a, c, g, or t
  misc_feature (287)..(287): n is a, c, g, or t
  misc_feature (296)..(296): n is a, c, g, or t
  misc_feature (306)..(307): n is a, c, g, or t
  misc_feature (352)..(352): n is a, c, g, or t
  misc_feature (373)..(374): n is a, c, g, or t
gtaacggttgcagtgaaccatgaatgtgccaccgcactccagccagggcagcagagcgagagcctgtcttgaaaaacannncagnacatancatngcagatgactacttaataaaaatatagccnatgatgggcaaatgtatatataacatgaaaattaaaaacactnttatcttatgtatttactgtntaccccagaatcananctacnaggatcaattatcccaggtcaatgttagggttctnnaactgggacaggaggcttctacccaccaggccctggttcgnagtgggcancagcagagtnncctgcaataacttagagtagaacttgaatgcctgaatcaggcatnagagcctgcagctgccatggnnagagctgacccagaccctc

SEQ ID NO: 534830 - DNA, 231 bp, Homo sapiens
  misc_feature (1)..(1): n is a, c, g, or t
ncaattcctcctcctcctatttataatatttatcttgtaatagtatttattgctacccctctccttaaaaatattattagtctgatttttaaaaacaattatatccccccaataatttttttaatttatttagccccaatgatggttgtctttggatatactacagcgatggctattgagcagtatcctgaaacatgggtatcagacgttgaagtcttgatgagtgtttta

SEQ ID NO: 534831 - DNA, 133 bp, Homo sapiens
atctagagatccctccagagcgcatcatagctcactgcagctcgaatcctgcgctcggggatcctcatgctcagtctcctgagtggctgaaactataggtacacaccatcatgcctggctaatttttattgta

SEQ ID NO: 534832 - DNA, 162 bp, Homo sapiens
tgagagaggggcttgctctttaacccaaactggagtgcagtggtctgagcatggttcacttcagcctcaacctcccggcctcaagccatccttctgcctcagcctcccgaatagctgggatctacaagtgtgcaccaacttgcctggcctattttttttttg

SEQ ID NO: 534833 - DNA, 245 bp, Homo sapiens
tatgagactcagctgatctttgtaagcttgttgggagaggcagagtcaagagttgccttactttagagctggtttagtactattcctatgcaatggcctttctggggtttctactgactgcctttggtgttcaccaagatttttccattctggctggtcagatcttaaacctctcctacccctatatgagctctgggaattgcttatcttacagctcccaggcattcgttcccttccttcctcag

SEQ ID NO: 534834 - DNA, 307 bp, Homo sapiens
  misc_feature (10)..(10): n is a, c, g, or t
  misc_feature (20)..(20): n is a, c, g, or t
aatcgcttgnaaccgggganagaggttgcagtgagctgagatcacaccatcgcactccagcctgggcaacagagcaagactccatctcaaaaaaaaaaagaagtactaacttaatacaaaaaaaaaagttccaaattgctaaaaagggatttttttctgattggcctctgaaatttcctttttaaaatttggtggtttctctgacctcctttccagttgttaccttgctgttagggatttctaaagcccccgcccaggaggggaatccttcttagagttcgaccctgcaggctttgcaagctttggc

SEQ ID NO: 534835 - DNA, 102 bp, Homo sapiens
cagtggtatatttgttgttttactgttaatttgacacatctgaaccaaagcattcacaatactagatatacttcctcgtgagccagattctatagcctcaac

SEQ ID NO: 534836 - DNA, 350 bp, Homo sapiens
  misc_feature (144)..(144): n is a, c, g, or t
agctggttgaagaagagcttggaccgtgctcaggagcgcctggccacttgcccttcaaaaagcttggaggaggcttgaaaaggcttccttgttgagagtaagaagaggattgagggttatattgaaacccgggcccttaaaaangtttgagggaaagagtattgggccccccaggaatacccactctcaagagagcgctaacgacacattcaaagagagagacagatagggtgtttagagaggtcgctcataaatgtgagatgcatcattaaggaggactacttgagcagcagcacaggagcgacgatgctgctgctcagcaggaccccctgtcgccgaagatgattgat

SEQ ID NO: 534837 - DNA, 165 bp, Homo sapiens
caagaccagattcgggcgctacatctagagcagtaggtcacgaggtcacccaatacttagatggctttcacctgactcattcaggtaatgtgtcatcaatgaagtcacacaaatgggggccataatagtcagtggccagtaagtgacagttcctcatcctgagga

SEQ ID NO: 534838 - DNA, 454 bp, Homo sapiens
  misc_feature (146)..(146): n is a, c, g, or t
  misc_feature (242)..(242): n is a, c, g, or t
  misc_feature (305)..(305): n is a, c, g, or t
atatagagattgagttaccagagtaactaaatactagactgctgtatttgttggatgtgcagagaaggaaactcaaatatggaacgtggtcttaatgtcttatgaatcatttttacttaacttttaaaattcagattaatagagtnctctaaaaagaaggtttttttgaatttttagaaatagctcagagttttacgtttccctctgtcagaatcttttcaggattcctcattgcctcttcntcagagtcgtttaagaaatatttattagttatcacagtgtcccacagaacaaccacagtcttngctgttaggaagcttatagtctcatgtccattttcaaacttgtatttcaccacttttctctgtacttccccttttttgaccagtctacatttcgtatctgtgggatctgcatttgtgaattcaaccagctgaggatgggaaacacttga

SEQ ID NO: 534839 - DNA, 377 bp, Homo sapiens
cgatgcacggatctgggtagtccacatctttagccccgctacttggaaggctgaggcatgaggactgcttgagcccaggtgttttaaggctgcagtgagctatgatcacactacctgcactgtagcctgagtgacacagtgatgacctatctttaaaaaaaaaaaaaaaaagttttaaatggaaaaataaaatagttttggagcctccagttctgatgccagtttggctcctcagtactgccagtgctggatgtggcagcaaggtgaagcaaaagaaccaagtgacctgagaggagatacacgggaaattaaccatcaagtgacattaactacttcaataatgctatgaggccaggtgcagtggctcacgcttcagc

SEQ ID NO: 534840 - DNA, 444 bp, Homo sapiens
ggcctgggcttttgaccctggatggtctcttcagaacgtgctgcagggtacacacggttttctcacaggccaccttgaggttattggggtgcttgtgtgtccactccaggtgcatggcagcatccaggtccccattgccaacaaagacggcgtccactttgcgaatgtccatccggatgcgttccatcaccacggagccagggggattcctcctccttctgatccccagcacaatcaggtagttgctgccctgcggggcgggctggccggcgctggtgatgaccacggtgtcggggcccatagagtgcagcatgtccatcacccgcaaggcttcctcctggctgtggatcttccggccactcagtaactcggcctcaaactgtttgggcgtgttaatgtctgcaagcgggaccactttttcttggtagacggggaggaggcttt

SEQ ID NO: 534841 - DNA, 984 bp, Homo sapiens
ggaggatccggagtgcgctacctcgcgatcctttcccgatccgatctgtgcatgaacaggacgttctcctgggtctgctgaccggacttacgcccatgaattgtgcttgatgagaagcccaagagatacagtgcagtggcttcttgagcactggatgcctgtactcctggggcatggtcggttctggcgtccagcgagtgctgggtactgaagcagcggtatgtcacgtaagacgtgactcctcgggatgtcatgcgaatgcgcccgcggtctggaccgtagagtgggacggaccctcttagtgcccgactagttgatggcacgttgtcggtgcagttgcagggtgtgcattcgtctcgcgtgtgcgtcgagtcgttgcctgagctctttctccgttcttgcgttccctgcctgcgtgttccatgtgccgtgcaacggagggcacctgtgccccgtccttttgcgggccccctggggcctcgaagtgtatgtctgcacgcagtgcagcgtgcgggcctgacgagcgtacgaagcctgggcgcgtaccttaggctcgctggtgcatagacagctggaccagggtttactttttgtttgttcagtacccccctggacttcccttcctgctgcctttggctgccgccgttcttcgttcggggatgattggagccccggttggcccaggcgatccacctgttttggacttaccttcctgacccgcagagagggagtctggctttggctctctgtgtcgcgagcactaagtctagcttgggagaggcacgtaggttgaccttggccctggggggggtcgggaggggtgaggtggggtgtaaacgataggccaatccccgggaccccgggggggggtgggctccccaggaggcaccttttcgctccctgcggtggcggaaacttggtcgcggggcccccttggggggcggccggtccctcggttcacggtgggaggcccgtaggagaggg

SEQ ID NO: 534842 - DNA, 321 bp, Homo sapiens
taaaaaataaatcaccctaccatgaacacagcagccttccttccaattaataactaacgcaaaaaacgtccgaattaagatacctaatacaatatgtatgacgcatgagtgaacagaaaccatccacctaacagaatcagtcattagataacttgatgtcatggcccagacatcacggaataatgtaaaactgatgggaagaccatttaacagatgacatgtgctatcatggataatcccgtagacattgtcctacatgcactcataatggcctgggaagttatccaacaggaatcccagaattccatgagtacacattca

SEQ ID NO: 534843 - DNA, 339 bp, Homo sapiens
agcccagtgatacagctccaaagagaacaggccagcaatgatgcccacgatggggatggtgggctgggaatactggctcccatctcagggtgagtgggcttgcggcaaaccctcatgctgcacatggcagtgtgtatctcttgctccgtgtccagcaaggcagccaccacagcctgccacacttcttggaagtgttcctatccctctgcatggcctgtgtctcctacgacgctcctgtgtccgtgtggtcttggtcgctcccctatccctgctcgctacgtgctcgtgattggtggggatcctactcagagtctgaccttgcatggcattgcaatgctt

SEQ ID NO: 534844 - DNA, 743 bp, Homo sapiens
gggaacatagggtttttatacaagaatataaagtgaattaagcgtgaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaatttaaacaaaaaaaagtttagccgaccggcccaaaaaaaacctaattgggccaatctaaccaatggggcggaaattccaattaactggcccattgttccaaaaagcgggcgatgacaatatctatggcccgcctattaaaaaaaaaattccggggaaaaccctttttgcaaccaagggtaaaaccccatgggccccccacctttttcccctccccaaaagtgtgccaaaaaagcccggcacaaaaaagattgtacaaccatattggtaaacctaaaaattcccaacgggaaattttttgccctcaaaattctttgtaaaaaacccgcggcccaataattggggaaaaaccccccttatattttaaacaaaatagcgcctctattttggggtaaacgccctttttacacccacatggaagaaacaacccccccttattataaaatgagggggcccccaaacatgcgaacataggggcccaatatctttaaaaaaaaggggagtgaccgccgccactttaggggggaacaaaaaccccgtaaatacaagggtgggggggcgcccactctggtgcccttcttggaggcggtctggct

SEQ ID NO: 534845 - DNA, 524 bp, Homo sapiens
  misc_feature (2)..(2): n is a, c, g, or t
  misc_feature (32)..(32): n is a, c, g, or t
  misc_feature (124)..(124): n is a, c, g, or t
  misc_feature (242)..(242): n is a, c, g, or t
  misc_feature (524)..(524): n is a, c, g, or t
tnacaaggttcgggggcgcttcaagaaaaaancttaccctcagtaccacacaatactaacccttcccctcctctgagggcttacatcacctcccaggagatgaaggggattcggggggggtttnccaagggggcaggtccccagggggaacggttcctaggggacctggtagctaaggcagggccagaccgaccaccttctatctttgagggccaggtacatctttgggatcaggggtttcngggctgggctgagcaggagcgcaatgaatttggcagacaggtggaggtcagggaggcagacttcggggcaaaggtttaccaaggaggggctgctacaggtggtaagggctgataggcattcacaccaaagaagataaccatagcgtggtggggccatgactctctacaatggtaactcaattcaaagggggtgcctaaagctctggaactgggattccaaccaggtgaccgaactcactgaccaggacaggcatgggtatttcaacattaatagcatggcan

SEQ ID NO: 534846 - DNA, 331 bp, Homo sapiens
  misc_feature (3)..(3): n is a, c, g, or t
  misc_feature (33)..(33): n is a, c, g, or t
  misc_feature (282)..(282): n is a, c, g, or t
ttntttttttttgagacagagtctcgctctgtnacccaggctggtgtgcagtggcgtgatctcagctcactgcagcctccgcctcctgcctcagcctcctgagtagctgggaactactggtgcatgccaccacgcccggttaatttttgtatttttattagagacggagtttcaccatattggccaggctggtgccgaactcctgacctcgtgatccgcttgcctcggcctcccaaagtgctgggtttacaggcgtgagccaccgcgcccggctcctttttnaggtttttctacctctcaggctctgccaggcagtcagttccatggaatt

SEQ ID NO: 534847 - DNA, 570 bp, Homo sapiens
gagctggccttccagcagcagctcctgcaaatgcaacagttgcagcagcagcacctgctcaacctgcataggcggggtgcgtggatcagcctgcagcccaaccaaggcctcggggcccctccagacccttccgcaagcagctgtttgcccaacagacctgcatcagttagttgagagaggcgagggtgcccccgggcagactgccgaggacagcgtcaagcaggagagggctggaacctcactggcaacgggcagaacaccagaatacacataggtttgaccagattcgcccacacagagggtgctaagacaaagcagcgatcggtaacaacgaataagcactagaaagagaaaggagagaagacataagtgatggagaacaaaatagtcggggagaagaacaagaagtctatccaacagcggaagggaaagaagacagcgagcaatcacaaaacacaccaatgataggagagaaacaggaagaaggtgacaagagtaacacaagaggaatgagaagaacaaaatgcaggatgaaagaaacatgagagaaaaaggtgaaataaagaaaaa

SEQ ID NO: 534848 - DNA, 488 bp, Homo sapiens
aacggctcatttcagtttggtgattaatcaaagaactaaatctcgaactagcattagacccaacaatcccattacttggtatatacccaaaggaaaataaattgatctgtcaaaaagacatctgcactcttatatttattgcagcactattaacaatagcaaagaaatggaatcaacccaggtgcccatcaatggtggattgaataaagaaactgtagtatgtatacaccatggaatactacgcagccacaaagagaacaaaactatgtcctttgcgtcaacatggatccagctggtggccagtaccctaagtgaactgacgcaggaacaaaaaaccaaataatgcatgatctcatttataagtggaggctaaacattgggtacacatggacacaaagatgggaacaaaaaaacactggtgacttcaaaaggcggaagacaggtgaagggttggaaaactacctatgggtgactatgttcactacttg

SEQ ID NO: 534849 - DNA, 1631 bp, Homo sapiens
gggtcactggcatcccgaaccctcctcctgctgctctggtgtgggccctggcccctgacctggagacctggtgctggctcccactccatgaggtatttctacacctggcatgtcccgtggcctggcctgctggtggagccccgcttcatcttgatgtggtgctacgtggactgacactgcagtatctgtgaggttcgacatgcgacgccgctgatgtcctgagagaggacgcctgtgtggcgcacgtgtgatagatgcagtgacggtggcctgcgatggtactctgtgcgacctgtgatacacatcaagatcttagcaaagtgcccagtgcgacatgagcctgactcggatgaggagccttgtcgggaagcctttgcgctgtgctatcatagcacatcccatgaggctgataggccgggtgttctcactacttttggcacgagagatgttagttggctttgctgaaccataggcgggcctgtgagccttgcggctgcgccttccctccccagctgggggcagtaagcccacgattaaggcctatcgtgacttgtgcacaggggagtttacagttctgcctcgttgaaccagatgtgaccctttgaggcgtcctttggactcgtgcagtgcgagagatcctgcgggctcaatgactcatccccaaggcgcaaatgttgcggaggggctgcgccccgttcgatggctgtgacgcacgcttgaaagaagcctaaccctggaagtgggcaacgttgcggttgaaaggtgggtcccgggaggattatccttgtcatgaaccgtggaaagggagacgctagaagtagcgtctggacaccccagaagaaccagcggtggaccaaacacaccatttttttgaccttgaaggccatccttgagattggttgggacccgtgcggcattttaaaccggtgtggagcattcacatgtaccctggtatgagaatgggacggcacaaatcagggaccttgagctgtgtcgcacaaaccgagggaaataaacgtcacaaacggtaacatgtgaggccatgagacaagagaaaacacactatcccaatgaggtgcaccactgatgagacgtccaacaccacgtaaggtgagcggacaaagcaccgccgatgtagttgcttttttcttcctttgtcgtcttctctctctcgtgcgccaggccgaacgagaagcagaaggacgaggcacggcgaccagagggaacgagcacagcgggagagaagacacaacgacgccaagcgagaacgcaggagacggcagacagacaaggcgcaccggaagacagcagacacagccggaagacgtgagaggagcaaggaaggacgcagagagtgagcacacacgcctacggagagagaagcttccgacgtagaaggaagagcacgagaaaggcggagggagagggaaggggaggcggagggcagcgaggcaacgaacaaggggagggagcacggaggtgcaggagcaaaggacaaagctagcagatgcagcacgcgtaggcgaggcgagaggacagagtccggcagcgacgaggcaggagtgagtaaggagggacagagccaaaggagcataggccggcagaggagccgcgcgcggaagagcgaccgt

SEQ ID NO: 534850 - DNA, 85 bp, Homo sapiens
ctctcttgtaccacagtttcttctgttaatccagtgttacaatcgtgtgaatggcacataacagtttgacaagtacatacaccat

SEQ ID NO: 534851 - DNA, 140 bp, Homo sapiens
  misc_feature (67)..(67): n is a, c, g, or t
ctgcctgggtgctggtcgtctcttgatggatccaccattggcactaagcggatgaggggccctcggncttcttgtaactcactgctggggcactcgtgcccctgcgcgaggtgccagcacaacaatccagaaccggagca

SEQ ID NO: 534852 - DNA, 351 bp, Homo sapiens
  misc_feature (244)..(245): n is a, c, g, or t
atgggccctgttactggctgcgagtggattacagccgtggcgagggcgtctgcagttgttgccccgagcgggtggccgaatgggacgccgcgatcggacgcaaatcgatcgacgaccagttcattgagctgatggacgctctcgatgggtacgatagcccggaagcgatcagtcaacggctcgctgagctccaaggcccgatcagggaactcgcggcggcttgccggcagacggtgctattcanncgagctcaagtcgagttcgagtgaccaaagccgacatcaagctgcggccgatggagggaggttgcctcttcgccgcttggtatctgctgatggaccgcattgcacg

SEQ ID NO: 534853 - DNA, 142 bp, Homo sapiens
taagcgcatggcatgcatgaaggaatcgcagatcagctcagagattgatcttccgcctaccaacgacgagaagaaatgggctcgaccccccatttccatgaactttgaggtgccattcgcgcccgctggcctaaggcacatg

SEQ ID NO: 534854 - DNA, 417 bp, Homo sapiens
atcttttattttaaaaagctgttttaatatatttattatatgcatagtatgatatgagtgtatgtatgtgtgttgtgtatgtatatgtatatgtgtgttgtatatatgtatacacacacatttatgtatgtgaattaatacaaatactctacccaccaaattgtttactcttctgagggagaggagtgacattttgggtggatagtaaaagaagtctctgattttttatttgtatatatgtatacatatcaacaaaaatatatccatgtattgaaatgggattttaggccaggtgcagtggttcatacctatgataatcccagcactttgggatgcgaagacaggtggattgcttgagctcaggagttcaagaccagtctgggcaacatgacaaaaccccatctctacaaaaaaaaa

SEQ ID NO: 534855 - DNA, 184 bp, Homo sapiens
tcttcatctgtcatggaaggcctgaaccccggtaaaccactgttagtccatagagtccaacaatgctgaaaaacttggagtctgatgtttgagggcaggaagcatccagtatgcgagaaacataaaggctggaagaatcagcaagtctgttctttctatcttcttctgcctgctttattctagc

SEQ ID NO: 534856 - DNA, 142 bp, Homo sapiens
ctttatgtttgcagctgcaaacacaccaatgcaataacaatgccaaacacacaatgccagctgcaaacacacaatgcaacacacaatgccaaacacacaatgccagctgcattgtgtgtttggcattgtgtgttgcattgtg

SEQ ID NO: 534857 - DNA, 81 bp, Homo sapiens
ggtttccccccccagggcccgggacagggttttttttgcccaaagggggggcccaataaatgttgttggctggttgcccca

SEQ ID NO: 534858 - DNA, 274 bp, Homo sapiens
cagatgagatgggaaaggcaggcgcggcttcgtgtcagtagttctttgacgtgaagaggggcagcacagtcatttacacttgatccagcctcgttggcatcttacaaagttaagacagctaaagagaattacaataagaaggcaatgcttgtggaatgtacagtacttattggcggcgcacgcctcattacgatgcgcctgcttgcttctcctgttcaatcgtttctttggaaggcagtggatttctctctcacatctcgtctcttctcttgta

SEQ ID NO: 534859 - DNA, 315 bp, Homo sapiens
tggtgtcagtgtcagtctaaatctatgggtgaagcagttagtccataagacaaaaaattatttgcctagtggattccctttacctctttttaagaagctcagagatctgtaatcattaatttactaaggattttttaaaatattattttagtcacttttaaacctgaaaatttctcttttgatttagatttttgaagtgaggcttgagcatacacaagtaacgctgggattttcgttcttcgtgggggttttgccccctcattttttctagcattttgaagaagataaacattttgaactgaagtatataacaaa

SEQ ID NO: 534860 - DNA, 166 bp, Homo sapiens
  misc_feature (117)..(117): n is a, c, g, or t
atattatcggatctaagtacagacgcgaagaatcaaggaaagataaagtactgtgagagatgataccatgggataaaagtccttgagatgtcctgtctattcaaccaccaggcaatntatacgctgcagttttccatgctcagcaacaccgtcgcaaggggtaccg

SEQ ID NO: 534861 - DNA, 429 bp, Homo sapiens
actggttggggatggagaataggatctcactttgttgcccaagccggagtgcagtggcacaatcatgggtcagtgcagcttcatcttcctgggcttatgtaatcctcttgcctcagcctcccaagtagctgggaccacaggtgtgtgtcaccatgaccagctaatttttttttactttttaatttttttagagatggagtctcactgtgttacccaggagttcaagaccagcttgcaacatagcgagaccccacctctacaaaaaatacaaaaatattagccgggtgtggtggtatgtgcctgtagtcccagctactcaggaggctgaagtgggaagggtcacttgagcccaggagtttgaggttacagtgagcaatcgtggcaccactgcactccagcctgggcaacagaacaagatcctgtctctga

SEQ ID NO: 534862 - DNA, 1019 bp, Homo sapiens
ggttttactgggatgataggacggatgagtggattcttcaccaccatgtttcctgttgctcttctctccatcccttcttagggcgggaggagtggacatttattctctagatgacgttcccaaggagatgccagtctgctctgccttacggtgggaaggagagaggaagcccacgtcagctcttatcagcattagaggtgttcaactgatccttccccaccatcttcagaatctgttcctcctggtagcttgacgtggggggtggggatggtggaagtccggtggatgtgtgtgagaggacccagggaatgggggatcgggaggggaaggccgggaggttccaccaatcgtaacaacgtcatggagtgcataagagagagagtgaggcgtgggcgagtcccgatgctgctcttacgggtgcccaacacagcctatctgatgttgagcgggtaagggagagggtccatcgtgtgccttgtggttcagagtctcctgagtctgagtgctactgatggcctggccgagggctgacatgggttatctctgaagtcgagagagctagggccctggggtggacggatgtagtgtggattcttcacgttatggatccagccatctgttgaccattggactggtcatgctagtgggaaggaataatgctattgtctgaccgacatgaactcacctgatgtagtgggccaggcgcatcaagagctgtccggcgtgtaccgggcacgcggtccaggcgcggccaacctcactgcacttctcatcacagcgagccgggggtagaaggggaggcaaacaagagccgaagggtggcaccgggggtggaaaggagaggagaaaggaacaccggcgaaataggagacgagcacaagaggcaacgcctccacgcacgcacgcgcgcacggaggtccgaacgggaccgactcaggatgtgcggaggtccacacgccgcggatgcgggccacatccatccgacaccagtcaacggccgctcacagatcatgagcata

SEQ ID NO: 534863 - DNA, 405 bp, Homo sapiens
cacgagggcagacaagcgaaccagacactcttgatcacacacatgtgtctaccacacagagcaaggagtgtgtgagtgtccttcaatgtgctgatggactacacacatgtgaaggccagggggtgggtgggcgtggaccttcccttcactggacagaactgtcccccagcttagggaccacactctactttcacactggaggtggacagagtcaagctggggggctcaagagaggtcacaggccctcaatctcttgtcctttccctgtctgtaacaaggtgtctggcccgcctttcccaacaacttggttcatatgatataacgtgtgaactgggaacaagcccctgtccgcggtgggccccttaagcaatataacacgcaaggcccctgtcctcttataacggg

SEQ ID NO: 534864 - DNA, 158 bp, Homo sapiens
cacgaggcgcacccgctcctcgaaggcgatcggcgtgagcccccgctggcgcaacagaaattcgtagcgttcccgggagaaccgcccgtcctggtggaaggcttcgatctcctggatcacgctctaacgctggatgatcttgaacatcatacttcttt

SEQ ID NO: 534865 - DNA, 191 bp, Homo sapiens
gtttttggggggccccttaaaaagggggggggcccgttttttttttttaggccccccctggaagcccacgggggtttttttttataaaaaaaaaaaccggcccttttcccccccggggcccccaaaggaaattttttatgggggggtttaccccaaaaaaagggccctgggggtttttttcccccttttta

SEQ ID NO: 534866 - DNA, 376 bp, Homo sapiens
ggtcgtcgctgactgactaacgttttctgaccttcgtcatataccgacagatgacgaacgacgacgtagtgggaaggcacagaaccaccaggtaggtttgaggggatacatcctaagagcaagacccattccagggcagtcggaaaggaacgccgccagggctgtctcttcaaagcatgcaactatcaagaccttgtacttcatcccctgtttggaagacctgatttcctcctggtcttacagatgcgcaagtcgtgccattgcaccaccacgatactgacgaagaaggctgtgtgcgaggtgaactccacgatttccctctgctcataggtccactgcttgccgtagctgtctaccacattgttgatccagtggt

SEQ ID NO: 534867 - DNA, 958 bp, Homo sapiens
aaatacggtggggacgtccggcttcggagcgggagtgtgcgcggtgccagcgactaggaagagaatgcagtatgggtgatgctgatgaacatggcagaagaccagatttgctatatatgcaagtgttcccagtgccatcatccgttcgaaagagtggatggctggcactaatactgggccagatctccgcgattggtcgtctttgggcgcgacagaggcaggtcaggcccctggatactcttacacaggacgactcggaataagtagacaagtggcttcttctggggaggaggatacacggatggcgtatttggcgaatcccgataagtacatccctgaacacaaagtgatcttggtcggaattaaagaaagaggggaagagagggctaggattaaggaggttatcgcgaataatatgctatcgtaagtgagtaattcgttggtgctggatggccttatcttattgacgagaacggtgaactgtctcaatgacgtttgttgatgtgtaccagtgccttttaagtatggattgtcagtacgaccgaggaattgcagaatcatgaatgagtggcagaaatatttttggtgggcagtcggctgatcttagaacctaagagtgcctgtggttagatgagtatgtgcagtttgccgattcttagtagtgacctccaatttcggtaatggtgattcccggttggcccctttatatgattgattcgacttcgtgaggtaatgtcccactgtcaccaccgatggtgagtgcgtcttaaccttacgcgatggtatttgccacgtaatagcgggtgcggactctgaatattggggcttggtcctgttctaacccgcgctcccgggtgggggggtatgcccaaagaagggaaaaaacgaggcgcgaagtggggcagcgcaaaaacgcaaaaggccaaagacggggggaaaaatagcgccccacagcgag

SEQ ID NO: 534868 - DNA, 263 bp, Homo sapiens
  misc_feature (41)..(41): n is a, c, g, or t
  misc_feature (89)..(89): n is a, c, g, or t
  misc_feature (119)..(119): n is a, c, g, or t
  misc_feature (170)..(170): n is a, c, g, or t
  misc_feature (227)..(227): n is a, c, g, or t
  misc_feature (252)..(252): n is a, c, g, or t
ctacggcaactccacagacccagctgcagctccagcaggtngcgctgcagagcaagcactcagcagcagttccagcagcagcagcaggngtcgctacagcagcagcagcagcagcagcnacagcagcagttccaggctcagcagagtgccatgcagcagcagttccaagnagtagtgcagcagcagcagcagcttccagcagcagcagcagcagcagcagcattctnaattgaaattggcattcattcaaanttcaggcaaca

SEQ ID NO: 534869 - DNA, 925 bp, Homo sapiens
gctgactccaaagagggtgtcttgccgctgacggctgcgttccactgccccaatttcattcggcttcactcgcaacgtccgcacggaggcagtgctggtccgactcgggagacgtgcgcggcggccatctccggaggagaaggatttcttgaaaaccgtggaagggagggatgctgcatatgtgtgaagccccaggaggcccccaaggaactcgtcatcccgtttgatccagaatggtcatcgcaggcaggcaccagcccggccctcctggtgccatctcacatgatactggggccttgtgctggatggggtggtgtctccaggcatgtgaaggagctcattgcggaatccaagaagtctctggaagagagagagaagtgcgggtgtcagaccccacgctcgctatccccatgatccagacacaggatgcacccccagcggggaaggggcagacagcgaaaccctggtcagagtacagtgtccagcagcgagagctaacttatgaggcgagtccccgtggagtgcctatggtgctggaccatgctgcggcggcatgggctggaaacctggcgagggcatcgggcgaaccttcaatcaagtagtgaagccccgtgtcaactcgactgaggcccaaggggttagggctgggtgccaacctgaccgaggaccaggccttgagccccaatggccccgtcccgccatgccaagaccagatgaggcagcacggagaaaggataaggaaagatcaggctctagggctgggtgcctgggaggagcctgatggtggattctttctggccctcaccgagggcctctatgggaaaggttggcaagtgcctttgatccctgacgatgatcgggccatgggttcaggactggcatgagggggaaccagggatgggagactgttaagattgaagtacta

SEQ ID NO: 534870 - DNA, 94 bp, Homo sapiens
tcaagcttctaacgatgtacggggacatggataatttttgttcttcccctgtgtgatttttgccatcaaaataaaaatttgagactcgtaaaaa

SEQ ID NO: 534871 - DNA, 424 bp, Homo sapiens
atttttgtatttttagtagagatggggttttgccatgttggccaggctggtctgaaactcctggcctcatgtgatctgcccgccttagcctccttacatgcgtgagccactgagcctggccaaaatattgtctaattattcatcattctgtagtgttgagtaaatgtaacttttttgtgtctatattatgtagttttgagtaaatgtaactttttttgtctgtgtctttggacacttgtagccaaaaagaggaagaagaacaggaggcatacagggtattttaaggtctagattgaacctggaccttggaactgcttcctaggtgttgcaaatgggtaagaaacatatgtaacaaacctgcacgttgtgcacatgtaccctaaaacttaaagtataatagtaaaaataataaaaaaaagatcaa

SEQ ID NO: 534872 - DNA, 140 bp, Homo sapiens
  misc_feature (97)..(97): n is a, c, g, or t
gcggccgcctactactactactactgctcgaattcaagcttctaacgatgtacggggacatgaaccaccacgcccagccaaagttaaactattattnctgtgtcagaatctgtattaaatgtgacttgtcaagcaaaaaa

SEQ ID NO: 534873 - DNA, 209 bp, Homo sapiens
tggtcgcagtcgtacttgtgcataccgatgtgatctctcatggattacgccagatcttgtgatggtgtacggccctgtcttggcccgtttgtatggtctgctccttcacgttcgtcggtatttcaatttcacacctagtggggacgctgcttcgatggggtactgtcgactgtgacaggcccttcccgggagcttgcatgcgagccatg

SEQ ID NO: 534874 - DNA, 137 bp, Homo sapiens
acgatcaccagagaataatgtgggcttccagagctcaggccttcacagctagccatactaggtgttggacccctggaaccactttatagcactctatgttcttagtactacattacctttagactaccaccgcgact

SEQ ID NO: 534875 - DNA, 113 bp, Homo sapiens
ccagtcttttctaccattcttgatattctctgagcatagcctagtgtttcagttcatatttaatgatacttaaatcgtgggaattttaatagttagttccaacaataagcaga

SEQ ID NO: 534876 - DNA, 137 bp, Homo sapiens
actctcagcaggcatccccccatgctctcctcccgtggctcccctgttcacaggctttcaacagtggcctccattcccacattcaccagtggccctcgcacacagcagtccgtgtcattgttcatttttctgtccac

SEQ ID NO: 534877 - DNA, 435 bp, Homo sapiens
gactgactgccatggatgccataaggtacaccatttacgagtacggagccctcaccattgatggggagtactacatccccttcaagcagtatgctggcaaatacgtctctttgtcatcgtgtgccagctactgtaagcctgacgggacagtacattgaactgaatgcactacaggaagagcttgcaccattcggtctggtcattctggtcttctgttggaaacaatttggaaaacaggaaccaggagagaactcagagatccttcctaccctcaagtatgtccgaccaggtggaggctttgtccctaatttccagctctttgagaaaggggatgtcaatggagagaaagagcagaaatcctacactttcctaaagaactcctgtcctcccacctcggagcccctgggtccatctgacccatcttggggatcctct

SEQ ID NO: 534878 - DNA, 347 bp, Homo sapiens
ttgagatgtcagcttaccccagttaaaatggcttttatcaaaacaacaggcaataacggatgctggtgaggatgtggagaaaggggaacccttgtacactgttggtgggaatgtaaattagtacagtcactatggagaacagtatggcgtttcttcataaatctagaactaccatatgatccagcaattccactactgagtgtatatccaaaagaaagaaaatcagtatacgaaagaggtatctgcactctcatgtttgttgcagcactactcacaatagctcaaatatggaatccaaagtgctcatccaacggatggaataggtaaaggaaaatgtgggatgtggg

SEQ ID NO: 534879 - DNA, 2405 bp, Homo sapiens
  misc_feature (2082)..(2082): n is a, c, g, or t
  misc_feature (2134)..(2134): n is a, c, g, or t
  misc_feature (2145)..(2145): n is a, c, g, or t
cctgacaagcgtccgagaacgagcacaaaagaaacgaaagatccacacgcccaaacacaaaaaaaaaaacaaaaaaagagccggcagacgcgataagcgcaccacgacaagcaccagacgcagaagaggacgacgccagacgtttttacagccacgagaagccgccaccgatgacggcgcgcgacgcacgacgggcggcgcagagtagcacacgaggaccagcaggaacagaaaggacgacgagacgagcaagagcacgagcgcgacagcgcacagcacgagcggatgaacgcacgacaggtggcagaagaagacagagagaaaagatgaggagagacgacaagcggaagaagagagagaagacgaggagacgaagggaagaggagaagaagagagaaggagaggggggagagaaaaggagaaaaggagagagagaacaggaggcgaaacagggctcgagagaggagaagaggagcgaaaggagaggaaagaggaacgagtacgaacggcgggccgagtacgagagacccgagagccgagcgtagagcaagcgaagagatcgaaacagaaaggaagaaaggagaaccgaagccagaaggcggaagcggaggcggcacacagcagaggcgtcataaatgagagaatcgaaacacaccaccgcaaagtagagcgagaatgcgggaggccaagaaaagaaagagaggagaggagagcgcaaagcggcgtgacggggcgaacggccagcggagcgcggagacgcacaggggcgggagaggtaagaggtagaacgcggagagagagtgggtacggaaagggaagaggaggagagagagacgggcgcagagaagaagagcaggtgagcaagaggggggaacgtcagaacggaagagtcagcgacgacgcgcggaggagcggagaacgggaggccgccgcggcaggcacacggcggaggagcgacgggctggcgcaagcagagggacgggagaccagagggagggagagcgaggaagcgagaaagcgcggaggcaaagcaagagacagaagagcagtgagcagagagcgagggggcggagcgagcaggcaggggggcgaccggacgaagcagaggggggcgaagaggaaggagagcgggtgagaggaagaagcacgcagagaaggcggcgtcagggtagggatagaaggagatcaaagcacgtagacaagtacagaaaggtaggcaggaggagagtacgacgggacgacgtatagcaagatggagagggccagtgcagagcgcaaggcgtggcacgtgaagaggaaagagcgcgaaggaggaggaggcgagcgagcgagcagggagcggcgtgcagcggcactgaagcgaggcagacagaagacgagaggcggcagggtaggaaggagaggaggcgggagcgaacgagacgagaacgcagagcggagagagagacgggagcagagagcgaagagagcggagcagaaagcagcggacagagaggtgtgcaggacgcgggcgagcaggcgatcagagcgaagtgagagacggcggacaggcagccgtatgaatgcaccgagcgtgacgccgcgacagacgtgcagcgtgcatgcgatgaaggcgcgcgcagcaacagagtggcagatacgaatgcgcgacaggtcgacaggcgaggacgagtggaagggaggacgagcggcgcgagcagcgcgacgggctcggtacccgctagagcacgacagggtgcgagcggtcaacggagcaggaggggacgagcgatggacgagagagcgaggaggcgcgaagacgtgggcagacgtgagagaggggcgaagcgcatgaagcgcacacagagcgcgtcgaagtgtccgcgtgagtgctagtagaggcgcgcgcgggagcaggagcgcggcggcgcgcggaggcgtgcgcgtagatagcggatcggggaggcgcgcgacgcgcgcggctgtcagcggggcgcgtaggcagcgagcgagacgagtaggtcgatagacgagctgcatcgacagcgagagtacgctgaggctgcggtgcgggtccgcttagtgactctgcaggagatcgancgcgagggactgaagtagcgtgaatcagtcgtgagagcagagcgcgcgcggnatcgacggagngtctctgcgacgagctacacagcatgcatgcagctgaaggacgacagcagatgagggtagaagggcgaggactgatgcgtcgactggccgtcgcgcgagacagagaggcgagcacgtaccgatgcgatcgtgatagacacgacgcaacgagtagaccgagcggcagagcgagtgcagcggagacgagtccgagcagacgagcgacgaggagtcacgcgacggcgtggcgtgcaccgcggcagcggagcgtgcaggagctc

SEQ ID NO: 534880 - DNA, 484 bp, Homo sapiens
atctcatgaaacagacatatactactctgattaaagccaccaacttattgtggttatgcaatctctacgattgagcatatcgtctgctgcctatcattgtatttgtctattcatgctggagtttacttctttctcagcacatattccagaatttagctgtatgcaatgctgtcttcccaatttatagtcagtacccctctttggtcgctagtagaacccccctgctgtaatcccagcacttgggaaggctgaggcgagcagatcacctgaggtctggagttggcgaccagcctgaccaacatggagaaaccctatctctactgaaaatacaaaattagccgggtgtggtggcgcattcctgtaatcccagctacttgggaggctgaggcaggagaattgcttgaacccgggaggcagaggttgtggtgagccgagatcacaccattgcactccagcctgggcaacaagagcgaaaactctgtct

SEQ ID NO: 534881 - DNA, 105 bp, Homo sapiens
atctaacactcatggcagagttcttctattctctcttattttttggaaagcggaggtcccgctctgtgtagcccaggctgagagtacagtggcacaagtcatcga

SEQ ID NO: 534882 - DNA, 137 bp, Homo sapiens
aatagctgaccaggctttgtccagtgccaactcagaggtgggcacatcctgcgtactgcatcacgtgcagaagctggcaggccctgtgaccccagtggagaccatcctgcagcgctgcaacctggaggagatttcca

SEQ ID NO: 534883 - DNA, 116 bp, Homo sapiens
aatagtgtcttcacagcatcagctgaatgaatacttttatgagtccgtgtatgggctgatgatcttcaatcttgatcctccacctatttcaagcatacaactttatcataactccc

SEQ ID NO: 534884 - DNA, 391 bp, Homo sapiens
  misc_feature (153)..(153): n is a, c, g, or t
ctaatctatcagcagaatattcttggacaatatattgggaagttcaagctatcaggacaatacagctcttatagtcccccagcattgactactaagcatagcgggcgctatgcttgcacatagttccgtgactcagcaacatgccatgtgaangctcctaatccataacagtcatagtctctgctccttcaggaacagtacatcttcctggccttaatccattatagcaggcgtgatgtggaaactgcctttcagggaagactggcagacagttgcttacattcttcctcaaagtatttaccatcagctacagtccaaaattgctttttgttcaaggagatttatgaaaagactctgacaaggactcttgaatacaagttcctgatagatt

SEQ ID NO: 534885 - DNA, 156 bp, Homo sapiens
ccccccccggaagcttaaggggttttttttccccctgttttcagccgccctataaagactgggggtttgggggccagggtctcccgttatgggcccaaagggggtgaaaaaacaggggctgggatatttggccaaaaaaaaagttttttttttcta

SEQ ID NO: 534886 - DNA, 142 bp, Homo sapiens
  misc_feature (22)..(22): n is a, c, g, or t
ccagacacgtcacaacaaaaanaaaaaaaaggggaaaaagaccctgcagatgtcgggccgacttttatatttttagggttttccctcaatggctgtctgaattttctcacccttccccttggtgttaggactcgtcaccgtg

SEQ ID NO: 534887 - DNA, 326 bp, Homo sapiens
  misc_feature (34)..(34): n is a, c, g, or t
  misc_feature (54)..(54): n is a, c, g, or t
  misc_feature (147)..(147): n is a, c, g, or t
  misc_feature (161)..(161): n is a, c, g, or t
  misc_feature (202)..(202): n is a, c, g, or t
  misc_feature (230)..(230): n is a, c, g, or t
  misc_feature (247)..(247): n is a, c, g, or t
  misc_feature (276)..(276): n is a, c, g, or t
  misc_feature (283)..(283): n is a, c, g, or t
tacaggcatgagccaccacacccggcctgagggngtatcttgactcacctgctnggaccttcaaataatctttcctgtgcctcagttacttcataggttcgctgagaggattaactggtgctaatccatgtaaaacactgaaaaggngcatagcatgtagngagcaggtgctaggtattattactgatgctcttaattaagngaggtaaggaggggagagatggagtggnagaacccagcatcttgngaacatcagaccacagaaaaggcagcacncctgatncctgtgcttagcctaggaactaaggctttgaaatggctctgaa

SEQ ID NO: 534888 - DNA, 648 bp, Homo sapiens
taagtaaaaacaggtttcaccgtgtttagccaggatggtctcgtcctgactttgtgatccgcccgcctcggcctcccaaagtgcgtgggattacaggcgttaagccaccacacctgtggccccggcacgttatcttttataaggaaagtgacaccagttctccgtggctttcgtgaccaaagaaaaaaagtgtcacgaggagaactttgaagaaggcaggacaggaagggtgtggtgtggcagcaaacacactgtgcaagacgtgctatctctgtggaattgtggtgcagtggggtgtgctctctctcgcggaaaggcgggtgtggtgaacacaggccgccacttatccaacaagtgtagacgagggcgcccgtgggctctcccgcggtggtgtgtcctctcacacttctcagaggtgtgtgtgtccaccctgtggtgcagtgtgttgtggacacacgccaagaccatttgtgggggggcgagaggaaacaccgagtctttcctagaagagaggtgctatatcccagagagctctcaagacgtgtctgtggggacaggggaaagccccgaggggggtaattttttttacccaagggcccccaaaataagaggttgggtggtgtgttttacacagacaaaaaacaagcc

SEQ ID NO: 534889 - DNA, 547 bp, Homo sapiens
  misc_feature (172)..(172): n is a, c, g, or t
  misc_feature (355)..(355): n is a, c, g, or t
  misc_feature (392)..(392): n is a, c, g, or t
  misc_feature (473)..(473): n is a, c, g, or t
  misc_feature (492)..(492): n is a, c, g, or t
  misc_feature (495)..(495): n is a, c, g, or t
  misc_feature (500)..(500): n is a, c, g, or t
  misc_feature (505)..(506): n is a, c, g, or t
  misc_feature (531)..(531): n is a, c, g, or t
  misc_feature (541)..(541): n is a, c, g, or t
ggaagcaggggctgggggagcttgggccgcggcgggtgatgctaggcgcgtgggcgaggtggtagcctagatggagaaggagtttggggcgtgggcaagagaaagagtgagggtctaggggaatgctgggccccttcaatgttagatccggagttggattgggggggtcatntaggcctcctcccaacctccaagggtcctacagatgaggaaacaggttcagtgtgagctctggcagaggccccgaagagagggataggaaggggccaggagaaccagagctagttgtgaccatggaagccgaggggtcaacgcaagggccagacgttccaagggaaaggaatggactcatcanactcttaagatttgttaggacgcttgagtttccgagnattggggggaacaggattagtttggccctaagagttggtttggtatgtcaactcatgcacgtttgttggtaggagggtaanatctggttgggatagggtntgntggancctannttccaagtaatgaaaattcaattanttgcagacangccttg

SEQ ID NO: 534890 - DNA, 362 bp, Homo sapiens
gagacaatttcatgcttggttatctttaagctctctggaaaaaaaaaaaaaaaaaaaaaaaaaaaaaccagatggaaagacagggttgcgcgggggctaatgcctgaaatcccagcactttaggagggtgaggcggccagatcacctaaggtcaggagttaaagaccagcctggttaagggggggaacccgggtttactaaaaatataaaaattagctgggtgtgggggctggcgcctgaaatcctagctacttggaaggctgtggcaggagaatcgttggaaccctgaaggcgaaggttgcagtgagccaagattgcgccattgcactcaagcctgggtgacaggagtaagactttgtccc

SEQ ID NO: 534891 - DNA, 151 bp, Homo sapiens
  misc_feature (26)..(26): n is a, c, g, or t
  misc_feature (52)..(52): n is a, c, g, or t
  misc_feature (60)..(60): n is a, c, g, or t
  misc_feature (130)..(131): n is a, c, g, or t
ctcaaatgtcagcataagaatgctgnttcggcctttcgagaactattctgtntcaatttntggtataaatattcattttttaggatacaatagtaggaaactaattttttacctatcctgtgtccttacnnttgacaaaataagaatgcca

SEQ ID NO: 534892 - DNA, 331 bp, Homo sapiens
aagcagtaggtgctagttattgatacagggggattgtctagagtacagctcgagtggatcgcgcttgtgaacaggtcgtgcggaatgatgcgccgtgagtgggaataaacctggcgacagccagcgccaatggctcagcgattgccccgctcattggcaaacgcacttaccgcttgtactgcttcgccggtgccttcgagaatctgcaggatcaccgtgccggcctggttggccagctccacaccttgggcggcgcggtcgctggtggcgtccatgctgtcgatggcttggcgggtttcgtcctggatcatggcgatcatgcgccgcgcag

SEQ ID NO: 534893 - DNA, 1228 bp, Homo sapiens
ggcagcatgtcggcaacagcggctgctcgtaagcggggaaacgccggcctctggggccggggctggcgcgggggcctggcaagcggcggcgaaaggccgactctgctggggtgacagtgggcaaatccaacgggtggcggcaagactgacactgaggagactctccaggcgacctctgacgacgcgacgacgcctagactccaacggacacggcctgaggacggacggaggacggacggacgctgcgaggacacactggcagcaggaccaacgacagctgcgccttgggcgcaaggagcctctaacgccgtacgaacggcacgacgtaccgattgcagcgcacacgaccggaacgggaacgacacgggcgtgaacggggcccaccgaggggacatatgagagacgagaggacgaccaccagctggtgacgacgtgaggaagaccatataggcaagggcgacgagcactggtaagctatagagcgccagcagaccgattggggcaacggtgacagtagacgacgagacacagcatcggcgcgtggggcccaacacaaggaaagccacttcccaaggcgacaaccccaccaatgtgggacatgcacaagccgctaggaaacacagtgacggcacagatacagcacaaccggggagggatcgacaacaccaaggacgatcgtcacgtaagctcacaagcaaattggcgtgcacgggcgatgcggagtagcagagccaccgctaccggggacgtggagacccgctcccacaggcagccaagtgacggatagcgatgtcagttgcgacgctagccccccaacaacagcgcacccttgggcgcaagacaacagtcacaggtatccaacgcgttggagcaaaggccaagcatagagggcagagacaggcatgcggcaacagtggaaaaagggcactgggccaacagatggagcggcaggcatacacaggtccgcgaagaagctcaaacagagagaacacggagagtatagcgcccgaggaggagcaggacacacaggacacccacgacgggggaggccgccacaggaggaccagagaccaccaccggcaggacggagcgatgcgacaagtgagacccagaagtccgccgcataccccgagacgaggaggcaaaagcaggagacagccccagagagggagcccgaacaatgcgtgagaggaccaccacggagcacaaaggaccaacagagcagcca

SEQ ID NO: 534894 - DNA, 230 bp, Homo sapiens
cccgccgtcattggatccaggtgaggggtctcctatgtaaagggccttctggagccttccacagttaggaagagctcagacactggtggccgcacccccatcccctcaccaaactggcttctgaagtaaaagaagacagggcaaggtggttataaaccaaaccccatcttgtctagacttttttcttcctgtataataaatatgtgcatatacagtagaatatgtagtac

SEQ ID NO: 534895 - DNA, 759 bp, Homo sapiens
ccttgcgcgagaaacaaaaattacgttattttcgttgccccatacactaccttgatgggcgagcaagaaaaagttatacttttaaccatgacgggaaatcgtgcacatccacgctggctcagtgcttggcaaccagatcggtgccaagttctgggaggtgatcagtgatgagaccatggcatcgaccccaccggcacctaccacggtgggacgagcgatccgtgcagcgtggcactcgcatctctgtgtactacagagtgaatgcctctgcgttggtcccattatgttcctcgtgccatcctgtgctggatctagaacctgggaccctgcgactctgttcgctcaggtccttttggcccagatctttagaaccagaccaactttgtatttgcgtcagtctggtgcgcaggtatacagatctgcggcccgaaggcctactactacagcagggcgccgcatgctgtgtttgattctggtcctgggatgttggtaccgcagagcgagcgcctgaggagctgtcgatctcgcgctgcagggtcttccatgcgtggacccatcgtcactgggcgggggtgcgcagagctctggtacatgggcacctctccttatcagcaagatccgaggaagaataccctggaatcgctgtccctgaataccttcagtcgtggtgccttcagccacagtgtcttgaccccggggtcgagccctaaaatgcaccctcttcggccagtcagcggacaggatctgttggccctttgc

SEQ ID NO: 534896 - DNA, 875 bp, Homo sapiens
ctacgggcggcgcctgcggttcctcctggccccaaggcagcgctgcaggcgcctgcggtccctgctgaccctgtggcaccgctgccgacccctgctggcgtgggccagcccgtgtcactgtggccatgcccggtagggccatcctcaggacagcgcagccggccccgtgtggtcgctgctagcccagtgccagcggtaccatgcccccgcgggcactcctcaccctccgaccacgcctgactggccgcctagcttcctcccaggacagtgctgctgcccccgtgcgggccttcctagccccgtgtcagtacggccagccccgaaggtccctgctgggcagccagccgccccggtggtcgctgctggccccaggcagcccagcggttagtggaagccacagagcagaccgggccacgtcacgccttcactcctgggcccgggacggcgaggcgagcagaagcagccgctcatgggcccggagcagcctgcccacccaagcggcgctcatgggcccagagcagcctgccagcccctgcggcgctcatgggccccaacaagccctgaaacccagcgtcgctccccattcccgatcgccttcactcctggggcagcgggccaccctgcggctcttctggtgctcctgtgcagccgtggggtcctaatggatctggtgcggccgtaagccggtctcgctactgggcctgggcatcttgcggccctgcggtccggggaccgacctgttcccggatgcagaggcatctgtacctgagctgtgctgagcctccattggttcgccccggtgttgctggggcacggacaggatcctcgggaagttggaacgagctaaggggtttagaaggcaggggcaggggaag

SEQ ID NO: 534897 - DNA, 300 bp, Homo sapiens
tccccatcagtttctcaagacagcaggtagaagcggtccgtcctcctcgaacaactcaatcagctctacgtgacgttcctgtgtcccttggactggttcagcatatcctacctcccttaaaaccctgacttccgaatgtggcctggctgcttctcaattatcttgatggcttactcctagctggtgatcaggttgatcgcatggtctgtcacttcaggcatgaagctgcgctcccctcagcacactcttctctgcagcgtggttgaccgttttcaataccttgccgcgagagagctcgtg

SEQ ID NO: 534898 - DNA, 518 bp, Homo sapiens
  misc_feature (470)..(470): n is a, c, g, or t
  misc_feature (476)..(477): n is a, c, g, or t
caacttgggtcttgttgcaatagtctacatatgatgaaaaaacacctggtggtagttttcctcttctctgaaagcaatggctagcatttatggagtattactattgctaggcactgtacgaagcactgcgccaatgtgatcacatttaatactcatcacgacccttcaaggtagtgactattcttgctattatctttaggccagaaactgaagagaaacataagatgacttgctcactgttccctcaagtaaatagactctcatctggctgaccccaacgtgtctgctcctcacagtccttgcctgcctcttgtctgcatcaaatggtcttattctctgtagacataacccttggacaccccagaagagaaacggagttattaccacctcagctcagttctggcacacacccctaaagctttaggcagctttttaatgcatgacaactacgaataacaggacaaggcagnctttgnncccacatgtcagagatcctgtattattctttactgcatttg

SEQ ID NO: 534899 - DNA, 490 bp, Homo sapiens
  misc_feature (111)..(111): n is a, c, g, or t
gcttgccttagcccatctgaacccagtaaggaaaaaggtcaagagttagaacctatagagaaaactgatagctcccaatttatccccatgaaaaatagtaaagatgaagcnagcaaagaaaaaatactctgtgaagtaagaagtccgtatggaaagtcacctaggaagcccaagataacagagtgtgtttaataggcaaattatcccggcccggcccaggcgcagtggctctcaccctataatccccaaaactttgggaggtggaggcgggcagatcacttgagccccaggagttcgagatctgcctagccaacataatggaaccccgcctctataaagaaatacaaaaattagctggcatggtgttgtgtgcctatagtcccagctactctgagagagcgttgcttgaaccctagaggttgagattgcagtgagccaggatcacgccactgcactccagcctgggtgacagactgagaccctgtcttaa

SEQ ID NO: 534900 - DNA, 759 bp, Homo sapiens
  misc_feature (191)..(191): n is a, c, g, or t
  misc_feature (379)..(379): n is a, c, g, or t
  misc_feature (383)..(383): n is a, c, g, or t
  misc_feature (451)..(451): n is a, c, g, or t
  misc_feature (477)..(477): n is a, c, g, or t
acgcctttttcgggtggttggggggcgctaatgtcgttttattatgtcttacggaggagaacatactgtgatcacaccctgaactggtggacgcccttctgatacttatatgttcatgggtcgcaagtgagatccgcacggaccgcttttacgcaacctggtaacagttatgttaggaggggcgggcagtnactataatgccggtgacccgccacatcggcgactacctaatcctgggaatttacctacttagagaagtgactgatcaaatcgctctgccaggttggaacattagggggggagtcgtggagggtccaacttgccaacatatagcggatgtcaatgcctatgcgatatttgcaatcttaagtattcatgnaacnatgggggtaatcctcagtgaaggagcctttcttatacagcgggttcgctgatgcctttttctgttgcngaaatataggcgccctctaaggggcnttgttgctataaaggagtgcacataggcggccatactaataagtgtgcggcttaactcgcaggttgtacctacaaaaacgacctttttggcccaataatagaaaaacctaccggagattggggcttggggttatgggatcgtgcagggggtaaatgggatatctaaaaggggcccttatgaaaagcttaaaataaaaccttcttattttgggagaaatgggggaacccacccattgggcccctcttttcaagggaaggagaaccccctccccaatcactgcg

SEQ ID NO: 534901 - DNA, 427 bp, Homo sapiens
gcaaaaaatgtgattgaagagcatggtccttcaaaaaaggcaataaacggcccaactagtgcttctggcgatgacatttttaagctccagggtactccaggagaagaaaagattaatcccttaaaaaaagaaacccctcaaaaagcaccagtcctgaatggtgtttcataaactgaaaaagttcctagtttccagtttttttccattacatttccaatagggcttgtccaagcttcccaaaaatagaatatggatccccagtttttacatcgccctttcagttcccccctttggaattcaaaaaggggggggatcctgaagaaatcatatgttaaacatactttgcccccccctgtgttataaaatatatcatcaaatgtcccttgagaatagtatatgtaccattaaaaaaaagttgctggctata

SEQ ID NO: 534902 - DNA, 248 bp, Homo sapiens
acagagcaagagtccctctgcaaaataaaataaaatgcactcaaaattattaacaaaacagaacaggcaaagatgcttaacatcattagtcactagggagatgcaaatcaaaatcaatgagataaccactacacatctattagaatggtcaaaaaaattgacaacataaaatatgagcacggctgctgagcaccaggaattttcatgcattgttggctaggattgcaaatagtacagtgatcgaccaa

SEQ ID NO: 534903 - DNA, 228 bp, Homo sapiens
ttagccaggtgtggtgctgtgtgcctatagtcctagctatgggggtggctgaggtggcaaggattgcttgccgcgcaggaaggttcccggctgtggtgagcatgggatcaaggacatctgcacgtgtagtctagggtaacagcagtgagaccctggtctcaataacacaaaaccaaaaacgaacaaccattgatttttctacagttgtattcgcctctaggtggtact

SEQ ID NO: 534904 - DNA, 173 bp, Homo sapiens
gaagacgagagcacgtcttggatgccttcgacgcttcatttaaagatgacttggagggggttcccgtggtcattccttttcagaggaagaaaccctatgagtgcagtgagtgtgggcggatctttaagcacaagacagaccacattcgccatcagagggtccacacgggagag

SEQ ID NO: 534905 - DNA, 730 bp, Homo sapiens
ggcgagtaagtggcgtgctactaattggcctccagtcctaggagatgagagcgagattgtttcaatttaaaaaacataaaacttttcatagagatttgtcacacctagatgtatgagaacatttcgcatgttgcaattgttgagagacgtgcatccataaagaagcttaggatgtggccagtgcactgtgtctcacgcatgctggtcccagcacttggggaggccgtagccgcgccaaagagacatatggcccggtcgggagtccaaggagctatgcttgagccatcatggggaacttaccggacgtctactacgggagatgcaaaaactagggtgggaacggatggccgtgaaccttgtaatcccagctagcttgtggaaggttgaaggcacggaagcaaattgttgaacccagggtaacacgaaggttgagcccaagaatcatgccaacgtgaacttccccaagcccagggggacaaacacagccagtttggaggaactcctggttccttccaaaaaacatatcaaacacatccattgtgcaaacaaacaaaatttttttgggcccgccgctcgtgcccttggaaaaagaacttttctacaaccccatgttgtggtgggagcccctggcccccccaaggacgttgagggaacacatagttgcctacaagttggcctcgaagaggaaaccgctggatacgcgaaatacttgtgctggggatacacaccc

SEQ ID NO: 534906 - DNA, 553 bp, Homo sapiens
cacgctgcaccgtgtgttcagagttatgaacggcaagaatgggtggcaatggtggctcctggaaaagctcacccagcagagttccccttacgtcggggccttggttacttgtccctagggctatttatatttcataacatttttatataaatacacaggagaaatagaaaatataagatctgcggggttggggaagaaacgttgagggactcagcaggaagccagagctggagaggtccattcaggccaacttgagctcctccttgacccctgttaggcttctggcttctccctcctatggctttctcctcttcggggacttctttcttctcctcgtgggacttgctctattttgatcctctgttttgactctcttggctcagagtgaagttggcagagttcttgcggtcccccctctacctcctcttcagaatcggagaactcttcctcacaggccatccgtttgtcacaggagcagatcgagatgcgcgtttcaggggcgtcatcgtcctcatcggcactctcctcatgatagcgtcctccggaatcgcgt

SEQ ID NO: 534907 - DNA, 574 bp, Homo sapiens
gcacgaggcgaccaaaggccacaaataaatatgcactgtttttaaatttttttttcattaaaaaaatacgaataaattccttaaacacatacatcattttgcttcaaattttacgtttgtaagaaagaccatttgttgtcttaatacctatgaagcactacttataatcttaattaaatctaattcttttctttaactttttttgagcatcgcttctatcaattatgtgtatacatacatacatacatataaatatacgcgcaggctaagtagaaaacaacgcaagatagaattactttatttgtcattcatcaagcgcaataaaatctctctaggtgtgcagtattgcatttttacgttcttagaggcggctatccattcgggtccgtaagtaggctcacattgatcgaacatattgtagagatcaacagtatccttgcctaaccttgcatatgtcctaaatagccaaacccatgtatctccgtaacgcgagcactttttcagagctctttctaaccattttaatgatgtttcatattgcgcttctgcataaaaggatactccaatctccaaa

SEQ ID NO: 534908 - DNA, 335 bp, Homo sapiens
gtggtcacgccgtattccaacatttgggaagctgaggtgggtggatcacttgaggtcaggagttcgagagcggcctggccaacatggcaaaaccccatctctactaaaaaatataaaaattagccaggtgtggtggcgtgtgcctgtaatcccagctactcaggagggtgagacaggtgaatcgcttgaacccaggaggcagaggctgcagtgagccaagatcgtgccactgcaccccagcctaaagcgacacagcaagactctgtctcaaaaaaaaaataatgaaataaaataaaaaatactataatcaaaatctcagaaaaatataataaatt

SEQ ID NO: 534909 - DNA, 1237 bp, Homo sapiens
  misc_feature (806)..(806): n is a, c, g, or t
acactcctactcctcattgtacccattcgtagaatcgcaaggggattcctaatgcttagctgaacgaagaattctaggctatactacaacgtacgcaaaggcccgcaactgttggtatggcccctacaggtgctgactacaacaccttcgctgacgcctgtaaaagtcgtatccagcgacacaggagccccgttaataatcccgcctcatattttgaggccagtcacctctcatatatcaccggcactcgcaccgttaggctcgtcgacctatcgctttttcgtactagtgaatcgcccttcttcattagggcgttcgcgctggtgctcgtcctcagacctaggtctccagtacctttgattccggaagccaaaccgcaaagcgcctcaagcggcgaggtcattcaaactgcacatcctgactcgagggagtgccagctctcgaggaacattcataacatctcagcgcacctggaatccagagttggcagcattctggagttctaaggtaggcccccatatccagaatcatggactaatacaaacgttcgcacgcccctcagcccgagtaccagtttgcttagccttagacaagaccaattaagcgttagactgacattgcgttggccttgtatgaaggggcatcctcactagcccctctgtcactagagaaccataggaaggctaggtactggagttgtcactaccgtagtgcgggtccattggacgcgctttcgcgtcgaatgagctagtagaatgttaggtcctgcacaacactaatcgggagaatgaccccgaatgggcgangaaacaccaactctgtacggatcggctccgacccgtcaccgtgtgtgcccgcgtaccagaagatttacgatgcttgcagagtcctcgcaatactttttgaaagccttgagtgaaacgacagggaacactaatttcgcgacgcagtgacatactttagcgattaagcaccggaaactaccggacttactccatctgtaatatagttagcctacaaggaactagatcatagccaaattaaccaacgtcagtaatccctaagtgtgacgtagtaaaaagagaatcggtcacgtgcattcccactggaagcatctactcacaaacactaattcttggtcaagcgagaaggaacccttagggtatcatagaccactgccccctggatacccttaagtggggagaatccggagcagcagaggcactgagcacaccag

SEQ ID NO: 534910 - DNA, 168 bp, Homo sapiens
taatgtcggccattatccccgacgaaaggcccctattgtgaccgacaccaacacggcgccattcgacaccagcgccttgggctcgaccctcattgacggcggctgccgctttgggttgtgggcgcctcgcgcggagcgtgtcgagttggccctcgtggcggatgacgg

SEQ ID NO: 534911 - DNA, 153 bp, Homo sapiens
ggggggggggggggggggcccttttttggggggccccccccaagggggggcgcgccgatttttttttttccccccccctttttgggggggttggggggttttttttttttccccccccctttttttttttttaaaaaggccccccccccccga

SEQ ID NO: 534912 - DNA, 632 bp, Homo sapiens
gtacaactttcggcactctaagtatttgaggaacagcacaatatggaaaaggaagcctcacctaagcaaacgtgtttgctgtctcttccgggatgatggattagactcaaacaaatagagggcgtttccgtttctttcctgttggcacagcagcagcaggaggcattcccacaggtcctgaaataataacatatgcactgagatcaggcagagtcagttaactgtacaaggcaaaaaacaattacaggtacaaaaagtagcatttacttcctaatgtgttatcaataaatatagaaaattcctgataccataaatatatttcatgactgtcaacatgggtcatattttaccattaaaacttagaatgaacctttcaaaaaagtaaatgacttacacctccccaccacataccagcttgaattttatataatgttttacagttttgtttggccagcatgcccatactgttaagacaatactctcagaggtgctagatgaaactgcagcattgtgaagaatctaaaattaaaaaagttatagatttcaaatttcatttccatccctgtgcccttttttccattaccctaagacacttccacgttaagaaggcgaaataatcactaatcttgaac

SEQ ID NO: 534913 - DNA, 217 bp, Homo sapiens
cccgatgtattcacgtggtccgggtcatccacctccccgtcctcgttctggaactccgacatgctgtggacacacactgccacgatggaggccagcaccacgctcagggaggagactcgcaatgagcttggccgacaggctataggctgtgtttgccatccgaatccagatcttcttgcggagtttcccgaatcgcagcaccacgttgaagtccatg

SEQ ID NO: 534914 - DNA, 299 bp, Homo sapiens
atatgatggaattacccaagatcggtgcagaaggtaaatgattaagccaggattttaatctaagtctgattaaatccggtgctttcaaccactttgctgtactgccttttcaaatatttccccttgaaaaagtaatattgggctgttttataaatgcatattcttttttcttttcttttttttttggagatgggagtctcgcttggtcgcccaggcgggagtgcaggggcataatctctgctcaaggcaagttctccttccggggttcacgccatggtccggcctctatgtcattttcg

SEQ ID NO: 534915 - DNA, 186 bp, Homo sapiens
ttgagctcggtcccctgcccgactaatttttgtatttttagtagagacaggattccaccatgttggccgggctggtctggaactcctgacctcaagtgatctgcctcccaaagtgaggggattacaggcgcgagtcactgtgcccagcccctccccattcttttctatctcaacaaatactgccat

SEQ ID NO: 534916 - DNA, 514 bp, Homo sapiens
cacggattgccatctggcatgttgcagagatggtggagctagaaaagatgaaacacaagtcccttttcagttggtgcactgggtatggtccgtgtagatggatgcagatttgctgaaatgaaatgtcggtttagacgagatcataccggtaaagcaggaatgacaaagcttgcttttctggtatgtcctaggtgtatggtgcacttcactgttatattaatggccaatataagtaaatatcagataatatatgtatagtgtatcacaaagcttagaccttcaccttccagccaccccacagcgcttgatatctcagagtcagtcatgggtaatccatgtgtagtcccaaagcacataagctagcaagcagcaactattctaggagcactaccatcggttatcaacatgcaatgccacacacatagaactccaacatcaaatttcattgccacatgattgactgtagttaatttggtcacagaattctatggccttgatcttaattgcttccaaa

SEQ ID NO: 534917 - DNA, 484 bp, Homo sapiens
actctggataactcagaggccccatccaccgaataggggtatcattgtatgtgcccagaagcctaaactgagtaccaggtacgatcggactgttaagtcaagtccgcagaatgaggggacacggcttcgaacaggatgctctgttggaggagagatgcaagggtgtgtgtagccaggttgccagaatataccagaggaaagacacacaacgccagggtgggctatagagaaccctcgatgctgctccatactgggggcaggcggctacttcgtccagctgactttgggaatgtcgtaatgctccgtgagtgtgtccaggtgtctgttgaagtcctccactctctgcttgtgggttttggatgccttctttaggatcctttccatttgccgcttctcctgcattttctcgaaggccgcctgggccggggtccgcttgtccaggccgcgccgcttctcctcctcgttctttttgcttgttccgctg

SEQ ID NO: 534918 - DNA, 318 bp, Homo sapiens
gtcgacctctagacggactcccctttgtgggtcattgatgtgtcatatacttattcagttttctttgtttacaccaaaaatgtaagagtgtatacatatattgtgactttatatcttagcttttgcagttaaagtgtaacacatgctgcactgtgagcctttttaaaaccagaacgttctgtaaatcccaactcatacattctttcagcttcaccatctcaccttaaaatgacacccgatgtcgatatcttgaggaacaccgaggccgtagaagcaataaccgacgtcttaccagtttattccactgggtatgtatag

SEQ ID NO: 534919 - DNA, 363 bp, Homo sapiens
  misc_feature (52)..(52): n is a, c, g, or t
  misc_feature (60)..(60): n is a, c, g, or t
  misc_feature (72)..(72): n is a, c, g, or t
  misc_feature (148)..(148): n is a, c, g, or t
  misc_feature (305)..(305): n is a, c, g, or t
agtttcactcttgttgcccaggctggagtgcaatggcgtgatctcggctcantgcaatcngcaccttccggnttcaagcgattctcctgcctcagcctcccaagtagttgggattacaggcatgcgccaccatgcccggccaattttntatttttcgtacacacagggtttctccatgttggtcaggctggtctcaaactcccaacctcggtgatccgtccacctcggcctctcaaagtgctgggattataggcatgagccactgtgtccggccagctcaaacaattttaatgcttctttcaagnctattagaaacctttaattgcttcttaagtttctcccccaactatggaggaagcatat

SEQ ID NO: 534920 - DNA, 693 bp, Homo sapiens
  misc_feature (175)..(175): n is a, c, g, or t
ggagaagagggggaagagaggcagagacgacagatacggagaagggcgaccgtgctggtagccactgtgctaggacttgcagggttttggcaagctgaaatcgcctagtcagccgtgaagtaactctaagtccagatgggcgtggctggcacgaggaacagctcttgagctcaanaaagaatgcacagcatgagtcgacgcgtcaagatggaatgtgtgaggctctcaatgatgctgagtactgggaagggcgagtgaatatccttaagattcgtgcttcaagttaatcgtatctggtgatagaagccatagtaagcaaggagtgagatagtagtgttaagccgtatggagacttagactagtattgtgcttatccaaacggtggattacttgtttgaaccgtagtggagtgttgagcgtttcgttttcagtgaaggataagttactactcgtgtttacaattagctaattgttacaagtattttcattaccttaggtatgtggacatattagagggtttatatgtgagatatgcgagatagagttgtccttttcttaagtagctgtcatatggttaggaaggatagcctcaccttaagctaaatgacgaactgtagagtaagtttgtgagaagaaagctggaatctctgctaaagtctagttaattgcatgttgtgctgaagggaaaggagg

SEQ ID NO: 534921 - DNA, 599 bp, Homo sapiens
  misc_feature (151)..(151): n is a, c, g, or t
ctgctctatcatcggttgggaagcgcgggagcgcatgtaggataagtagaagacgtagggacgttgccttggtctgctgagggaaatccctgtttcgatgactgacggtgcgtgaggtattcgtcaacagacttaagatcacgcgccgggntggagaaaggaagtgtgctcgaacagatgcttcagtggaggtcctcgaaggtcagttatatggtatcgtaatcaaagcagagaagtcctattgaagagggcagtatttggcagtatgtacacaaacctgggaattcgaaatgggcgagggatgggcaagacaaagcgtggcaacttctatgtacctgcagaaacccaaatttgcgcgtttgtcatcagaaatcagagggtatccaattggacgttgaaggcccaaaagggttcgaaaaggggtgtgcgccagcttctttccgccttccgtcaaattcttcaagtggaaccctttgttgaagctcaacaagggcttcgattaaccatgctgaggatttgtagagccatattatttgcaatgggggttaccccaaaatctggaaagtcaggtaaattgaactaactcttacaaagcgtgg

SEQ ID NO: 534922 - DNA, 427 bp, Homo sapiens
cagaggaaatccagattgtcatttttacactctggaaagtacatatgtactgtatctaggctcaacgccatttcagctatgcagatcatatagatggaacagaggtgacacagaatgatatgatgatggctgacaaggctcttcggaatcctagcacatgttgcatcttctgagttaccccagtatcgtctgatttccatcccgggtgatgccaggaaaaagcaatgtcggtatctactagtaatccaaaggaaagagtcctggtattatcgacgaagactatcatgacagccaaagacttgtaggagaaagtacaaatcgtgctacattatattatactacgagagagttttatcatgaaatgctagaggaaagaaaggaaaagaagaaattctgtaaaacatatattgaagaccttgtgaaggaa

SEQ ID NO: 534923 - DNA, 109 bp, Homo sapiens
actcactcgctgaccttgctggagcctccccgggcacctcaggcatagaaaatgagctcaggggatctgccccaccctggaccccagtcccgttggtgctgtccgagga

SEQ ID NO: 534924 - DNA, 179 bp, Homo sapiens
gcttgtcaggagactaccaggcaatgaaactgactcttctgtagacctggatagagcaataaaacactgactgtgaatgatgtaaggaacacttactcctccctagaaggaaaagtcagcgaagataaaagcagagaatcccaatctcttctaaaaggtaaaaatgacacaaaataaaa

SEQ ID NO: 534925 - DNA, 254 bp, Homo sapiens
gatctagctacttgcgaagtgaaagtgggaggatcaccggagcccaggaggttgaactgcatttagctgtgtttgtgccacggcactcagcctgggcaacaggagtgagaccccatcttaaaacaggaaaaaaaaagttgaaagatgaaagtcttttttagggaggatgttaagtacagttcactagatggatcctagtttgagtctgatctctgggtggcctcaggaagctacatgcaaatcaggcagttaca

SEQ ID NO: 534926 - DNA, 123 bp, Homo sapiens
cagtatgcaatagtacaataatactggaccctacatctatcaggagtgatgatctctcaccatttatcttaccacttcgcaaagtgaaaacgatacacggccattcatagcagtcttgttgaa

SEQ ID NO: 534927 - DNA, 708 bp, Homo sapiens
  misc_feature (575)..(575): n is a, c, g, or t
cggacgcgtgggtccggacgcgtgggcgactcccttctttatggcgtcgctcctgtgctgtgggccgaagctggccgcctgcggcgatcgtcctcagcgcctggggagtgatcatgttgataatgctcggaatatttttcaatgtccattccgctgtgtggattgaggacgttcccttcagcggagaaagattttgagaatggcccccagaacatatacaagctttacgagcaagtcagctacaactgtttcatcgctggcaggcctttacctcctcctcggaggcttctctttctgccaagttcggctcaataagcgcaaggaatacatggtgcgctagggccccggcgcgtttccccgctccgagcccctcctctatttaaagactccctgcgagcctgtgtcactccaggtcgcgtccacatcccttgccgggctgccctcgtgtgggactagggtttcccgggcgagagactgaatcccttctcccattcttcttgggcagtcctggccgcccgtgtgaggagggctagaggctggcggggcttgtatccgtcatctcgcagccgcttcgncttgtgttcccgatgatctcaactataatgagaatcttggctctgctttccaagagattgaaattaccaagacacaaaggggattggaattaagacagggaaccagtaaaaggaactacttatacaagttggc

SEQ ID NO: 534928 - DNA, 281 bp, Homo sapiens
ccccgtgagcctcgctgtgcagtccctcgctctgggtgcacgggcaggaggtttggcggctgtgtgcactgcacagtgttctgggtcccctctctgagccttggtgtgtccatctggggaagccgggcacccctcatccctgagcagcggtgcatgcactgctggttcagctggactggggcgtgtggagtgcagagcttccggtgtcggggcccaggcagcattggaggaggacagagtgagtgccctggggctgttggctatgagacaacatgagctct

SEQ ID NO: 534929 - DNA, 606 bp, Homo sapiens
caggcataagcaccacactggctgaacatcagatatttaaacggtgtagcccagagtctagtggtaaatgttacttatattggcgactagtgatttctaatgtttctgggatatgctccctataaaatgaaatgttttcctggaacaatgctagattaggagttgcattccgtggccaagacatgacatcacaactaagtaatagacagtcaccagcaatgaattttgaaaagctacaagaatactattaacctatagtaagccattcttaaaatttccagaattatgttcccagtacctctattttctgaggctagaagaagcttacgaggcatctgatgatagattccccagagctggcatggatcccttagggaccctacgtaatctgactgtctgtccacctgactggattcttctaaaaacacggattgtcacttaatttcccctaccttattacgaactaacatcaggtgggcaccatcatagagcctctttatttataaacagaccatacttttgagtagacacactcttaactggagaccccgacgctgcttcaatacttgtcctcacgtgcttatcttgtcccgacttactacaacc

SEQ ID NO: 534930 - DNA, 385 bp, Homo sapiens
  misc_feature (145)..(145): n is a, c, g, or t
gctcgcgcgcctggatgcctatcatatagtaaaacccagcccatgacccctaacaggggccctctcagccctcctaatgacctccggcctagccatgtgatttcacttccactccataacggttcctcatactagggcctactanaccaacacactaaacatataccattgatggggcgattaacaggggaaagcacatcccagggcacacacaccacctttccaaagggctttgatacgggatatcccttttattccccagaggttttttctcggaggattttctagctttacactcagcagcccgccccagtagaagcacggcccacaggacaccagcaagcgggaggccatctaacaaatctttttggatagggttacacta

SEQ ID NO: 534931 - DNA, 483 bp, Homo sapiens
aggacgggcacatgaactcttgtaatcactgtgtcatagcatagtacgttagcagtggtctttgtgcatcgagtatgctagaccatcacctatatccagagcgagccatgatgctaggagggaaactggacctagcaatggaacctactgagccagctatccaggagacctgagctgtaatatgctggattacactaggataaatgaatatccacaaagtaccatttcaacatcatgtctcaaggactgattaaaaagcagatttgaacataccgatacttattaggaaaatagaaaagcttcccagaaacgggttgaagtagactttctatatagctgcttagatagaggaatatctcctggtacttgggcagtaactcctggaagaaccagatcggaccattccagaaaaactccaaactttcaggaagattactattaatgtgtagaacttgaacgttcactttctacacaattaaaaca

SEQ ID NO: 534932 - DNA, 393 bp, Homo sapiens
  misc_feature (36)..(36): n is a, c, g, or t
  misc_feature (45)..(45): n is a, c, g, or t
  misc_feature (362)..(362): n is a, c, g, or t
ttcagtatagtgtagatctactgtgtaattaatttnctgtttctncgaggagctgtgaaaccaaaggacatataaaactgctcttttctccctgtttctgcctgcagcttggtcctaaatgtgagacaattgtgaaaagtggaggacagagccacctggttaaatacagccccagctttctggtgagaggactgaaaccaagatgtgtcaagtaactagaatgtgcctggacagatactgtagaaagcaaaaccataaagttgttcatgagcttgtggacgcacctgccagctgtgaataagtggctctaatcccgaacaacttacctaaaaagagcctgagagcttgaactgtgcaatggnccacttttccagtcctcacttgaccactggg

SEQ ID NO: 534933 - DNA, 1013 bp, Homo sapiens
cagagcaagactctgtctctaaaaaaaaaaaaaaaaaaaaggagcatccttggtaccaagacagggggaaaagcaacttattttttcccggcccacccagggaaaaaacttccgtggttaacctttggatgttctttcctttagtagtttcgtctaatataaaagatgctgctcctcctagttatacccaccccacttcttaatctacatgctccctttgagagaattgaccttacgacacagtccttcaaaatcctccaggcctggtactggaatttactagctcacgcaccagcgcgatagtgaagacgtccagctacgcgtggtggaaccaattgggcgggttacattgggccccagagaatctgacctctaagcggcgctgaccgagatcaacctggcgtgctccccacgaaaggggacacccaagtcaccattcgagaagaaatttcgccattacattctccttgcctgggtcacacctgggggtcgaactaacgctgaccagcgcctttggcctttcaacttttggcatcgtgcgcagcgagcttgacgaagaggagtttctcctacacacagacaacagaaccgggactacatctcacagggaagatccccaagggacaaacgacgacttacatacttgccagtccccacactaaacagggcaccaattatgccggatttgggtgggaagaactgaattacttggccactccttaacggcgaaatatgggctggcccgtgggaactaaatgtgtaacgtgaaccttggtcttgcgacagggtgcattcaacgaaccccggggtgggtccatgccggcgggtctgccaaggcttcagcggacgactagggacaacaactctggtagttactggtaactcctcaggatgaaacacattttcagctcacggaagatacttagcaggttgctaccccagcccggagtatcattcctacaccgggggagttacctgagcacaggacagcggtgcaactcagacctttcgaa

SEQ ID NO: 534934 - DNA, 147 bp, Homo sapiens
agttctaaccagctactgtgcatctcctactcctttctgggcctgatcttccaacagtcggaaatggcgagggattttactcccgagcccgtggtggctgccatctggcgtcgcggtggctggaaggccggccaccacggacatcgt

SEQ ID NO: 534935 - DNA, 260 bp, Homo sapiens
atcacaaaagcggcaataaataaacactttaatggccaggatggataaatcccactcatgccttcaggatttactgtaaatgtatggcgttcctgttgtggctcagcagtaatgaaccaaactaggatccatgaagatgcgggtttgatccctggacttgctcaatgggttaagaatccagtgttggagttcctgtcgttgtgcggtggttaacgaatccgactaggaaccatgaggttgcgggttggtccccgcttttg

SEQ ID NO: 534936 - DNA, 642 bp, Homo sapiens
cgtttgacatctctgaagtgaagatggggtagaatccgacattgactcaggatatgaaggttcatcagtcaaaaatcggtgttctatgcataagatgtgtgttcaaagaaaggtgcaagtcataggactcatggtgggcggtgttgtcatagctgttgtcagggtcgtcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaggaaacaaacccgttttatgatttactcattatcgccttttgacagctgtgctgtaacacaagtagatgcctgaacttgaattaatccacacatcagtaatgtattctatctctctttacatttgggtctctatactacattattaatgggtttagtgtactgtaaagaatttagctgtatcaaactagtgcatgaatagattctctcctgattatattcacatagccc

SEQ ID NO: 534937 - DNA, 165 bp, Homo sapiens
tgaatttgtgtaaggaacaaggctcttgcttgccctgcaggcaaaaaaaacctctgtgtgccagcctcttcagtgccttacggggacggagctcgaagtatcccttctcggtggcgtggtccttactcctggtgagcgtgagtggggatccatctagatgtcgac

SEQ ID NO: 534938 - DNA, 208 bp, Homo sapiens
  misc_feature (150)..(150): n is a, c, g, or t
  misc_feature (175)..(175): n is a, c, g, or t
  misc_feature (190)..(190): n is a, c, g, or t
cagtatccaaaggagctataccaaaatctaaccaagtaaattttgggattttgcctctttgtgctttaaagtaccagggatttctgtctctatgggataggtcttgggagaatgttaagtaatgggatgaaactttttaaaataatttgntaaattttaccctaaggtagggacngtagtccttactgcnaatccaaataatttactg

SEQ ID NO: 534939 - DNA, 642 bp, Homo sapiens
  misc_feature (305)..(307): n is a, c, g, or t
tgctatgccatggagtaaggggccctgtgagggccattctccccaccgcggtgggggtttaggggagtctccggaaaactcttttaaagtgttgtgccccctcaatctgaccccgggatatggcctcttgtgtcggggttgggcccctgggtttccccccccggttcgggggttttgaggctctacccccccggttgccccagttctctggggtgggggttttaccaacccccccggggttttggggggtttcccgggggggtgttctcccaatagggccccgccttttttttttttctttttcnnnttttccccccccgggggggggcgcggattttcccatttaaaaattttttttggggggggcccccccccccggtaaaagcggggcccccctatttttttttttccaggccccccaaggagggaaaacgggggggccccctttagttttttttttgggtttccctaaaaaaaaattggtttccctggttttttcccccaaggggggggccccgaatccttttttgttttttgcccccccccccccggttgggggggggttttttgtttttttcccccttttcccgggtccttttggggggggggttttctgggttttttttaaacccctttggttta

SEQ ID NO: 534940 - DNA, 274 bp, Homo sapiens
aacctaaccaggtgcgatcgcccttcagactcgccctgagctacctccagtcaacataaagctcggactcattctccaagcccaggtgtgatccgattcttccagtataccaagtcaagaacctgggatacagaaagccctctgtccttgagacaaggtagagggtctaactgagcttgttaacacaagccacctatagacagcaaaactaaaagatcaccctgtaacacacgcccactgaggcttcagaagctgtaaacatccacccctagac

SEQ ID NO: 534941 - DNA, 890 bp, Homo sapiens
  misc_feature (3)..(3): n is a, c, g, or t
  misc_feature (78)..(78): n is a, c, g, or t
  misc_feature (83)..(83): n is a, c, g, or t
  misc_feature (90)..(91): n is a, c, g, or t
  misc_feature (94)..(94): n is a, c, g, or t
  misc_feature (104)..(104): n is a, c, g, or t
  misc_feature (124)..(124): n is a, c, g, or t
  misc_feature (131)..(132): n is a, c, g, or t
  misc_feature (138)..(138): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (193)..(193): n is a, c, g, or t
  misc_feature (211)..(211): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (257)..(257): n is a, c, g, or t
  misc_feature (269)..(269): n is a, c, g, or t
  misc_feature (272)..(273): n is a, c, g, or t
  misc_feature (295)..(295): n is a, c, g, or t
  misc_feature (302)..(302): n is a, c, g, or t
  misc_feature (306)..(306): n is a, c, g, or t
  misc_feature (315)..(315): n is a, c, g, or t
  misc_feature (319)..(319): n is a, c, g, or t
  misc_feature (324)..(324): n is a, c, g, or t
  misc_feature (334)..(334): n is a, c, g, or t
  misc_feature (338)..(338): n is a, c, g, or t
  misc_feature (343)..(343): n is a, c, g, or t
  misc_feature (352)..(352): n is a, c, g, or t
  misc_feature (357)..(357): n is a, c, g, or t
  misc_feature (365)..(365): n is a, c, g, or t
  misc_feature (382)..(382): n is a, c, g, or t
  misc_feature (387)..(388): n is a, c, g, or t
  misc_feature (397)..(397): n is a, c, g, or t
  misc_feature (412)..(412): n is a, c, g, or t
  misc_feature (414)..(414): n is a, c, g, or t
  misc_feature (416)..(416): n is a, c, g, or t
  misc_feature (426)..(426): n is a, c, g, or t
  misc_feature (430)..(431): n is a, c, g, or t
  misc_feature (433)..(433): n is a, c, g, or t
  misc_feature (454)..(454): n is a, c, g, or t
  misc_feature (484)..(484): n is a, c, g, or t
  misc_feature (491)..(491): n is a, c, g, or t
  misc_feature (501)..(501): n is a, c, g, or t
  misc_feature (512)..(512): n is a, c, g, or t
  misc_feature (525)..(525): n is a, c, g, or t
  misc_feature (531)..(531): n is a, c, g, or t
  misc_feature (536)..(536): n is a, c, g, or t
  misc_feature (538)..(538): n is a, c, g, or t
  misc_feature (544)..(544): n is a, c, g, or t
  misc_feature (777)..(777): n is a, c, g, or t
  misc_feature (811)..(811): n is a, c, g, or t
  misc_feature (866)..(866): n is a, c, g, or t
ggntccgtccccgggggccttttttccccagttcccctctacaggctagctcatccctctgggtggtcattccccggntaaanttgaaannaangatgactgcnccacctccctagctcaaggnctccttnngggggngacgcgtgctttatcatcctcctgccacaactcaaatagtggttntttncnaganggtctgttcccacaaatnaggaccctaaagtnttantttncaaaacccaaantncnacaatttnccccacactacntanngttttacgtgaattgaaagttngcccttntgcntggttgtcnacantttcnagctcttgtntttnttttnctttttttnctttntttcttgntttttttttttcttggngggtnntggtttttngttggtctttgtttntnanttctttttgntggnnanttggtggccaaacagggctangtggctccctcttctttgtcatttttcacncctggtnatttttttgngggcagctggngtgctccccacgntatttntgctncngccttnccttcttgtctattccttgggcaggaacaagctccagccttcctccacatggctgaggtaatcagcacccctaccccaggggcatcttcccagcctacaaagcaggaaggagcctgtgcagaagttacattttaaaaccagattttcacctgaggcgtcaaccagatgtcacctctgcttaaaactccaactgcaaggctggcaagcagcacagaggaagtacagatccttcntgtgtcactccaggcccagaggaactgagaagcnacctgctgttccggcccttgggctgtttgggaaaagccagcagtcagagtgccanctcaagctctgattatcccctcct

SEQ ID NO: 534942 - DNA, 192 bp, Homo sapiens
ctgaactaagccaaggatgttttagcctaaggtctgtataagaactgatcagaggcttcgtttttgccatgcgtgtgggatgataaagttactgtcacgtttgacaggaagaacctgttgtatatgtgaccctaattatatgcgtgtcagaatatgtagatgaggcaaataaatgagagctcgtcattaaca

SEQ ID NO: 534943 - DNA, 112 bp, Homo sapiens
  misc_feature (66)..(66): n is a, c, g, or t
ccgacgaacacgaaaagaaaactttgagtagatcactatagtggggcgcctccagcgtccttttantagaccggaaacagaaccgagcgccgagtcttgagcgaggaagcgg

SEQ ID NO: 534944 - DNA, 289 bp, Homo sapiens
cgcaggcggccggtcgggcgtccgagacggcgcacgatgcctatccaggctgcaggtatataccacggtctacctgcttgcctactcacagcaggctgcccatgcccgactggtgctgaccactgatgcctaagagtctgcgtagccaggtcatacattgccaaggtcccatccagcgtgccaacagctgccagagtgcatcaaactgcataagcccctgtgacgccacccgcagtgtgactccctctcgtcccctttcgtcccagcgctgagtctgaccatgccacag

SEQ ID NO: 534945 - DNA, 806 bp, Homo sapiens
atcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaattggtaaaaaatggtgatatctatgaaatggcaataaagtgaagtccaataagaaatggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggaaaaaaatccgggggggggccccataaatgagccgcacccaccatttatgaaaaagagggggctccacaaaggagaggggttattaaaaaagagacgaaggggggggccgattaaaaaaccagggaggggggaaaaaagctttatagtggatacagtggagaagaaaccaactgtggggggggaaaaaatggagaaccacaaccagaaaaatttatgcgcggaagcaataaagggagtagaatggaaaccaagtttttcggggaaaatt

SEQ ID NO: 534946 - DNA, 303 bp, Homo sapiens
atcatttccagcgtatactgcttcagactaattgcgactctttctatcattgccttctaaagtgttcaataagagttctctcagacgagcatttcagagaacttgcattcatcagcagcaatatgtagagaagaatggtatcctgtgctgcacaataggacaggaaggaagaaaatatatttactgagttctaatgggttagcctgaatgttgcacagtttcttcacaaccgatgggggaataattcaacatggtgtccaacaacgttctaacgacgtgcttcatctcaactggttactatga

SEQ ID NO: 534947 - DNA, 322 bp, Homo sapiens
  misc_feature (23)..(23): n is a, c, g, or t
  misc_feature (30)..(30): n is a, c, g, or t
  misc_feature (58)..(58): n is a, c, g, or t
tccccaagagttcctgctgctgntgggggntgggcttccctaaatgtcattggacagnttgcccccccatccattcaggtttttggaggtccttttttcacccctggaaaaacaaatgatttgttaacaaaggactgcccacctccggaaattttgacctttgtttcctccgtcctgataaaaggtccaccccccagggccaggtcccagttatgtagacccccgcccccacctccaacattgcacccttttgccctgcccccctggtttcaccccctttacactcacatttttatcaaaaaaagcatgttttgttagggca

SEQ ID NO: 534948 - DNA, 145 bp, Homo sapiens
acagttcaaccacacctctagcttccttcactactgttgccagtgagcctccagttaaacttgagccaccccctgtagaatctgtgtcccaagctaccattgtcatgatgcctgcacctcccgcaccaccaatacagggtaccga

SEQ ID NO: 534949 - DNA, 252 bp, Homo sapiens
accaatgattgcgcagcagtgcgcgcaggtgctgtaacgttcgtcaccgcgtgtcgtgtgcagagataccgggtgattagctgttcaaggtgcaaagccagtcgaatcggtttgaatctatcgccattttatacagaacagtcggtacagcatctatacagcgaatgatagctcggcgtgatgcacgcagtactgccgcgtgagccttcagtctgccggtcgggctgtcggttatggtaactatagatgatt

SEQ ID NO: 534950 - DNA, 343 bp, Homo sapiens
  misc_feature (14)..(14): n is a, c, g, or t
cctttcccttctancagcaatctgtgtagagtattaccctactgcatacagccttaaattatttaagcatattttgctcatgcctataattccagcactttgggaggctgaggagggcagatcacctgaggtcagaagttcaagaccagcctggccaaaatggtgaaaccccgtctctactaaaaatacaaaaattagccaggtgtggtggtggccacctgtaatcccagctactggggaggctgaggcaggagaatttcttgaactcgggaggtggaggttgtagtgagccaagatctcaccactccactccagcctgggtgacagagtgaggctctatctc

SEQ ID NO: 534951 - DNA, 408 bp, Homo sapiens
gggctcggaccgttcttcatcatactaccaataagacaaagaaaaagaagttgggttgagtgtggtggctcatgcctgtaatcccagcacttagggaggctgaggcgggcggatcacctgaggtcaggagtttgagacaagcctggccaacatggcgaaaccccgtctactggccgggtgcggtggctcatgcctgtaatcccagcactttgggaggctgagacaggtggatcacgaggtcaggagattgagaccattctggctaacatggtgaaaccccaatctctactaaaaatacaaaaaattagctgggcatggtggcacgtgtctgtggtcccagctactcggtaggtatgatgaaggacgcgtccttcatcaatacctacctttcttacgtaacttttcttt

SEQ ID NO: 534952 - DNA, 302 bp, Homo sapiens
gcggcgcagggtcttgccgagctcggccctcgaggcggcgagaacatgggtgcgcagtttcttgtgtgaccctccggattcggcgcgcgtgctgtccccccgcgagtgatgggttttcgtgttttcacatacggtgggtttacggggttgttgggcagcgcagggggctccgccgctgtggccctcgtgctgattgctacttgggggccagcgtcttgggccagcagccgcttcctagaggaccaggtggacagtccttgaaaagttcggggcgcattcggcactttttgttctctggtgta

SEQ ID NO: 534953 - DNA, 396 bp, Homo sapiens
tatccatcaacagggttatgctctgagtgtttactcttcggatgtcagcactgtaaggtatgatcgaatccctgatctgggatctcattatgggtcatgtcactagatcctgcagtgctgagcagcagtctgagcttctcgaatataggtggcaacagcaggcccccaggtcagctggcatttatgacaggctctacattgggtcagacaatggagtatagccctggtcccagctctccaagcatgcagcaatctcgtcgccagtataaggcacgcaggtcagcagctttagttccttgtcagtcacacacagtcagccacgaccaggaccaggcctaaaccgcagaaatcgggtcagcacctcgcggttaagcaaggaggcttcgattgggtccg

SEQ ID NO: 534954 - DNA, 199 bp, Homo sapiens
aaggccttccaggacccctatcaggacctgggggccttcagtttttccaggaagtgcctggcccaacaaaggcaaaggattcttccaaagagaaaaacttcaaaaaaggcccccccttccccctccttaggcaactgtgggggcccctcctgtgtggctttgtatgactgttgtttaaatataaaaccctgccccctta

SEQ ID NO: 534955 - DNA, 191 bp, Homo sapiens
gacacggagtctggctctgtcaccgaggctgcagtgcagtggtgcgatctcggctcactgcagcctctgcctcccgggttccagctattcgcctgcctcagcctcccgagtaactgggattacaggcgcccgcccccaccacgcccagctatataccagtgttcttgccacaacccttctgtcgtcttctc

SEQ ID NO: 534956 - DNA, 909 bp, Homo sapiens
cacggacatgaaagagagagttccagattgtgcgcccgtgctagcatgagtggggtataatatgcagcgggtcaaaagttgttgttacatggtgcgcaatttatatgtcttcggcctggtgatgctaatgtcccttgggaaccacaagtccattgtgttgggcgccccgcccggaatctttctcgcgccccgcgggcaatgctttgtcagggcacgctttaacgttgctgtagaacaaagactcccggcgaataggggaacgtgatacttgtcgtggtctccgcaagcgctttcccttggaagttaccccgaggggtgtccaccccgggcaacaataaaagcatttgatgcgggtccccgctttcgcagagggcccttttttgtcctgtttaattaggggccgcttctgtccagaggccccctgttcatgccgcccctcgtggaacatgttaagtgcaatgagcttgtgtgtgaaaccacgttgtgggagttttaacggggtcagtgccccttcttggaaggattccgtgattgtgttgcgcgtccaatagtaatatggcacaacccgcggggctcccacaaatggaatatttatataagtacgcctgaaaagcacatacactcacgcccttgtttccgagtagaaaacctctcatccaccttgctacctgcattttatagaaatcacagcatcatggtaaacatgccaaatcagtaaccagcaaccctatagggttgtacccatcactttcggacacctgtgccttcttagttcccccactagtaatcaaaaaacactccttccaccctacctttaagggggaaatacacgttgtttagtcttacggtctaaatttggccggaaggcgctatcccaacaaaaggcgcaaaattttgtcaaacataaca

SEQ ID NO: 534957 - DNA, 641 bp, Homo sapiens
tttccaggttgtaaaccaaaccatgggaataataaatgttctagaactctctcagaaccctgtgttaatcctgagcatggggttattaggtatgtgcaaacttccacggtaacactatgagaagtctgatcccttgaccatagtggtcagtgtcctggtacgttgcctcatatcactctcaaggtttcatatgatccggcagacatcacatagtctgtagtaagtactcaacatgcatcatctatctggcttaaggaataatgcagtatcgccataggaagacctcagttttattactatgcaaagttcgccgccatcttatatcagatgctttagcaatgtagtgccaccaggacgagttggttatatcgcgctttctccattctgttaaagcatgtcaataaagctctgcattatattcacctcatccacggaggctatttgcagtcgctatgagtaagaatacgtgctccatgcatgatgagttccaccatgttctaaaggctcgtgttggtcacacatgtcggtcctcagggtcaagtccagctcacagctgttcagtgtcatgcaggaggagcggctatgtatggagagaggtccacatctcaatttacaccgagcgtcaccgtctatgaattaca

SEQ ID NO: 534958 - DNA, 464 bp, Homo sapiens
cgattttttttttaagaaaaaaaacaaaaacaaaaaaaacctcttaagctatttggtaatcctctccctccggggattctgtatctagattgtgaaagctgtcagagaatggagtcagggaaaaccgtgatgggaaagttctcactaataattgcctgatataaagaattagcacaaaagactgccaaaaccacaaccttgcacaaaggccacaaaagtacacaaaaaaatgcttcaaggacatttgcgcagcaactgcctgtccaaccttggactgaccatcccctttgttactgatctttgtacccaaggataattgtttcaaaacaacttacgtaatcctcctcgtttttccttttaaaccccttatcttcctttacctccctgaatacacctatagtttactatgacaccatattctacattgcaatgcccactttcaaataaatttgtcatgtttggca

SEQ ID NO: 534959 - DNA, 1016 bp, Homo sapiens
  misc_feature (525)..(525): n is a, c, g, or t
  misc_feature (534)..(534): n is a, c, g, or t
  misc_feature (643)..(643): n is a, c, g, or t
gccatccatgcagctgcacctatcgcagtcatgcaaccacgtcagctggccgtcaccagccggcaactacctgcaatatgggcaacaggccagcagccaatagatgaatggcttgtactatcgtaccgtgaatagaaattttatgatagacctaggtagaatcaagacctgtcaccctaagcggagagcccgtctttttggtgggcatcactctgtccgtcctcggacatcacttcgaggagagacacatgcaggacaacatagtctgcagacagactcatgagtagaaggcatagagcgcacagatctatcgcatctcatgaagggatcaacagggatttcggtcgttataatcctgaccttgagcaacactccgaaaacagcctgagctggcagtcattgctccaagaggtggaagtcgtgggacctaattgatgctcaactcacggggaaagaaagcagcactgtgcgatgatgcccgcgtatatgacgctggccagtagctgacatatccgcttgtacagnttgcgatanacccgtttgcctgcagtgtactgatggtccaacgtgaagcctgcctggcaaggagagcccttctacttggttcgttctgggggccacgggtgagcacgacggggagcgnagtcatgctcgtatttggtctgcgcatgggattctgaagcgggataagtggcacccctaccatgagaaaaatacgttgccaatttggttgcgaacgcctatcttccaagagtccacatggcccgatgggattggcatgcggaggaataggcttcgttgagaagcatgggattgaccaggttggaatggggcatccctatcccgtgcatgacacccgaccagttttgacatccgtttccttcgatggacttgttgcgacgcccacaatgggcaccgaaggattatggagtcaatgcaaggaagggaagtttcccaacgaaagaggactgggattattacaaaacaccctgaaacgaaggtttcgacatatgacc

SEQ ID NO: 534960 - DNA, 83 bp, Homo sapiens
  misc_feature (22)..(22): n is a, c, g, or t
ctagttctagatcgcgagcggncgccctttttttttttcctgtaaagtatttttttaataaaaaaagtctgatttgtcctttt

SEQ ID NO: 534961 - DNA, 481 bp, Homo sapiens
gggtcgtgcgttctcgaccgtgcgatgagtgtgcttcaggaggatgcctgctataactgcggtacgaggtggccacattgcaacggactgcactgcgtcccagagacgagcgagacgcaatgctgctacaactgtggcaaaccaggccctctggctcgtgactgcgaccatgcagctgacgcagccctgctacttcttgtggagacacttcggacaccattcaaaaagacctgcaccaaagtgaccgtgctctacggtgtggtgaacctggtcctgtagccactcaacgtgcagcacagccccgtgacagtccacttgttaccgctgtggcgagtcacgtggcaccttgcacgggacatgccaatttgacggctaacgcctacattattttcctttgtcgcccctcctttttctgattgctggtggtactacttttctctgaatcctcttcactggccaaacggttggcaactacgacggc

SEQ ID NO: 534962 - DNA, 190 bp, Homo sapiens
gcgagcacagagccttcgcctttgccgattcgacgacccgtccacacccggccgccaggtcaccagtggcatgatgatatcgccgggctcgtcgtcgacagagggctccggtcttgttgcaagggccggcttcgtcgggctgacgatgctcctcccggggtccggcttccacctccattcgtggggcgcc

SEQ ID NO: 534963 - DNA, 362 bp, Homo sapiens
  misc_feature (11)..(12): n is a, c, g, or t
  misc_feature (91)..(91): n is a, c, g, or t
actgatggaanntccggggtttacctgattatccagaaaattaggaccacgtggaaaaattagaggaaataagacggaaaacacttgaccnaggctcagcggctcatacctgtaatcccagcactctgggaggctgaggcgggtggatcactcgagcccagagttcaagactagcctgggaacatagtgaaaccccatttctataaaaaatacaaaaatcagccaggcgtgatggcatgtacctcgagccccagctgctcgagaggtaaagcagaaagatcgcttgagcccaggaggttgaggctgcaatgagccatgacttcagcctgcacttcagcctgggtgacagagccagaacctgt

SEQ ID NO: 534964 - DNA, 150 bp, Homo sapiens
agtacacacgtagcaaaacatgaacactgcatgcatggtagttctttcgacacaggtccaagcattacactgactacacagggatctatttataaatcaaggggcagagttctttctacggccactgatattctacacctataaacattg

SEQ ID NO: 534965 - DNA, 186 bp, Homo sapiens
  misc_feature (19)..(19): n is a, c, g, or t
  misc_feature (38)..(38): n is a, c, g, or t
  misc_feature (105)..(105): n is a, c, g, or t
  misc_feature (110)..(110): n is a, c, g, or t
  misc_feature (151)..(151): n is a, c, g, or t
gggggcccacttgcctgcnttacccacaactgctgggnccctggaaggaattagaatccccaactgagtatgtgcaaggtcgcgctggccagccgtcttcacgcntgtcnctgtgtttgtggactggattcacaaggtcatgagactgggntaggcccagccttgacgccatatgctttggggagg

SEQ ID NO: 534966 - DNA, 895 bp, Homo sapiens
gagggctctgggtattctggcggccctaagcttgagcgcgcttgtctgacaggatctgccagaattcggcaactctctccagtcctacatgggccactgcggggacaatggcggcccggactggggtccacaagacgcggggagagtcccagtaacccccggcgcaagaacccccattcacggtggctcttccctgacggtgtggtccctgccctcaaacttacaactctatcgaagagtgaggggctgctcttacgccctctcttggacctgggaacttggggtccacatggtggagggaccagacccgtaggatgggagcgcctaggctagggcaactgcttttagccgccatgcactgcgagcaattgggaggatggagaccgcggcctctctgctgtggtggccggggaggcgctggtgacacgcatgggcttccgccgtatacacgccgccgccgtcctgctggaatacggggttcccatccctgagcctcagaaacgcaggggcggccgggaggtggctcggctgagtccaggacagccacaacacgggttgcgagacagcccacgctcactcgccgcgcctgcccacaggtggggctcctggatcggtatcgccatcatgacgcagtgtcgcccaggtgagccgagccgccctccctgcggcggggccctgcccctccgggccggcagcccctcctgacgcccgttctttcgttgcagtggacatgttctgcaatggtgggcttcacccagatgaccatctgggcaaagggcaagcaccgcagctacctgaaggagttccgggactacccgcccatgcgatgccaatatcaccttctgctctggcgtacctgctgggctacctcaacccgtacattctgggagatggc

SEQ ID NO: 534967 - DNA, 121 bp, Homo sapiens
tgagaacaaagtactacgacaagatctaatatgaaagcatagatgcacatacgacctctgtcataatcatctccctacaaacagatagcacttctcggcacacgtccacacgaagaacgaa

SEQ ID NO: 534968 - DNA, 878 bp, Homo sapiens
  misc_feature (14)..(14): n is a, c, g, or t
  misc_feature (87)..(87): n is a, c, g, or t
  misc_feature (492)..(492): n is a, c, g, or t
  misc_feature (523)..(523): n is a, c, g, or t
  misc_feature (709)..(709): n is a, c, g, or t
  misc_feature (785)..(785): n is a, c, g, or t
  misc_feature (802)..(802): n is a, c, g, or t
  misc_feature (818)..(818): n is a, c, g, or t
  misc_feature (875)..(875): n is a, c, g, or t
aagcagatttgggngggaacatttagggtaaccacacttaatgcgttcttggtccagtgactatctcaaaacaggaaaagatttttnagtaagttgaccatttgggaaccacttggtatgtcaaggtcatctcgtagaaaagcccaagttcttatgttctctgaagagctctcaaaagcagtcacagtcccagggggctggtcctctaagaatcattttgggactcttcggagttcattcatcagccaaagggcaccagtgggcaaagccaaggggcctgactggtgggtggcggccaggggggttggggcatacttcagcggcgtgctggtgcccaagcccccctgtgtatacgccaaagcccgccgagtccctgctgccatcttggtccttctggggggggggattctccggggggggaagtagggccctgtgatggcagtggctgaagtggttcccagaatccggtggtccaactgcaccctggtgggnttctcaaaaacattcctcagggtgggggggngggtaaaggggtcctccggggtcccgggttctcccattttgggaaaggagttataaacaagcccagcatctagccctgccacaaaagcccctgagagggccgtaaggaacaccagacctgctgttccatgagcaaatcgtctcaactgtaggagttggtgggtttcaggcaacttgtgcggagggngtagcagtgacagtgaggtccacaagctggcacaataaagaaccagggctgatcccaggtgggcagcaaggcggtnctgactgacccgagggntgtcatgggagtctgntttttcttctagtccacttttcacctataccatcccacagaccctggaagcagacgnggc

SEQ ID NO: 534969 - DNA, 321 bp, Homo sapiens
tggtgctgagtatcggcaggttaaccgacagcttcgtgcgtaactgagccgtttggacgtaaatccggtttgggccggtcataggattctgcccgggcgccgtggcaagcgccgggttaccgatggccgacagctgtggcggctgcaacacctggacgctggcggtgatttgcgccacccccggcaagttgatgggaaaactggccaccaggccgttttgcttgttggccaattgcacgaacccctgaatcaggtcgaacacccgcatgttgaccgccagggcggcgacgctggcaccactctccaccgacaggacattga

SEQ ID NO: 534970 - DNA, 334 bp, Homo sapiens
tgctgggaccacaggcgtaagccaccgcgcccggccctccattcttcttaaaaatttcaccaggatggtcatatcccattctttggtaaaacttaaggtcttccaatttataacatgcattataccataaaaggtccaggacctctgtgtagagtgatgtcctggttggccggggactttcaccagttttagcacggaaagaccggtgtccggagaaacccctcagcctgggcaaagcagattgagtagtcactcaaggttcgtccagaattgtcacttctaagaatttatccaaaaagagtactttttttttaaaagacaaggtctggctcgg

SEQ ID NO: 534971 - DNA, 382 bp, Homo sapiens
  misc_feature (312)..(312): n is a, c, g, or t
  misc_feature (369)..(369): n is a, c, g, or t
  misc_feature (372)..(372): n is a, c, g, or t
aatcaatgcttctttcccttccttaaatgtctttcctttaaaattgacttccttccctaaagaaatgctcatgtcctccttgaacttaaaagcaatcctcaggccgggcgcgggtcgcacgcctgtaatccccagcactttgggaggccgaggcgggcggatcacgaggtcaggagatcgagaccatctggctagcacggtgaaaccccgtctctactaaaaaatacaaaaaattagccgggcgtggtgcgggcgcctgtagtcccagctactcgcaaggctgaggcaggagagtggcgtgaacctgggagncggagcttgcagtgagccgagaatgtgccgctgcactccagcctgggtgacagagcnaantccgtctcag

SEQ ID NO: 534972 - DNA, 481 bp, Homo sapiens
acatgttaattttattcctttttttattctttacagtaaccaaaagtatgtaatctacatccttccctagtgcttatctccaaaagttccattttgaaaaacaaggagatatatatatatatatatatatatatatatatatatatatatatatatatagtagaatatcacaggcagaggagggaagaacatctgggtggagacgtaggtctgaatggaaaggacagaaaagaaaaaaaaaggagtggcagattcctcctgttacaaaatactgagctctagttaaaaaaaaaaaaaaaaaaaaagatttaggggagctgtagatgttaatacttaaaaactacattaaggcataaacatcagatgatgtgatattttaactcaaaggtcactgtatataaaacttgagcccaaattgagtaattagtctatacaaaatattctagaaattgccatggtttgttgtctagatgagaaaaaa

SEQ ID NO: 534973 - DNA, 410 bp, Homo sapiens
ccgcccctctgccctgggaaccagtccaaggggctgtcagttgaatttgcctttttgctgttgtggttgtttccgttggttatttgttctccttttcaggaattatgaagctaaagacagttttgcgtcttggggggtggtggccaaagttctagctgcttagcactggtcccccaactagaattctccctggtcctcttttaaagctgcccttcgccatggaaggttgggcctccatgggggtgcgttccccgacagacggggcgcttggcccaaaccgcttcccttgaaaggcatcccctcgcgttttcagtgtcccctgaggcccggtgcatttcccgtgccccttgggtgctcttgacagggggagggtgcctttcttcattgtccgatccctttccctgaactga

SEQ ID NO: 534974 - DNA, 429 bp, Homo sapiens
gactagttctaattcttctgtgtactgtgcagtagagttagaaaaagagattagagaagaccttccagtgaatacctctaaaacccgtccaaaacaggaaaaagctttttccttgaagaccataagcacttagtgatccagccggaagtacttctgtcgaaaaatagcccagccttattcaaggactctttccacctggctactttctaccggagccatcttggtaatcttatcaaaagagtggattctggacaaggagctcttcccaaggtgccggccaatacatacaagagacagataaattccaagtcaaataccaagcaaaatagtggtggcctccttcacagaccaatgttcttggaaaacctagctgtggggaaattcttcccccaaaagcaaaattaacacaaaataacaaaacacaggggc

SEQ ID NO: 534975 - DNA, 1432 bp, Homo sapiens
gccgtggcgtcatgggcggcctcttctggcgctccgcgctgcgaggggctgcgctgcggcccgcgggccccgggcccgagcctgctagatgcgccacggctcgggagggccctcctggacccgggagacggacccatgagtggcggatgaagcccagatggcgatgcaaacggcgagaatcgatgagggacgatgatccagacgactatagagaaggacaggggcattcacgctggatggggatgacagatgcattgcagaggcaccagaggagcgtccattgcacgaagaaataccgaggaccatgcaggaagagaaagccccttcatacccatgacccctcatccgactaccatgcagctcttggggacctagatgagtggcacaatgggtacatggagaagaggtacaatagatcgataccgacgcacctcaaagggccaaaggaattggcacaacaaccgaacatcggatagaagagatgacacccaagagaaccccaataaggggggtgacaaatataagacagatccaacgagttcatgacagggcaagtgatcaaatcacaaagacacacagcaacacatccagatgacagaggagggcacacaagcgggagaggaatcgcaagaaatggaagagaatcgcaagcagacacagaagaagcaatggtatgagcattgagagcaaggaaattggggaaggagcacacagggaaaacatggaaatgaaaattctgaaacccacaagagcaatgaaggaggctacgaaaaacatttggacacttatatagacatacccgcacaaatacaaccacgcaataggctgagggacgcacaagtaagacgtaccaaaacaaggacaaaagaacacgaccaaaaggcaccaataaatcaccaagaaacatgaacctagattcccaaaaaaaaacaacattaaacatatcaccatagaaaaacacaacaataattagaccaccaagcacccaaaacacaagtcagaacaaataagaacacaaaccaaaattacaagatgacctaatcatgtacccaccaaacacaaaacacaacgaattaggacaccacaacactataaaggacacccaaaataccgaacacaaccaaataaagagataaaaaaggaaacaacaacacataatacaataaccatatacataattaaaggaacagcctaaacacaaccgaattgccaacacagtggtggacacaaatcatatcaatccccgacataaggaatacaatcagaactatgaaaatataaaagataaacaaaaacgaaattatagacccataacaaaaacaaaacaaaaaataatatccaaaacaaaaataaaaacagaactcctatgtggtaaagaacacatactaacacaaagacgaacaagtaactctactgatccataaatatacca

SEQ ID NO: 534976 - DNA, 818 bp, Homo sapiens
aggcctttaggccacccatgggcccccaccgggttggcctggtgtcttgggcgcccgcgtgttcccccccaggtttggcaacggcgcctggccacagtgggtccaccccgcccggccccgtcgagtgtccgcccgacgtttgggcccgcgcaacccaaggcgcctgcctcatttgccccgggcccctgcatcgggtcccatttcggcaccactctgtgcgctgccaccaccggttcggtaccccccccgaaaaggtgcgccgcccgtgcccccggcttccccctgtgagaggaggctcacgggtggcccggccatatcgcaccaagaatggtggccccggactccatcgcgccatatttcttgctggatacctctaggagcgctggtcacacaaggtcccaacgggaggtcccttgccagacaccaacagtgtccacgccggctcgcaaggtatgtcacaccgcgtccccagcacatctcatctcttgttctccccagggaatgccctctggcgcccccagaaagggagaccacgttttgctgaacgaacgtgagaacgtggcccacacccagcttgggcccggacccggtccatgcgcccgtcccggaacacgtttatcaaagaaaggatgaaagcatcttgggtccatccactgagggaagagaatgaatttcctaaagccttcctgctagtcctccgtatggcccgttgcgcctacgccccggcttttcggcatacgggccacaaagagcccagggagcccccagaccggatgttgtaaaagaaaaaattaagccctcctggggacgttggaatc

SEQ ID NO: 534977 - DNA, 199 bp, Homo sapiens
tcttggagagggggtctcatttttttgcccaggtgggggggttggggcaaaatttgggttaatggaaactttggcttccgggattaaggggattctcctgcctaagctttcggggggggggggattacgggtttgccccacattgccaggttatttttggtttttttactagagacggggtttcaccaaatgggggggg

SEQ ID NO: 534978 - DNA, 1398 bp, Homo sapiens
ggagagaactagtctcgagtttttgaatggtttattttcctacgtgaggaaagtgcaaattaaaccaagggtccgagcttcttcttccaatcggggggctccatatccgccacgggttgtaggtctgtcccaagtctgtccagctggactgggacgcgtaggacggcgacgctgtagaggacgcacgggagagttaacactagtggcccatgagtgcccaatagctatgccaagcgttgtaaagcatgacatatgcgctaaagggaaggggccgcagcataacggttgctcggaccaaaatgggagcatgaagaatcggatatggatgaaaaccacacgagcacgcatagagttgtacacccagaaggcacccagacatatgaatgagacctagtatcgaaggcgtcgaggcagacccagagactcgggcgtctagaacccaggaaagagacatgggacatctggtcagcctaggacgaaatctccacaaaacggtaatagaacggcgcccatttatataaaacctcggttcccacagagcgatccatcgtgttagaaggaagacagctagaatactgcaccgcgaacggcggaactaataaattcgcggagattatgggcacgatggaaacacaaagtattcacaccgccaggatttaacacatttacaagaacggagagtgtgcaccccaaaaagaggagagtagaaccacaccagcaacaatttgaagcgagcaacaatgttgaacagcgatacgcggggaccgtcgtagataagaaggtcacataccgaaacacagaaacgagcagaagaaaactagacccacaagccaagaaaacaacccccgagaaaaacagcagcaacagaaagaagacaccccacacagcgcaacgtatacaccacacaaccaagagcgagcgcaccagccgacataaaacacaggcgccccccaaagggaacaatcacagtgaaaacacaacaacccccagctggaacacagcaaggctacgaggaacaaaaaccgaccatacaacacccacacaaacaagccactacatcaacccaccaacccagcttgggaccctaccatgccagccgaacaacaccgctcacgcaactggagatgaatcgcttcactcagcaaccacatagatagggacgataattgaacacgcactactcttagtgtcccccagatgacaagagagacaagaacagatagcaccattgatgtacacaacaaatagaggtgaattagagcaactccccacatcatgagacactgtaacaatataaaatatataaaccagagacatcaccctcgaacctagagagcgatcacgaaccgctatacgagaactcagagttgcgacgtacatagctaaacatgatcgccc

SEQ ID NO: 534979 - DNA, 1027 bp, Homo sapiens
  misc_feature (365)..(365): n is a, c, g, or t
  misc_feature (390)..(390): n is a, c, g, or t
  misc_feature (398)..(398): n is a, c, g, or t
  misc_feature (552)..(552): n is a, c, g, or t
acccattggagctgcgtaggaagtgctacaggtgtgtcaggggagaggctgcccaggaggacaagaatgcttccaagtaaaaccccactcttagttccctgttgacataagggtctctaaaacccaaagaccttagttccctgttgacacaaaggtctctcaaaaccccaaagacctttcttttggcacacgggcattgattcgcacttatagtattggtgaaacaaaattggtactgggtgaggatggaggctgtaatgaagggtcttcttatccatgaaagcgcactgacgaggtccacattcgacacaagtgagctgtcgagtcctggaaccacctgcctgtcacttggccagcagaggccngccggaaacttcttcaggatccttntgccatgncccacagattctagggccacagcctggttaaagcagcctccaatctccagcttagggtcaaccatgccagcagtttggccctaaatgctctaaaccaagagaccacagtcatggcagaatagtcccagcggcctctccatgctgggtatgagtnagcatttttacactattttatgaaatcctcacaaataacacccaggaaggtctttttaatcccattatcaggaatgaggaaacccggcttcaggatggttgtgggattcacctgggggcatgaaggtcaggattagcaggcgctggtagcattttgcagagtagcagacagaggcggtaggtacccagcgccgtctgcaacgcgcctctggcttcatgcgctggctctgcatggcctttctgcctccttcccacctctctcccacacttgctggcctcgccacaccttttgtgggaagagcctggaggccccgccccagccttgccaacaccctcctgaggcctgcttggatgtgttttcacaaagttgtgttctaggaaagatgggatgctcttaaacttttactcccttaagagaaaggaagggtcagggtgagctggtgtgcagctcacgtgtctgttgggagggcggccgc

SEQ ID NO: 534980 - DNA, 266 bp, Homo sapiens
aggaagtgaacgagcatgattatagctcacagtagaccttgaacatccatgggctcgggcggtcctttcaccttagcctccagagtagctgggactataggtatgtcccaccaggcttggctatattttatttattatagagacatggtctccctgtactgcccaggctggtcttgaacccctgagctcaagtgatcctccttcttctgccccctgagtcgctgggactgtaggtgcatactatcacacctagctaattttcaatt

SEQ ID NO: 534981 - DNA, 231 bp, Homo sapiens
acaggttcagtgtgcgtgtgtagctgaacgaagtctccgtcaatggggctggttttcccgtggtacttattcagaccagtcgggataataccggagacatttgaggaccatgtccaataccacaggggggcctcctgtaaggcacatgggaggtgactggtgtttcttagacgagaagatcactgaagacaacttctgctttaatggctttacaaatgctggcaatattac

SEQ ID NO: 534982 - DNA, 446 bp, Homo sapiens
  misc_feature (3)..(3): n is a, c, g, or t
  misc_feature (31)..(31): n is a, c, g, or t
  misc_feature (35)..(35): n is a, c, g, or t
  misc_feature (40)..(41): n is a, c, g, or t
  misc_feature (47)..(47): n is a, c, g, or t
  misc_feature (170)..(170): n is a, c, g, or t
  misc_feature (186)..(186): n is a, c, g, or t
tanttgggggtgggggggggggaaatatctntcanacatnncccatnaacactggcatgagcatgggcatcataaaagggagcttccagattatagacaagggaagataggagggcaccattagaaactatccagaagaaggtggctgaaaagggctaaggggggggggncccccaatgaggcttngaggacaggggtgggtttggaaagaggggttccttttctggtggattctttaaagggttcaaagggggatttggtggatttgggggaggtggaggagctgaatattacgtggaggccctggataaagataagaaggatcactggagataatacctggaaggatcatagggggttcttaactctccaaaataagatttcttctctggagcctacttggctgggttatcccttacagaatattagggaagatttaatcaatt

SEQ ID NO: 534983 - DNA, 176 bp, Homo sapiens
  misc_feature (124)..(124): n is a, c, g, or t
  misc_feature (138)..(138): n is a, c, g, or t
  misc_feature (172)..(172): n is a, c, g, or t
tccataatgtgtgccatcagtgctcgagaacaagcaagacataagccagttcctcaggccactccagaaaagttgaatcattggattccctgtctaactgttttttttttccctatccccaggnagaaactgacattngtgtgtgtgtagtgtgtgtggaatgtgaagtatngtcg

SEQ ID NO: 534984 - DNA, 891 bp, Homo sapiens
  misc_feature (81)..(81): n is a, c, g, or t
  misc_feature (94)..(94): n is a, c, g, or t
  misc_feature (113)..(113): n is a, c, g, or t
  misc_feature (115)..(115): n is a, c, g, or t
  misc_feature (127)..(127): n is a, c, g, or t
  misc_feature (129)..(129): n is a, c, g, or t
  misc_feature (137)..(137): n is a, c, g, or t
  misc_feature (148)..(148): n is a, c, g, or t
  misc_feature (150)..(150): n is a, c, g, or t
  misc_feature (156)..(156): n is a, c, g, or t
gctcgggccctggaaagatggaggcagggagacagaggcggaagtgcagccctagaggtcctggtgaggtgcaggcatctnggaacctgtaggnctgcggaggaggcagaatncnagccaagatctngntggagtgntggggactctnanaagaangacaatgttggctctgaagcaaggttccaggggtagcggattccttgcaagaaaaatcctgggctcagggagggaacactgtgttaaggggttctcggaccccgtgtgggttttctcgaaagacagagagcggacagagggcattggcgaggcttaagggaacattggaagagagctgaagggccaccttacaggggagaactgtagagggccaatcaaatattgtgggcttcaacaaagggcctgattcagaattggaggaacgccaaggaggaaaaaggggaccacaaattcgggggaaaaggcttttgagacagcttcccaaggggccaaaggaaaaaatagttggcctatgggaggaacaacgcaaggagacagttccagacacatggtggcaaggatacaaaagaggaggaaggcttctggcagcaatcttggagggaggatttctggaagagggtgaaggggaagtgtaaggaaagggactaagacagggagctgtgagggcgtggttacaaagaaacttggaacgttgagaggaagggaggtcagaacaggagcgggaaaacggttgagaggtatcagacctcctcagcttgtgtataccctgggggaaacgtgttgtcctggaggcgagagtgggggagatattttcgaagtgaaccaagaggggtgaccaagaggaggtgtcggggacctgggggcagcctgtgtgtctaagggggacacggggta

SEQ ID NO: 534985 - DNA, 892 bp, Homo sapiens
ggaggagggggcatggcggatactgtgttgttgaagtttcttcagacggagatggtggctgagctgtgggctcacgacccgaacccaggccggggggacagaagatgagcctgtcggatcctggaagggtatggggttccgagtgggccaggctctagagcgagaggctgccccgggagacgctggccttcagggaggagctggactgtcctcaagttctggtggccacagacctgtgggtcggcgtgtcgtgccaaacagtcagatgtgactaggctgcgcaccaattcaccaggggaccgtacagtcctgcaatacaacagcttccacccatcctccgtcccgatggcgctctggcctgcagtattctgggaggaagcgaccccaagtggcctggccgttcgacctgcggctgcctgatgctgggctccatctatacccatgggctttgagagcgtggtcgccggctccgtgggagccctgcccgtctgtaagttgcccggtggtgattccgagactcctaaggcctgcctcgctcctgctgcgtccgtgacgtgttgcccctggccgtcaccggctcaggagacggtggggcggctgcatttgcggggtggtcttgggaatccctggcctaggggtcacaattgtggtcaggaagtgggtgtcaactagaagtggggggtgtcacgatgcaggagacatggcgtcccaaggtgcggtctaggactgtggtgggatccccgcatgcgaaggggtgctggccagtgcatgccaataaatgctgtgtctgtggaagaatccagtgtttgccacgaaccaaaaaaaaacctcgcggtccctgcggcgtcaaagaaaaccacttcaggctccacacagttacgaggaacggcaa

SEQ ID NO: 534986 - DNA, 1416 bp, Homo sapiens
ggggagtgaggagttgtgaggccggagtggagcccgcgctcggtggcggcgtgctggagtgcagctgcaccgatgttccctgctgatggatccatgacctgactggtggcccctgtgagcctgctgctgcctctcggtgtgtcctgtggtctggtgtggtgatgcccatgtgctcgcatgtgcctggcgggcgggcctggatgtggctgcatgtctccctcgcgtgtgaagacggaacggctggacggatgctgggaacctgctggctggctgctcgcggctggctgccatgcagcgggcggaatgtggcagttcctgtggcctgtggcctgctgcctcagcaagggcggcggtgatcccaagctgcagttctcaatggggccctgtgagtgtgcagggtgcgccgcacttgcgagaaattcaagtttgtcgcgcgtccggttgattgcccctgatgttgaggctgtgtgtgtgtgcccttggtgaccttcttgacccattagtgcagtggcaacttcccaccactggccagctgcccggacagacagggccggcctcttcgacgtgccccgaaggaacgggcatttcgtatccatccgggattttcaggcgagcagtgcaggtggctggacggttttgattagcggccttgatcgtgtgtgacccccgggtgaacaaaccttgaaagttgccccccccgtgccccccgggacttcccttcccgaaacgctgcatcggggcgacaagggttgcttcatccagagagatactttacggaggaaaacaaggggacaattggcggactccttccattgttttgggggacttggagaccagctggggcctggggcaagacagaacaagtcccttggtacaaaaaggtctggcacagggctggggcccaacgattccaggttgaacccaggccagatatccgcaaactttggatagggagttcttccaacagggttcgtcagagcaaccggggtcagaaacttttacaaccaaattgggtctcacggttccaaacccgctactctcgcgactctgtcttggagcacggccactaggggacacaacgaactctcggtgaccgattccttggagcgggcaataaacctttaaccgactttgagtaaccccaaaagcggtacctcagatcacttacgggaatgatgggaaccgtggcggccggaaacgcgcgaaacggcattcgcgaaggaacggactcggccacgagaagcatggcaccacggcacatttatcaagggaaccggtggacacatgagggcgaagccaataatccaccgacactgatcgaccccatcatgcagtggcccgtcccgagtcgcctgaaccccaggaataaccaggcgcgaaagggtgcgctcttgcaccgaattgtgacacgacagt

SEQ ID NO: 534987 - DNA, 117 bp, Homo sapiens
cacctgttacattcgtgtccacgaggagctgcggaagctggggctgtatgttgaaacccgggatggcgctgactatgagggctggtgcgtggccaggctcagctggttacccgtgca

SEQ ID NO: 534988 - DNA, 338 bp, Homo sapiens
taccccaaagcaagccataaaatctaggaagactatctgaccctctcttctcctccctgaagacccttacatgacaagtgtcatgccctatgcccagaggaagaaatgctacacagagagaccaagaaaaatctgaacacacaggactttttggaattcccctcaagttattatcattacatcatgccttttttggccagtcaaaattttaaaaagctttccattctttctcggaccttagctttaggattttcaattttccctgggtctctgggtcttcatttctgagcgctcccatttgatgtaaaattttgattaaataaattttttcttgatta

SEQ ID NO: 534989 - DNA, 748 bp, Homo sapiens
tgggtgaaagagtctcactctaccccaggcgggagtgcaggggcgctatctcggctcatggcaacctccacctccggggtcctgaattcaattcaatttcccgtgccattagccctcctgtgagttagcgtgggattacagccggcgcaccaccagtgcccaagctaattgtggtatttatagatagagacgggatttcaccattattgggccaagcgggtcttgaactccgtgacctggtgatctgcccaccttcagcctcccaaaggtgcggggatacataggggtgtaagccacccggcctgggcctagttttaaagtttttcataagctaaatacagtgttaccttgtgtaagaaaactggccaaccgtggtttccaggagtgtgctgcaccatttggcattccataccaagcaggtgtcgtgaaagcctccagtgtgccccaaattccgtggtcaaccacgtgggatattgcatccctttagggttatacacattataaccatttgagatagcgggtgttgagggataatatctccagggtataaactttacattcccctaattaattacaggacgttgaacaatttccaggcggtataatttcccatcgttttaaatcctcattccgggaaaagtgtcggtacgaggctttaggccatagtgtctaaatggactttggttccactggagaattccacgagtccttaaccatatcgggagtataaactctgtggtcagaattg

SEQ ID NO: 534990 - DNA, 1324 bp, Homo sapiens
gttattccccctaataaagcatattttactttggtgcttattttatcctccttgcagtctaataaaaaaatctggacaatcaaaccttaaaatagctacactctgccctctgataatgtagcatatacataaaaatttggacgtatttacatcctctttcaagatgagcttatatgacacaagttattatttagctagatacatgactaatactgcactttacagtatctcacagactctgcaaatatgtcaacatacaatatttctatattcccagcaaattgctactatacaggttcgaacgtcttattaagggcatcaaaaattaacatctactcctaatgcacgcctaaaatgtatacaaaatactatactaagaacgaactgacacaattactcatcggttgatatatatactctaacataacgggacatactataatgacactgtgtaactgtgacggagcagaaaccatgatgaacgaatccaaattcaagcgacaacgccaatctatatcacacatagggctcacaaatatactccaatcccttgactcagaagactacaactacgtaaaacacgtcataaaaaaacaaagtacactccaacaaattatcgatacacgtagtatcacgaggcgccgaaagccacatcctacacaacattagagggcaacgcaatgaactgtgagtttcaaacgacttacaacccaaccaccttcaattaccaagaatccacactaacattaccatgacaaaagactaagacacaacccatgcacaatagcaccatataataagagaacaatgtatacaataaacagttatcctgaacaaaaaaatacaatacacggaaaagaaaaaagagcgcacgaagacaaactacaaaacagaaaaacaataaaaacaaacagcagataaaaagaaaccgacaatatacagaacacaagaacaaacgcaaaaacacacatgtaacacaaaccaaataagcaaccacaaaacgcacaaacaaaacaatcaaaaaagctataaagttaacacagaacagcaaataaataaaagcaaacctgataacagaaatacaatcactacgagtactgaagatagcagagaggaaatggacaatgactagaacaacatgagttaaaagaacgaacaaagaagcaaagagcaaggagacctcagaacacctaacgacatcaccataaatcaacagataaaaacaacaacatagcagaacaaaggaaaaagagaagataaacaaaagaaagtaatatacaaaaacaaagatactgatatctctgtcttttttaccggctgcaga

SEQ ID NO: 534991 - DNA, 616 bp, Homo sapiens
  misc_feature (34)..(34): n is a, c, g, or t
  misc_feature (51)..(51): n is a, c, g, or t
  misc_feature (56)..(56): n is a, c, g, or t
  misc_feature (68)..(68): n is a, c, g, or t
  misc_feature (153)..(153): n is a, c, g, or t
  misc_feature (245)..(245): n is a, c, g, or t
  misc_feature (363)..(363): n is a, c, g, or t
  misc_feature (418)..(418): n is a, c, g, or t
  misc_feature (438)..(438): n is a, c, g, or t
agaagcaagagggacttctgcggagcctgcagantgagcacggcctctctngatgnacttcggcctcnacactgcgaggaacacacctgggtgctcaacgccctcagtctgtggtgctttctcagaagcagccgcaggaaaccaatccagcgngtcgccctgatcatcaacatggacgagagggaagcaaggacctgtcgcctcaggacactgtcaacacttaactgtggtttgaatgtttgtgnccctccaaaattcacgttgaaacttaatccccagtgcaacagtactgaggagtgaggaggccgtaatgctcgtgctccggggagggattagagcctcatatattatattattttattntgagatgagatttgtattatttatttatttatttttttgagacagagtctcactnttgtcgcccaggctggagtncagtggcgtgatcttggctcacagcaacctccacctgctgggttcaagcaattctcctgcctcagcctctcaagtagctgggattacaggtcctgccaccacgcccggctaacttttttgtacttttagtagagacgggggtttcaccatgttgtccagactggtctcgaactcttga

SEQ ID NO: 534992 - DNA, 556 bp, Homo sapiens
ccctcccaaattttaaaaaaagaaaacccaaaaaaaaggggcaaaagttaaaaaaaaacttttttttttaaaaccggggggtggtctcccccccccaaaaaaaaaaacaccgcacaaagccctgccaactcacttttttttccttaaaaaaaagggggggcggccatctttttaaatcgcaggtttaaacccaaaggcgtttttccttcccacaacaaattttacccccttccggaaaaaaagactttcttataccacagaggcattctctctgaatccacccccctctctacaaaggcgggcaacccccccccaatatgcgcaaatctcccggccccaaaataatgctgcgctccccggacaaaaaaaaaaaaaacctcccccaaattccgccactctggcaacacatgagaaaaaatgtttactctccgtgacacatatagttctcccctcaacaacaatcataaatcattctttatattttcccgccctccataaatcaacaatacaccccactcttcttaccacacgtaaaataccctctacaatcttcccg

SEQ ID NO: 534993 - DNA, 1935 bp, Homo sapiens
  misc_feature (1394)..(1394): n is a, c, g, or t
  misc_feature (1446)..(1446): n is a, c, g, or t
  misc_feature (1763)..(1763): n is a, c, g, or t
ccgtctcctcggcggtctgtggttggtggtatcggtctactctctcttctgtctctgttgagtggtggtctctctctcctgtcggatcttgttatttctttatttagtgtctgcgtgcggagcgttgtacttctgttttcttccgtcgggttctgtttgtgttcgtattatataggattttggtggcggtctttatagaatatttcttctccctatctggtgtttcgttcgtgcctcctgcccttcgtcgtctttgttgcgggatgttttttctttccttgctgcccgggggggtcccccccagggcagtagatacttagttccccccctgttctccttggtgagggaagttggcgtctggcttttataggtcctcttctctcgtctgtgaaggctttcctacagggggtgttttttaaacgtgctcttctggggggggtctcccatcgccaagcttctttatatgtgtcggcagtatttttcctcccccgccactctgcggattgaggtagttgtgtcgccgcgggttgtttgtgttgccgcccccgtggttccacaccggaagggtgttgtgtaaagacacgtcccccgccgagccgttggggtgtagtataagggggacgacccacccttgttgtgggggcttccacccttgttttgtgtaacatttgtgggacgactttagatgggtggacacgttcccgccgttcgtatgtggccgcctcattgtttaatctttgtggatttaggggggacccttctagtccgcttggttctctttaatgttctctttggtggaaagtgcccccccgctcctgtggtgtgttgcaaaccccaggaagggttcctcacaaaccctctattttaggggccgccccccttgtgggccgctaagatttggtgtccttcatgagccgcccttgtggtagtcaccgcctcctgatccctccgttatttacgcctcggtctcaactagggtggtgttctccaagaccccccttcagacctctcctccagagaggcgccctcttttttaggtcgagtgtctctccgcagaacacacaacatgaatggcctctcgggggaacactgttctctcttctcagagcgttctttctcctctcttctttgctctcagaagagatgttctcccgctgtacactcctctttttagagagaggatagatggggtgttacacccacaccactgggacaacccaggagtgctctttcctggcggggtgaaattctttgtgagaaagagtagatagagtataggggggttatagagctcagatatagcgcactcccgagcgctgttgttacgatgtacatttagaatagagggagacgctctcttggtgggtgtatgagataccccccctggggtgagntctctctccccaccaccgtggacatttagagtgtggcacacaggatgagacnttctctatatagatgagaggcccccgtcttgttatcaccggcttgtagacggctagaggtgttatatagagcacaacatctctgcgcgctgtggcacgcacccacatagagggtctctgttgtctgggacacccagagacacatatattctcttgtagactctatagagggaattaggtctccacaacacagtccagagatatagagtggagagccccacacccgtgcttatccaggagagttataacacttttggacaagagggtaccaaagttctctctaacgtggatctccatccagagtctcatggtagactnagacctggtaggagaccttgccaacatgttattagaccagccagacgtgccccatatagtcccatgtggaagataaccaaactgggttttgggttttttttccccctccgcgtttaaagtttaagggtaaaggattttaaccccttattttaattaaaccttggtttccaga

SEQ ID NO: 534994 - DNA, 962 bp, Homo sapiens
ggtttcgacagcgtgggtggcggcgctgagtcgggtccccccgcgcggacggagaagccgaccgcactacaggtacctgaaggagttcaggaacggagcgagctgcaccccatggtttgtcatagcacaagtgcgcgcgagtcatcggccgttcactcgtgtgttccactggcacattcctcaatcagcggcgccgcaggccgcactcgcgcaggcgcgactggtggcctttcctaactacaggaacccgcggactgtgtactgctcctaaagtacaacggaatgcctaggcggctggtgtggcccgacggacgacgagtgtcccttactctggcatcgcggacgacgggggacgacagagatggctagagtaccagctggcgttactacaaatagcaggaacctgtcggtcctctagacagacgcacgtggccgttgcgtgaggaatgggttgcactggtgccttcgcgcacgggcccctggacctgcggacgccgtgtgtgacgtcagggagctgcaggcccaggaaggcttgtagaagggccaggtgggcggcgggtaaggggtcccggatctgcaggctgtggtcttggccagcagggcatgattgagaagatcctgagtggaggagccgccggtggcaagatgccaacgttcagtgctgggcaggctacaaggacggagtcagtagcccgaagacgtcacagccttgttgccgccagggttatgacgtgccatcactaccacaatagccgggtacaggtggtgcaaacccccggcggttccagtacaaggtccatggccctgccccgacgtgaagcacgggatgagtggggggggcacccctgactgcgaaggcggaacctgtgccagtttgccacccggacgacgggtcggccgagaccaaagggccgatggcgaatggaaaccggtttcagcgctttggcttgccttaaacgtga

SEQ ID NO: 534995 - DNA, 527 bp, Homo sapiens
  misc_feature (318)..(318): n is a, c, g, or t
taggctgtgggggttgcagtgagctgagattgtgccactgcactccagcctgggcaacagagcgagactccgtctcaaaaacaaacaaaccccaaattggattaagtctctcttggcttaacaccttccaaagacttcccatcacacttgacaaaaaatccacagtctccacaatgccctggaaggctctctgtggtccggctccagcccgcctctcagatgccatctcaggctgctccctgtcactcattaggatcaagacacaggaacttctttctctgcctctggacatgaagctgcccctacctcgggttattngtagctgctgttccttcttggaatctgcttcctccagactttccactctcctctcagttcagacgccacctctccagaggggccttccccgctccccacccactcagtgtctgcacctgcacacctgagcatgctggagaaaaagttctcaatcatgtgtgaccgtggcctcaggcgggccctcaggctgcctgtgacgccactacagc

SEQ ID NO: 534996 - DNA, 124 bp, Homo sapiens
  misc_feature (87)..(87): n is a, c, g, or t
aatcctgtcctcagaaccgggagacacggcactgtatctcgcgacagcaccagccggccggcccagcattttggtgatgggactcgnctctccatcctagaggacctgaacaaggtgttcccac

SEQ ID NO: 534997 - DNA, 181 bp, Homo sapiens
tttttttttctattcacacaccaaatactattttttccaaaccctcaaatgtccagtcatgctatcccaaactttccaatggccccatccccaagcttggtgttccccgacacattgctttggacttagtaattaccccccctttttttcctttcaataaaatgtccatttccttgataca

SEQ ID NO: 534998 - DNA, 204 bp, Homo sapiens
  misc_feature (52)..(52): n is a, c, g, or t
  misc_feature (109)..(109): n is a, c, g, or t
  misc_feature (175)..(175): n is a, c, g, or t
  misc_feature (198)..(198): n is a, c, g, or t
ggtggaccgaagtgggaccgctggcgttataagcgagtcatgtttgctccanggtattacctcaacgatgcagggtagactcgagtctatactgtctgaagacatttgnagcccgatgggtacaagcagtaccgtgatcatgcccattccgtggcgtcggattcatcacccgagnagtgaccaacagctactcatcgnacgagc

SEQ ID NO: 534999 - DNA, 445 bp, Homo sapiens
tgggtgaggtaagctgacacagtcagggcggggctgccagtgtgcgagaacacaagcccgctggatggtgctgcaccctgggtccctgctgccctctctggtacttcaaacatgcctcaggttggggatgccttcttccattcccagacagcagtgtgagggtgcagggaccaagatgtcaagctggccgggagtcgagtggccgcgacccctttcaccggttatgacgactttttggtgttctggctcggcctggaaaaggcagagcctagagagaaaaaggtggtggacagaccagggtggtcttcaagctggcccagtgagagtaggcccccgcacgcaagctcaccactcccaggggcctttcaggtcttttaactcagaaatttatcattatgtgatttgtgtaaataatgagctgggcaataaaagggatttaaagcaa

SEQ ID NO: 535000 - DNA, 145 bp, Homo sapiens
ccctgggagaagatgggccaataaatacatgtttcaaatgtcggctcatgcctgtagtcccagtactttgggaggctgaggtgggaggatcactggaggccaggagtttgagaacagcctggccgatgtagcaagaccccatctc

SEQ ID NO: 535001 - DNA, 909 bp, Homo sapiens
  misc_feature (889)..(889): n is a, c, g, or t
ttggttaagatactttgacaggggttttccgtttcatacaactgaaagtatcctgacttaaacaccttttgaggttctgccccaagcctttattgattttctcctcttgaatcaccaccagcatttctgcatttctcttagtaccacgttttttctattccccacacccaccaccccctctcttccctagctgtttctgtctcaaacaatacagggaaacattttagggtgtctgacagatcacacccacccctttctcagaccttctcaaccacaaggtgctctcccacctccagcgaggtttgtacttcacagttgatggggtcccggtagattcaggctgggcaacctgagagtctgtctcagtaacaaagggaaccctgcgcccagctgaagtgcaggcaatgtttacccgaaagctgggggtgggtccgcatttccaggaggaagccaagactctccctcatcctctgcagaaagaggaaggaagcgtaaacagagaaaaacagtagcagagtctgacagcgtgggtgctgtgtatggttgtgcattttgtgctctgaaaggctccgatccctgctaaaggcgtgcttctagattaagaggctctgtcttgaggtctatggttgtagattgatcatcactcatcgatttggcttagatatttgagtgggactcaattctaatgagacgtgataaacaaagcttctcgtgatcttatgatgagcactaaacatttatacatgttgataactaattggtagtcatgagtagaattggtgtggtttctgagacggctttaaaaagctgttgcgtgcatcctcggccataagattctcgaaaagctctatataatcggcttgatattaactctaaatcgcgtgcttgntaggacctgggtggtgtacg

SEQ ID NO: 535002 - DNA, 783 bp, Homo sapiens
caggagaatcgcttgggccctggaggcggaggttgcagtgggccaagatcacgctactgtgctctgttgcttaggctggagtgcagttgggcaatgatggctcactgcagcctcgacctcctggacgcaagccatcctcctattttagcctccgtagtagctgggaccgcaggcacacgccaccctgcctggctaatttttactttaatgtgtagagctgaagtcttgctattttgtccaggctggtctcaaactcctggcctcgggcgatctgcctgccttggcctcccgaagtgctgggatcacaggcatgagccacggtgtctggcctctgcagttattcttattctttgcttctctcctggagacctgcttcttgcccttccccattcatgcatagagaccacagggtgtgggctgagtccccaggctccccacctcaccccactctacccttgacttccattcctctttggtttaagcagaactctcaatcttggcactgctgacatttggggctggatcatttcctggttggtgggggctgtcctgtattgtaggagtgtggagctggaaccatggtctccaccccatgtggtcctggggagggatccccttcccccccagggcatgaacaacactaatgttctccagacattgccaggcacgtctctgcgggaattaactcttcctgtctgaacttttccactcgggtcctgtctctctctctggtaatatcctggcgggcgggtcgcctgacccccctggggcggggggggtccc

SEQ ID NO: 535003 - DNA, 188 bp, Homo sapiens
  misc_feature (185)..(185): n is a, c, g, or t
ccattctccagctattcctaggcaaaggagcctcatggctaaggcaagcctcaaagccagccccttcctccaaccttatctttgagtagctccagaggccttggttccaggcttttaggttcatccttcagttgggggggaaccgtaggacccaacttggagcctttggagggagatgagagccnttt

SEQ ID NO: 535004 - DNA, 402 bp, Homo sapiens
  misc_feature (402)..(402): n is a, c, g, or t
aggcagagtctcactcatcattctgctcaccgatggcgaccccactgtgtaggagactaaccccaggagcattcagagtaacgagcgggaagctgtacgtgaccgtgacagactgttctggctgggctacggcatcgacgtcagctatgccttcctggagaagctggcactggacaatggcgagctggcccgacgcatccatgaggactcagactctgacctgcagctacaggacttataccaggaagtggtcaagccactgctgacagcagtgaccttggagtgcccaagcaatgccagggaggagggcactcagaacaacttccggctcctctgcatgggctcagagatggtgtaggctgaggctccaggaccgctagtctgatgagctcacagccacgn

SEQ ID NO: 535005 - DNA, 192 bp, Homo sapiens
cacactactggccatctgatctataaacggtgcatcgacaaagaaccattgaaaatttgagaaggaggctgctgagatggaaagggctccttcaagatgcctgggcttggaaaactaaactgagcgtgaacgtgggatcacattgatatctccggtggaaattttagaccacagcactatgtgactatcatg

SEQ ID NO: 535006 - DNA, 151 bp, Homo sapiens
ttaactctttgcgacaggtttcagtcccgttacccaggctggagtgcaatgacgcaatcttgtgcacagtggcaactccgcctcccaggctcaaggaattttcctgcttcagcctactcaggtagctagggctatagagtgcccgcacacc

SEQ ID NO: 535007 - DNA, 179 bp, Homo sapiens
ggtgggcagccttggactcccctgggggtgtcccactcttcttccctctaaactgccccacctctacttatccccccgcgcctccaggtccccaccacgggtatgagcttaatctgctctaggagtgtgtgcgtctgttcccctctcctttggagcatagattatctcctgcaaaatcg

SEQ ID NO: 535008 - DNA, 825 bp, Homo sapiens
ggagctggtcggagaaaagattgtgactagagttggcagagtggtgtgacaggtgggtcggaagaacatgagtggtaggcaagatgtagggtgtgtgggagataggtggcagggggacttgtaatagtagcaaggtgtagtttggcggaagtagttgaatgatgcagaggcaagggatgaagactgcaggtaatgggtctggagggtagtgagccggacgttgtgtgtgtagtaagaaagcgtaagtaaggtagacgggattgggtttggaagagtgtgctgtgtggtgaggacttggggagcttttgaggaggctatgagagatgcggtaatgttgttcgaggagaagcacaggggaccgtggatatccgtggccgttgatgtactgtgtcttgttccttcgaattgcgctgaaggggaatgtaagtacatggttgcaggaagtcaagcaaaagcagaataacaggtgttatttgctactgagatggtgatgtgccaatggcagtgcaggttggactgtgtttgagcccccgccatatgtgcttagagttaggtggccaagtctgcgtctcagacttgacctctccagtgagatgaaaaatcctgttcatttgggcagatggaaatggcaccacagagagtgccccctgctgtgtagagaaatatggccgtgtctatcctgaggtagggtgggagaagaggagaaagacagggggatggtggggagagagagagaaagagagatgtgagaatctccgaggccaagccaccagggaaaaaggacgagagcacatcggataggaaaacccttttccaaaaaaaaaa

SEQ ID NO: 535009 - DNA, 178 bp, Homo sapiens
cacgagggaggagagcgtgtgtctcactgtgggcatcacggacgcacgtgcacatcacgaacccctcctccgtatcacagagatcccgtcgcccaatcaaatgcaccatcggacgaagaagaaacaccacaggaatcccatctcttggatcggagaagccgtcgagactgtctggcaa

SEQ ID NO: 535010 - DNA, 908 bp, Homo sapiens
gccgccgagcggctgtgctcatccagcagcactaccgctcctaccgccgcaggcccggcctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctgggaaggggtttcccaacgggattggccaattgaccttggccacggcttttttcaccacctggggggcgcctcgtgcagtcttaacgagggagagggctttcttggggcaggggagcccctgtcggcagctttcctgttcacctttgttggagccctctgtaggcctcctccctcctccccagccttgtcccaaccctctcctcgtccctcctggtcgtgccccgtctcttttggtcctggctccagaaaaccgcgccccaatactgcatcttccgctgtgacctccggagccctgctggccctgtccccagtcctcctgctgacccgatcggcccctcctgattgccttatttatttgttcgacgcgtctctgaatgtatccgcctcggttccaccatgtcttcgtggcacgccctcgtgtttcagggtgaccgtgtcccacccgactccgcatgttttggtctgtttcctccctctctggccctgtttaacccatcaaccgattctggcaatgactcaggcggaggggaaggtggtgtacataggaacgcgtgggagtcggccgtccccgagggagggtttgttcatactgtcacataagagatagtgagaaccattaaggccggggagggtgagggggtgggatcaaagcggggcccgcggccagggctcaatggcagcgcggacgcagcgtaattgccgc

SEQ ID NO: 535011 - DNA, 178 bp, Homo sapiens
  misc_feature (34)..(34): n is a, c, g, or t
gaagctgattgaagcctcacatctcatcacagcnacgtctgcatgtctctcctctataatgtgtgaacacgtgattgcagtgctcatactcgctgtctccggatgccaaccacagcgccagcatacagctttgtgttcagaaattaaggatattgatcgaggactccgatcagaactt

SEQ ID NO: 535012 - DNA, 97 bp, Homo sapiens
taaacgcgggtcgccatgctcctgcccggcactcccggtgggagcatggggtgcttggttgtttccttcctaataaaataaacgcgggtcgccatga

SEQ ID NO: 535013 - DNA, 680 bp, Homo sapiens
gctggtggctgggggccagctgggcgagctgcacaacggtacacagtatcgtgaggtccgccagttgcctgctcagtggctctggccaccaccttgttgccgcttctacttcctcactcgtgtttacttccgagtaccttgaggatgttctggaagagtctgacatatggacctgccccggtagcctggtgatcatcaagtcccgtgcctctgggatctctccagatatggtcgcatgctcaatggagagcatacgcgggagaacctggagcgggtgtttgtgcgcatgtgaccaggtatggcctagacatcctggccatgctggttgtggaacatggcgatgccccgtcggggaacgtatcactgggggtttgctcctgccagagctccagcccctgggaggctccctgcggggggatgtggttgaagggaacttctacagtgctacgcgggccggggaccagtgctttgatgtcctataactccactttcacttccggtcgatggagtacagcgaccgtgcatcggtgatggtgtccagctgtgaccagcatgcacaccggcacgtctcacaactgttctgacccatgtggctgacgcctgggcgtgagctgccccagcgtggttatccccctgacccgtggattgaggactgggcgcagatgatcatccgttcagga

SEQ ID NO: 535014 - DNA, 236 bp, Homo sapiens
tgactcgacgctcggtacccttatcggaaagcttctagatcgtaccgtcagcctggttgttcaagggttcattgaacatcttctgagttcaggctcattcttgcggataccaacagcaacgccgcgaccagaatgccacccttgaagtacggaccggtcatgacgatgtcttcatatgccggcttcttggctgcatcggagaggtaagccagcgaggcaacaaccagatggggatc

SEQ ID NO: 535015 - DNA, 201 bp, Homo sapiens
  misc_feature (132)..(132): n is a, c, g, or t
tgactctaaggatccccgactgcatcgaatgccgcgaatccggatgcggagatgggcgccgcgaggtgtccagtgcggtaacgcgacgatcccggagaagcctggtggtagcccctggggaggagtactctntttcttttgtgaagtggcagtggcgcccttggaattgggttctgcccctgagagatggggccctggtgc

SEQ ID NO: 535016 - DNA, 139 bp, Homo sapiens
  misc_feature (26)..(26): n is a, c, g, or t
  misc_feature (94)..(94): n is a, c, g, or t
  misc_feature (123)..(123): n is a, c, g, or t
  misc_feature (128)..(128): n is a, c, g, or t
gtgaacactattgaaacttccgcttntttgctaaaaaataggcaagttgaatagtaatcaaaaaaacataaggaaagattttagttcaaaaatngattggcctcctttcgtctaccctggacnttcancaatcaattgt

SEQ ID NO: 535017 - DNA, 587 bp, Homo sapiens
ttaaatacaatcctaagttatcccgctggtagctgtggtctcgctggaccacttgcggcaggctgtgcatgaatggggacatggagatctcccatggcatctgtcgcatcgctgtggccctgggcaagaaccattcccggtccttgttggaccaggtagagcactggcagagtttcctggcactcgtcaacataattatgtcctgcacaggcatccctagccattatcctgtcaatgagaccaccagctccctaaccatcaccttctggtacacactgcaggatgatattctatcctttgaggcagagaagcaggctgtataccagcaggtgtaccggccagtctacttccagctgatggatatgcttctgcacaaggcccagttcccttctgatgaggaatatggattctggtcctcagacgagaaggagcagttccgaatttacagggtgtacatctcagacacgctcatgtatgtcctatgaaatgctgggggccgagctgctcagcaacctctatgacaagctgggtcgttggctcaccagctcagagtgagccctactcctggcagcacacagaaggccctc

SEQ ID NO: 535018 - DNA, 364 bp, Homo sapiens
gtagacacgatttgacagtggacagttcccatgagtaacataaggcacaagggtccaaggacttcacttacattcacaataggcatcagaaaatataacacgagagctataactgaaaagaagagtttcaaaatggaaaacattagggctcagctttaacaccaattctaataactagacacattatttctataaaaatctatcatttacaaaagcatacaggagttcccgttgtggctcaccgataacaaacctgacaagtatccatgaggatgcaggtttgatccctggcctcactcagtgggttaaggatccagtgttgccatgagctgtggtgtaggttgcaggcaaggctcaaatctgg

SEQ ID NO: 535019 - DNA, 228 bp, Homo sapiens
gtttgaatatcttaatagccatgcatcctcttgaatctgcggtaaggcttcgaaacattccacggctcaccaatatcttctttgtgtctcttacgttttctcgcgggaaaattggttttgtctgcccaccatagccacactataagccccataaggaaaaaggactgtgtctggggccatcctcatatagatccagcctgcagtgcatgccttgcttggtgactcggc

SEQ ID NO: 535020 - DNA, 151 bp, Homo sapiens
gtgttccttttctggattgccctcccttctgctcaatggtgggagggggttttttttagttttttttggttggggtttttagggtttttatggaaacaacttttttttggtgttctatgtgtatatccccgtgggcctgttggggagatgg

SEQ ID NO: 535021 - DNA, 1555 bp, Homo sapiens
ggagtctcgagctattcttcgtatcgttacgccggcgggttcgcgcccttctcgcgcctcggggctgcgaggctggggaaggggttaggagggggctgttgatcgccgcgtattaagttagcgctacggggcggccatgtcgagccaggcgcaggtcagcagcagccatagtagtcaggcagctagcagcggccgggcaccggcaggggcatgcaggcaggcaagcagtaggactctcataggccggccccatgggcacgtgccatgtgcaaccagcagcatgtataggccaaagagggcaacgtcagcatcgcaacacatgcacagttagcaacagggcccagcacaagaaagcaaacatgccccagatgcgtcaatccatcgccatcgtggcacacttgcacagcatgcacacacatagggttgcacaacatggctagtcaacccagacaaccgggcacacagctgcacctgcaagcacctgcacacgcatgccatcagtcgcatccgcgtgcaccaagcggcatgcactgcatagcacagcaatagcatggtcccatggtcccacatcatcacgggcagcaccaatttgccaccacaccgggagcaagcccaaccccacccacggccgactagcgggcacagctacctcggggccccacccaacgccacacccaatggctcaacagagaactttacacacacactccccacaaggcacaccgcggagcagcaaaagcacgcagcagcattacgggcacaacaacacacacaagcggcccaccaccagccagggccacacaaaaggggcacgcgcacaacaaccaggccagcacacagcacaccacatgagggaacacgaccaactaccacacacgcgcgcaggcactagcagccgaatacactcaaaagaagagcgaacccaactcatcagtcggcagtctcccgtcaagacaggaaaaacgacaaaagaagactcgcaaaattgacggaccgcgacacaaaaacagcgcacgcggaccgccgacgagcgcacaacccacaccaaaccctggaccacaacacatcgaacgaccaaagtacacacagcggcacggaactaacaacagcatggaccacagcacaataacaccagtggcgacaacagcacgcgcactccaagacagcggcagcctgacacgaacaagaccagcaaagcacgcacgagcggacccagacacgacagaaccaagccggcgcgcaagcccacagctggacgcaacgcgagagtcttcgatctcagccaccgacatagacagacgcccagtcacctatacgcagaacacgaaacgacgacaagcaacacgacgacacacgaggacaagccacacacgccacgggcagaacacaagccagcagcgaggcacacacacgcacacgcacaagcaacacagcagaacacgcgccaccccgcgacgcacacacatcacagcacaagatcacgaagcgagacagacaatcaaccccagcgcgcacacacaacacagtctacacccagcaacgaccgcgctgtcgc

SEQ ID NO: 535022 - DNA, 190 bp, Homo sapiens
aaaccctaataacgataggcaatagtttcaataattacgagcataggaattaatggggcgggtgtccttgtggtagaaagtgggctagtgatgttttggttttataggcggaatcctgtgcaatacgagttgctagatcatacgggggattgctactacccacggtttataggactagtttgtgtaggtg

SEQ ID NO: 535023 - DNA, 1654 bp, Homo sapiens
cgttgtagctgcgttcgtttgctcctgaccatcgggctgctgtgtctcttgatagacgatctctcctcgtaggctttgttgctgcccgaccacccagcttcatcctcatgaattgcggcgatccacttcacaacgacgggtttcaacaacaggggtgtcgcttagatatgaatgttcttcggcccaccacaagtgtcttttcccctcgactagaccaccctggctggaagatttttttgcgaacacaccgttttgcctttgtcttctgttgcattaagaaggggggacacgaccacattttctgagaggagaacctcttttgggtgtggtgataatagtaaaaagaccctgttggctcgtcgagatttcactcacgaagtcgccgcccgggccccccccgtgtttgtgtaccgccacgggtagatcatagagggagggagaataagggggggggaccaacaataaccgttgaaacaaccgggcgttgtcgcgagaagaagcacagaacggccttgtgatcccccccccccgcgagaagcctgtatatccccccgacccagaagcattgtgccggcccacagggaaatggttgttttccgcagcaggaaatagcaacaccgcggccacgaaggtctacacagtgttagagcccacatggcaccaaaagggcggagcacaagagatgttttctgtgggagaacccctccggggagagtttttgataaaaaagggggggacccacctcttgtgaaagggaaatttgccccctttccgcgccaccagtcgctcaatttctcctttgaggaaagtggggcgcgcccccacaccacaaagggccccaaaaaccccacagagtcgttgtggtcttctttgggccaacagagaggaaaagtcgtgtttcacttctcacacaggccccctcgtataaaaagggtgtgttttgggagaactctccccccacataaaaagcgccacctctgtaggatccacagcgagatatattatggggtgtttttcccccgctcgtgtcttgagaagaatgtggagcaccctcgtaggagatcgagatatatctcacaacaggcacaccatcttctcatatctcaccgcagagagagattgtgatatgtgagatattctctctcccctgtgtgcgcacacagcccacactctctctgtgagatgatgacacacccacacaggagagagattattgaggagaaaaactctcctgggtgcgcctctctcttgtgtggagaggagaaaccataaccacactgtctccccttgagagtggtgctcccacagctcattggagtccacgagaagagcctttataattaataataatttgtcactccccaatataagctctaaaatataggagaaaggtttcttcacaccacaggagattaccacgggggatagctaacctcaacacacgcctgtgaaataatatatgcccttataatcactttttattaattataaactctgtataaataagaagaataaatccactcttttttaaaaatgttttcccccacaaccactaaaaccctcaatataccacagtttgtttctaagtaaccacacaaacactgagagaaagaaagtttaagtagctgtgaaattaaatgacctccccagacca

SEQ ID NO: 535024 - DNA, 263 bp, Homo sapiens
  misc_feature (196)..(196): n is a, c, g, or t
agggctaccttagagaagtgaccattctcagctcagccatcatgggaaactaatcctgttgctggtgatttgttcagtagtggacatgacacatgtgggaggttggtgaggctggggtcccagtggcttttagaaaaatttctccttgatcttaagaaaagagatgcagagagaaaagatccttgggatatttgtntgctgctctgggtgtgacctaccggggcctgtggccagcccatacttggcaaccccaggggggcaaa

SEQ ID NO: 535025 - DNA, 1074 bp, Homo sapiens
agcggatcccgcgggccgggaagccgggaggagcggaggtcacgcttcggagctcgtcccgtcccttgctcgttcggtctccatgacttgggatgggcggctagctgcggttcgtgcgctcgttgctacagaagtctcaggctctgggcgcggacctgggacgccaggactgacccatgtatgagtcgcccgcacgctcagcaaagagctggcgaagggagctagtatagcctgaactaaaggacatcaaggtgtgcgaagacccagctgcgtgagacgaatgcgattggctcgagtgagcatgatccagctagttatcgtggtactatcatcagatggcagaagctcaatgcgtgcactccacggtggatcatccgagcatagaaggctatgtttcgaacctcgggcctgccgcaatcacggttggaccgagacatcgagtgatcgcatcgagtcgacacgagttgcgatcgtcgtggaagcattggaccaacgcgaaaaaacgctacgaaagtggtcgtggtcggcgaaccgcttgtagaccatcgatctagtcgccttgaatggagggcttcaagtcgattggaaaggaggtttcagaaagggttggaatagggaaaggcatcgctgggggattcaaagttcgcagggaaatgggagacaggttgatcgcaggggaaaccaataccatagccaagtcggggtggggatggtgtagctttcgcggagcgggagccacagcgattcggatttgtcggccaaaagaaaaggaatccaccaatctggccgcttgagaattgccgcccctgggtggcttttgggggaactcgggaaggtctccatattcgagtggaatttttgaggccaagggggccaacaggcagcgctaagtggtgtggaagtatgccttagagttaagcaaatggggagaccaattggggcaagggtaacaggttgcggatccagtgaagacagagggattggcggggaccacgtttgttgcggagacatattgggtgtgcgttacaaaggtccacgaaggacaaggaattgggtcgaaggtggagattggag

SEQ ID NO: 535026 - DNA, 1012 bp, Homo sapiens
tccggtgggggcggccagatgccgcttggggcctgaccacatgggtgccaccgctggtgcccccagccggagtttggggtgattttgccccagaccccgggggggtttgctgtcctggtgtttcgggccccctcttgccatgttggggtgcccgacctcggccctgatgggggttgtctctaaccggcggttctttctcctcgacgaagtgtgcgtgtgtctcaactctgttgtgcctcgcacactctggggggtttatatttttggagggatgatttttggtgggtgttggtgggcccccccccggccccaatgggggtccgacccccctctcgctcttgtgctatggcccctctcgcgcgggatgagtcgttgggggagtataacgcccctctctttcggggaagaaagagagattgtgtgcccctctgtgaagctgttgatattctcgagtatttcaccccccctcgcgagttttgtagaggacactctcgggtggacttgatttttttgggccccctgggtagttggagaggtttgcacctcggtgtcccccctgcgggtgttgtataacgcgtgtccacgcgggctcgaggtgtgttttctcggggaattgtctttcttagagagagctcggggccagagaacccagctttgtgtgttgtgtcttggccggggttcttgtgtccgaggtgttgggaaagtgcccgagacctcttgggggaccccgctttgcactcttttgtgtaactgggaggtgctcttgggccccgaacacccgtgggctgtgaccttgcgtttgaggtggagaaccggtttgccatttacagccctgtatagagtattctattttgtaatgttaagtaaggttttttgtgtacacgccgattgtcgagttcttttgaaaagatgacacaccaattttggttttttactgttatgtcgggcaacctttggccccccccacccgtccttgttgttaagggaaaattaaagtgctccccgttaaaaa

SEQ ID NO: 535027 - DNA, 109 bp, Homo sapiens
  misc_feature (3)..(3): n is a, c, g, or t
  misc_feature (70)..(70): n is a, c, g, or t
ctntcctgaatatcacactagtttccccatttctctggctgctgtgtgatggtgttttggaagggagcangccagagaaactctgtaaaacaaacaccagatcttatca

SEQ ID NO: 535028 - DNA, 260 bp, Homo sapiens
tattgcaggtggtgaatatgcaaggcggtacactacgcaggggacagcgtcagaaatcctctgttgatgggagctggagcgtgtagagtgcttgattgttgtggtctcgaaatggtgtgctataaagataaaggtgaggggaagacaaagcacaccatgtgtccactgttctggtctgatagaggaaatgcagagcccttgtagtgtattagataagcaagggcactgtgatacagtggtgagtgaaaggagagtgtggt

SEQ ID NO: 535029 - DNA, 413 bp, Homo sapiens
atctgtgtttacgcaggggcctttcttgccctgcctgcatactactacatacacttcatggaaatcagtgtggattccatacacacagggcatcccggatgcggggaaatcgctgtgagttctgttcgcacaggggtgtcacacaggtgggggtcattaacgctatattgttgcatactatttttcatatgccttacaatattttctggaacgttattaaaacgaaagcattttattgccaaaataaatctatgttgttacttctgcattagcagtagaaaaataatgtagcaaaaatatatattgtacagtacaaaattatagtatatatatatattttgccaataaatgaaaatagattgaggagaaagaagcacatttgttatagcacaaacttacaacaaaacccactg

SEQ ID NO: 535030 - DNA, 832 bp, Homo sapiens
  misc_feature (4)..(4): n is a, c, g, or t
  misc_feature (153)..(153): n is a, c, g, or t
  misc_feature (155)..(155): n is a, c, g, or t
  misc_feature (277)..(277): n is a, c, g, or t
  misc_feature (382)..(382): n is a, c, g, or t
  misc_feature (459)..(459): n is a, c, g, or t
  misc_feature (464)..(464): n is a, c, g, or t
  misc_feature (575)..(575): n is a, c, g, or t
  misc_feature (824)..(824): n is a, c, g, or t
ggcnggaaagaggaggcaggaaagggagacaacagaaaccggggcagtggggagatgagacatggagtaaggtttcttccccgcccacaaggttgtaggcagagcacagtgaacggggacgtgtcttagatgacaagactgtcctcccttaanancagaaagaacaggcagatgtgtggaaaggtttgcgtgtgtcaggaaaggaaggcattatcctcgacatcaatgggcaacagattgctctgggatagacaaccgggaaagccatacacctganactagactggttggctcttccacaacaggattctcacgcctgcgctctatgagtgaaaaccaaagcacttagcgtagagtggcccatgacgaagtctcaattaangtgagctgggctggttactgaaggcatggcatgaagacaaggggccgctcatttgtcaccaactgtctatgactgtnaaaanggaagatggcaaaaatctctaatatgaggaagataagccaaaagcacccatcagcctgaagagctttgatgctgggatacagagcccagctccttgcttcccatgccagcngcagcctgtacagcagcctgacctttaagcatacagggatgtcacacctaaggctgttccctagtacacctctgaacaactaagtccgcatctcatccgtgtcacatatcccagaatcccaaagtggtctccccaacttatctatgtcctctggtcctccttatgttaattgttcttattaataaagcacaggctttgccccgcctgctttagagtcacacagagagatggttaacacgctggtgccgntggcccca

SEQ ID NO: 535031 - DNA, 116 bp, Homo sapiens
tttgacatggatgttagaattctttattattacttatcttattaacgccactttaatgctgcagaaaattcaaatcacccttgatacccacttctttctcccacccaaatctgatc

SEQ ID NO: 535032 - DNA, 892 bp, Homo sapiens
acatacgtgtgcatgtgtctttatattagaatgattgatcattttgtcagtatatacccagtaatgggatggctgggtcaaatgtattcctagtagtagatccttgatgaatcagacacacgtgtcttccacaatggttgaaataatttatactcccagcaagagtgtaagagcattcttatttctccacgtcttctcgagaagtatcttggtggcattctctggaatttgaatgtggttcctgaatttgaatgttggcctgccttgctagatggggaagtactcctgtataatatcctgcagagtgtgttccaacttggttccattctccccgtcactttcaggtacgaccagtcggacgtagatttggtcttttcaggccgtagtcccagtatttcttggaggcttgtgtgtttctttttattctttgtttgctctaagctcctcttcatgcttcatttgcagttcatttcatcttccgtcgctgatcccctttcttcaggttgatcacatcggttactgaggcttgtgtattcatcatgtagttctggtgcgtggttttcagctcctcatgtccttttaggcccttatctgcctggttattctagttagacattcgtctaaatttttttccaggttttaacttcttgacatgggttcgaactactctctagcgctgaattagtttgattgcctgaagattcctctctcactgtccaagtccttccctgaacgttgtgccttgctgggagggcgctcttgaggaggtggaccggggttaaaatcggtctggcgtgtccccggtgggtttcctgcctggaggggaaaagcggtggccctctcgtggcctctagacccccggggtggcgccattgctgcgccaaggggttcg

SEQ ID NO: 535033 - DNA, 817 bp, Homo sapiens
  misc_feature (5)..(5): n is a, c, g, or t
  misc_feature (71)..(71): n is a, c, g, or t
  misc_feature (73)..(73): n is a, c, g, or t
  misc_feature (76)..(76): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (99)..(99): n is a, c, g, or t
  misc_feature (101)..(101): n is a, c, g, or t
  misc_feature (112)..(112): n is a, c, g, or t
  misc_feature (161)..(161): n is a, c, g, or t
  misc_feature (180)..(180): n is a, c, g, or t
  misc_feature (192)..(192): n is a, c, g, or t
  misc_feature (196)..(196): n is a, c, g, or t
  misc_feature (204)..(204): n is a, c, g, or t
  misc_feature (209)..(209): n is a, c, g, or t
  misc_feature (286)..(286): n is a, c, g, or t
  misc_feature (301)..(302): n is a, c, g, or t
  misc_feature (308)..(308): n is a, c, g, or t
  misc_feature (311)..(311): n is a, c, g, or t
  misc_feature (313)..(313): n is a, c, g, or t
  misc_feature (322)..(322): n is a, c, g, or t
  misc_feature (326)..(326): n is a, c, g, or t
  misc_feature (346)..(347): n is a, c, g, or t
  misc_feature (381)..(381): n is a, c, g, or t
  misc_feature (397)..(397): n is a, c, g, or t
  misc_feature (442)..(442): n is a, c, g, or t
  misc_feature (445)..(445): n is a, c, g, or t
  misc_feature (478)..(478): n is a, c, g, or t
  misc_feature (511)..(511): n is a, c, g, or t
  misc_feature (520)..(520): n is a, c, g, or t
  misc_feature (548)..(548): n is a, c, g, or t
  misc_feature (552)..(552): n is a, c, g, or t
  misc_feature (565)..(565): n is a, c, g, or t
  misc_feature (570)..(570): n is a, c, g, or t
  misc_feature (575)..(575): n is a, c, g, or t
  misc_feature (581)..(581): n is a, c, g, or t
  misc_feature (587)..(587): n is a, c, g, or t
  misc_feature (589)..(589): n is a, c, g, or t
  misc_feature (591)..(593): n is a, c, g, or t
  misc_feature (605)..(605): n is a, c, g, or t
  misc_feature (629)..(629): n is a, c, g, or t
  misc_feature (632)..(632): n is a, c, g, or t
  misc_feature (637)..(637): n is a, c, g, or t
  misc_feature (651)..(651): n is a, c, g, or t
  misc_feature (657)..(657): n is a, c, g, or t
  misc_feature (736)..(736): n is a, c, g, or t
  misc_feature (757)..(757): n is a, c, g, or t
  misc_feature (792)..(792): n is a, c, g, or t
tttgngtgggaggcacgtaagaccgctctgagcgcacgggggcgctcacctcactggctcgttcgcgttcnangancagatccggggtanangnaaaananctccgggccangggctgcccgtcgccgccgtcggggagtcagcccgccagacccgccagnccttcagcccgccagccancgcttcgcgtgncccngtccggtncccgntccagaccaacaccattcgtctcggcttgcactgtaaacactcagttagctagaagcacgactctacttcaggtttncttcaggaatagacnngccagncantntcgcgcagnagtnagtccagcgttcattcggtnncaagtcgtcgggtccagttaatcctagcaagaangaagattgagggaaanatcccggagaaaatgcgttgcttcaagttcacaagttcatgattngcncatagcgaccacaggaattttcccagggtgttngtcgcgtagcgagccaatctcggtagcaatttncgttagttnccatcagcattaacccaataattcaggnttantgacggtagacanagttngtacnttatcnaaaaantnannnccagttcggggnctcttgactatttcaacaagtcgnagnaaggngtagagttattccnttactngggaatgcaaattacttgggtcagatttcaatttttcaaaatttaaaccctttacaggaggaacaatgttacctcccanggagttccagtagaatctccnttggctaaactcagggacctacatgttttcagaangcatggaagagggaaggggatttga

SEQ ID NO: 535034 - DNA, 131 bp, Homo sapiens
agagtgaaactgcacccccctccaaaaaaaataaagtacagtttaaaaaaattaaagtacagtttaaaaaaagaaaagccacttgaagtaaaacatttaagcagggaatactgatgatgtgtattacttac

SEQ ID NO: 535035 - DNA, 217 bp, Homo sapiens
  misc_feature (151)..(151): n is a, c, g, or t
  misc_feature (213)..(213): n is a, c, g, or t
  misc_feature (215)..(215): n is a, c, g, or t
gatccaagaaccctctcttggggtctgaatcatacccctttcgggttacagcctatcacagcatttttaatcctatgcacttaacacttctgtatagaaaaagaacatcacactagaattttgatgacaatagatgacaatatgatgaatnttattatatgaagtgttaaacttattagagcagatatggtactaaaaataaaatcccacctncnct

SEQ ID NO: 535036 - DNA, 228 bp, Homo sapiens
ttagtttatcatctttacaagaatgctaatcctgtcctcaacctagattattttatatacatatatatagtacatgaaactcttggggtcagatgcttttaggaggccatcatgcaagccagtcatttatgtcactgctacacaacactcctaacttgactgtggctattgtaatacataggcccccctattgtaatatattggggtgccaagacactttatcttccc

SEQ ID NO: 535037 - DNA, 110 bp, Homo sapiens
catccccgaccagccccaaggttgttattatatctcacacagaaatatctggccgtgtccacggccgtcactgaagtcagcctcagggacaataggttcttggccgtgtc

SEQ ID NO: 535038 - DNA, 165 bp, Homo sapiens
gcggacgccagattgcaggaagtaacattctttgattgttcataatatacgaagttacctataacacggtgcagtaacacagctagttcctctgtatgttatggtagaacggatttgtaatataaagttaacaggaaaaaatgctcagttctgatacggttttga

SEQ ID NO: 535039 - DNA, 257 bp, Homo sapiens
  misc_feature (214)..(214): n is a, c, g, or t
ggcatctaacctcactgttcttattatttcgaattagccatactccctattccgctactaactactcatacatctcctattaaaaaacttcctaccactcaccctagcattacttatattgcatttctccattcctcattacacatctccagtcattccccggctgcataccaggtaccgcttgcaaatccaagtcagggttaccgaagctcgnatttcgctaatcctggatcctcaactgctttcctgatgtttac

SEQ ID NO: 535040 - DNA, 177 bp, Homo sapiens
aaggagtcatgacttccagaactagcaggagtgattaaacggttattggcgagatggtggggtacaagtttctttcagcagatccagggattatcagctcaatgatcttgcttcatattatcctaaatgatctggttagattatcccagcttaactacattccactcagcaagttgt

SEQ ID NO: 535041 - DNA, 613 bp, Homo sapiens
  misc_feature (172)..(172): n is a, c, g, or t
  misc_feature (285)..(285): n is a, c, g, or t
  misc_feature (320)..(320): n is a, c, g, or t
  misc_feature (448)..(448): n is a, c, g, or t
  misc_feature (473)..(473): n is a, c, g, or t
  misc_feature (503)..(503): n is a, c, g, or t
  misc_feature (508)..(508): n is a, c, g, or t
  misc_feature (517)..(517): n is a, c, g, or t
  misc_feature (523)..(523): n is a, c, g, or t
  misc_feature (585)..(585): n is a, c, g, or t
  misc_feature (607)..(607): n is a, c, g, or t
ccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagantgtgcgcgcccagtgactgcaccccggccctcatcacccaccggcactgattggggcaccgcctggcccagcctccaccagggacccctcctcatgaactctggagccctganaagaaaagggcagccccccaccttgtcaccctcanggcttccccttctgtcctcattcttaaaaactgcttctcccaaacataacgcgttagccatgaaagaatccgaaccctgggtccgaatggaccgcctgcggtctgcatcaacctctgggaaaccacancaatgatgccaactgggcacgtcangactccccacacacccacacgatgccacangtccnggggctgtncctgantaaggaacctcccattgccttcctggccccggataaaaaaaggaagttattttggggctacnaaaccggccccacacctggctnaaatca

SEQ ID NO: 535042 - DNA, 217 bp, Homo sapiens
tgtgaacgagtagaggagtcctccagcgccagaaggttaagaagcagggtcggagtgagtgagatctcgagaggagtgaaagtgagtgagaccaagtgcaccaaagaaagagcaaaaatgaggaactccctcgtgccatagtctccctccgatctggatagcttggacgggtggagccttaatgatgatggcagcagcgaccctagggatatcgacc

SEQ ID NO: 535043 - DNA, 271 bp, Homo sapiens
cgcgtgacacgccgaagatccatacattttctttcaaatcccttataagtatctggtgattttttcggatggttggggggttttggtttttgtttttgagacagcctctcgctctgttgtccaggctggagtgcaagaacctatctaaaaaaaaaaccaaaaaaaaaaccaagggccaaaaaaaagaaaaggacctttttggggggggggggaaaatgccagagggaaaaagataatcctagaacccaggaaatcgggacttaaagctgaa

SEQ ID NO: 535044 - DNA, 314 bp, Homo sapiens
cgagactgggtgaagggatgttccggtcgtgatgggtaatgggctgtcgcagtgtgagcagatgacgggatgttccatgtgatgggtgaagggctgttccatgtgacgggtgagcttgtgactgggtgactgggctgtaccgtgtgactgggtgaagggatgtcctgtgtgacgggtgacatgtgatggctgacgggatgtaccgtgtcatgggtgagatgtggccagtgatgggatgttctgtgtgctgggctgttccgtgtgacgggtgatcggatgtcccgtgtccgcaggtgacaggatgttcggtgtga

SEQ ID NO: 535045 - DNA, 1486 bp, Homo sapiens
tgcctggtggcacggcgggatcctccacagagaggaggggaccaattctggacagacagatgttgggagggatacagaggagatgccacttcgtcactcaccactaccagccagcctcagaaggccccagagggggggtggctgaccacggcattggagcgacaccttgacactgtagcaataggcaggggtgccctgccacaacccatccaggccagaacacaagctgaccatgcgtcagggggcctagaggatggaggttcttagcgtatccttgggcttccaggagccagccctggcctctggcccacttccgccacagtgggtcttgtgtgcataagagccccatgttgacgaagcctcgagcgctaggttcacagaaaagccatgtccattgacaccctgcgctagcttcgggccagggacgcaagattgacaccaaggacaacacaagaccaccctttcccagtggaatactggttagccacgcggcgaactcttcccattacacacctacccttggtgaccattcctagtggtagataatcagagcgtctaatcaacaggggcggagcgcaagttcacaagcaacggagttcccccgaaggcgtatcgggtaaacaccacacagaccgatatacacgaaaagcctgacccgtgcccgcaacatccactacagcattctcctaccccacatcagcaagaggaggcaccgaacacggacccttatccggcacgccggttatcgacacgagcaatctcacatagtatgaaacacaaaactgcggaggcagcaccttacaatagagagagacctagacgttgtaagatgcgcgtacctaactacacactatgtacacaaaccaccattcataacccacaaccatctcctatcacagtcatggcaaccacacacccactccagcaccaccatgcgacagcaatcttactacatcaaaacaagaacccacacaaccacatcacaacatacacttaacacaacatacatagacaaacaaaaaaaaactaacagacacacattacaacagaccacatagcaatccacaacacaaccccaataacaggagactaaacacgtctcaacacaacccacgcaataacatgcaccccgacaccaccacaaactctcactgatcataaaacgcaaatcgaacatagacacaactcctacacaccaaccacactacgcaccaacacacacacatacccacacacaaacgccacaaaaagcatacacaaaacaaccaccacgaccaactacagactaatccaaacaatcacagaccaacacaacgacaacaccccaataacacatccatacaacacacaataacctcataacacaccatcacacgcaatacgacagcagacaaacaaacgaccactacacaagcaataaatctagatcgaacaccacataaagatacaccaaaacataactcacagaaaacatacataaatcaat

SEQ ID NO: 535046 - DNA, 1843 bp, Homo sapiens
  misc_feature (542)..(542): n is a, c, g, or t
  misc_feature (832)..(832): n is a, c, g, or t
agctcctacaattttcttaggatattctgggaaagatgagcggagactgcccgccttgtcaaatctagtgtctttttttcagtcctcacactgcttgacctatgtataacctcctatacttccctctttgcatactcctctgggttttctgtggtagtcaagattcctccctgagatttatttcccatgagtcttgacccctcccctcagttggtgctatttccccctacccgccctccgatgatcttatcagagcccacaggttcagttttctttcatgctacctgaatgtcctgataaactggctcgctctcttctttaccttccataatggcattaccatttaccacgccacccaagatacttactaggaacctcaaagtattgtattctttttctccatcacactcatacttaatcatcaagtccttttgagcttgtctcctcttgaatatgtcccttcttaattccctgctgccttcttagtaaaggccttcattcttttttgcctagtaataatcttttccatatgttccagttanaataccatgttctccctattccttattacatagctagcattccttgaaaaaaaacaattctctcaggcctccatacctttagcatgttacccactctgcctctgctcttctggaactagaacactcatccttgaaggctgggcttctgtatgaaggttggtcctgcctccttacttgaggtgaagctttgtacatgcctgtattacggacatcctcttatttaagtgtttgtctctttcgtcattgggactccagcacccagcatagtccctagtatactagttggtgcngaataaatagtagctattattagaaaaggaagggtgaaattgagcatgggagttagtaaaatgtatatggaaatgatttttaaagggaaaggtaatgattttctggcaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtagaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaacaaaagaggttcacccccattggaaaacttccc

SEQ ID NO: 535047 - DNA, 663 bp, Homo sapiens
  misc_feature (40)..(40): n is a, c, g, or t
  misc_feature (42)..(42): n is a, c, g, or t
  misc_feature (44)..(44): n is a, c, g, or t
  misc_feature (49)..(49): n is a, c, g, or t
  misc_feature (521)..(521): n is a, c, g, or t
ggatgatacacaactgccatcacctcagttcccactacgntngnaccangggaacttctacatccatgatctcatctactgtgagtacaggtatccctacctcacaaccaacaaccatcactccctcatccgtgggcatcagtggttcattacctatgatgacagacctcacctcagtgtacacagtctctagcatgtctgcaaggccaacaactgtcattccctcatctcccactgtccagaatacagaaatctcaatctctgttagcatgacgtctgctaccactcccagtggaggaccaacttttacaagtactgagaacactccaacaagggccctcctgacaagctttccaatgacacattcattctcttcttctatgtctgaaagtagtgctgggaccactcacacagagagtatctcctcacctcgaggcaccaccagtacactccacacaacagttgaatccaccccatcacccactaccaccacctcatttaccacatccacaatgatgganccaccttcatccactgtatcaactacaggcagaggtcagaccacctttcccagctctacagccacattcccctgagaccactacactgactctacaactgacatttctacagtatctgccccgcgagccggttcagacgctc

SEQ ID NO: 535048 - DNA, 639 bp, Homo sapiens
aggttaatatcttattctagttataactggcatttctccagtgacaaataatatcaaacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaacaaaagaggttcacccccattggaaaacttccc

SEQ ID NO: 535049 - DNA, 323 bp, Homo sapiens
  misc_feature (181)..(181): n is a, c, g, or t
atctagaggatcctgggtgatgggtgtcagggttgtactctgtgtggagtgtactggtgggaccactcacacagagagtatctcctcacctcgaggcaccaccagtacactccacacaacagttgaatccaccccatcacccactaccaccacctcatttaccacatccacaatgatgganccaccttcatccactgtatcaactacaggcagaggtcagaccacctttcccagctctacagccacattcccctgagaccactacactgactctacaactgacatttctacagtatctgccccgcgagccggttcagacgctc

SEQ ID NO: 535050 - DNA, 447 bp, Homo sapiens
gcttttcataatctgttacattaaaatccattggtctatcttgcattttaaatggattttttcctatgcatgatttcgtaatatcaccacgttggtgacttaaaaaattttggttcactcagttgtgtgggtcttcaaaacgttgtcatgtttcattgtacaataacaaaaaatctgtctgggcacggtcgctcatgcctgtaatccccatattttgggaggctgagttgaggattgcttgagggcaggagttcaagactagcctggacaacatagttgagacctcattcaagaacaaaataaattagccagatatgtttctccatgctggtagtcctggctatctggaatgctgaagtggaagaactgcttcagcctaggagctcaacgctgtagtgagctatgctcgcacccacctgaactccaggccgcgtcaccgagagaccc

SEQ ID NO: 535051 - DNA, 284 bp, Homo sapiens
tctcttttgatagggttgtcggaaactgctatattctcctatgtgggtaattgaggagtatgctaagatttgcgtagctgggtttggttaatccaactcaactgcctgctatgatggataagattgagagagtgaggagaaggcttacgtttagtgagggagagatttggtatatgattgagatgggggctagtttttgtcatgtgagaagaagcaggccggatgtcagagggggtgcttgcctatctaaagacgagggtacccagctccaattccgaaatcat

SEQ ID NO: 535052 - DNA, 436 bp, Homo sapiens
gcggcctggtgccaaaatgttggggactgctgtgctttaaaatctgccatgaatctgaacgcctctattatatatgctccctatagactttgcttcctaccgtcttacgttctgccttataagcatctgactttgcacccctctgtccttgttagtatgctacgctggtgacattgaccaaattgaacacacattaattataagcttagttggtgatgacctcaacggaataacgtgacatacagtattgtgacaatacttcttgcatgtatctgcaggtggagttgtaaacctggtggtcccgagatggtctaaattccatcttcctatgtatctccttatattaatagtggtaacattagtggtggtgattcagcatatcaatgcctcttctcatggcaacaacaaacgttttccttctgaatcaccattaacc

SEQ ID NO: 535053 - DNA, 780 bp, Homo sapiens
cggcacccgaggaacacgattctccgaccgaagcgtcccagccgagtagtggaagaggaggaaactaaaacatttaaatgacctgggtgtgacagatgtgttgtgtgaagcttgtgaccagttgggatggacaaaacccaccaagatccagattgaagctattcctttggccgttacaaggtcgtgatatcgattgggcttgcgagaaactggctcttggaaagacaaggcgccgtttgcttttgcccgattctaagatcgcactgcatggtagaatccccagcagtcagttctgtcttgctcctagtttctgtaccgccgctctcggtgagctggccttttcagatctcagagtcagtttgaagccctggggtcctctattggagtgcagagtgctgatgattgtaggtggaattgattcaatgtctcaatctttggcccttgcaaaatggaccacagtatacataataggcaagcatccgtggtcgactggattgaccatcttggaaaatacgaataggtttcaacgttgagagctctcaaatacttggtcatgggatgaagccgaccgaattactgaatatggattttcgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctc

SEQ ID NO: 535054 - DNA, 458 bp, Homo sapiens
aaggggtctcgttctattgcccaggctggagtgcagtggaatgatcttggctgaatgcaatgtctgcctcctgggttcaagtaattctcctgcctcagcttcccaagtacctgggattacaggcacgtgccaccacacctggctaatttttttattttcagtagagatggagtttcactatgttggccgggctgatcttgaacttctgacctcagttgatccaccggccttggcttcccaaagtgctgggattacaggtatgagccactatgccttgccaatttttaggaaaaatattaggaaacaaaaatattaaatgactgggcccagtggctcacacctgtaatcccagcactttcggaggccgaggtaggaggatagtttgagcccagaagtttgagaccagcctgggcaatgtagcaagacctcgtctcttcaactgataaaaaatttagaga

SEQ ID NO: 535055 - DNA, 277 bp, Homo sapiens
attgcactctagcctgggcaacagagcgagactccatctcaaaaaaaaagaaaagaaaagaaaaaagttgggcagaggatttaaatagccatttcttcaatgaagatatataaatggccaataagcacatgaaaagatgctcaccttcattagttattgaagaaatgcaaatcagaaccacacctaattgaatggcaataataataaggaaaaggagaataagtattggcacagatggaaattagaaccctaatgcattgctggtaggaatggaaaa

SEQ ID NO: 535056 - DNA, 301 bp, Homo sapiens
cctcaagatctttaccctgaaacagttctgttgaatttcaccctggcaatgtaaactgatagcttattttcacagatgtgggacaggaagtcatccctctgctcacctgagacaattgcatatccgattgcttcctgtgccctattgtttatgtaaaaatgcagatacactgagacagactaaactttttttttctttttcttttttttttttttttttttttgagtcagagtctcaccctgtcacccaggctggagtgcaggtggtgcaatctcagctcactgcaacccttgccttccag

SEQ ID NO: 535057 - DNA, 203 bp, Homo sapiens
tattagacactgtcgagcgttgcgggggcgcttccaccctgagcggatgatatctcacgacaccttccgagcgtccgctcactccccttccacccgtcatctccacccttctgcagatgataatatcaagacacctgctccgagcgtctgcgggggccgcttccaccctcagtcggatgataatctcaagataccttccgagt

SEQ ID NO: 535058 - DNA, 207 bp, Homo sapiens
ggatcccccgcgccggtttgcgctcccccacagctgcacccacaaacgcacagcacacacacgcacacacattgcacacacagcacacaaacgcacggcacacacacgcacacacatgcacacacagcacacacgcaaacgcacagcacacacaaacgcacagcacacacgcacacacagcacacacacgagcgctacaccgggcgg

SEQ ID NO: 535059 - DNA, 270 bp, Homo sapiens
tcctaccacgtctgcaggtccgctcttctctgtgtctccttcttgactgcttcatgttggcctcagtgtcatgcacaccttgtgctttgagcccagcaggtccttgagcatggatctttgcgacatgtgcaccctccgcagtggggggcgcttgaacttgtcccgcagatacaatagcttctggttcatgtactccagctccttgctggtgttctggagcctcacctccatgtcgtacttctcctcttcagacgcatagatacatggcgt

SEQ ID NO: 535060 - DNA, 330 bp, Homo sapiens
ggggcccaaatttttttttttgaaggaatgggccaaatcaaaaaacttaagggggtgttttgggcccactttttaaaaagggaaaggaaaccccaacatgcctgccctgccttggggacccgggaagtcacccccccggtttggggaaattaaccccagggttaactttcattatcactggctcccaaggggggcttgtcaaaaaaatattccccccaaccaaattcgggcgctcccattttgcccaagttggtcacgtggtcacccaattttttgaagggtttcacccgctcattcagggaatgggtctcaatgaaagcaccccaatgg

SEQ ID NO: 535061 - DNA, 648 bp, Homo sapiens
ggcgggggccccaaatttgtgtgggtgggtgccatagtgaaatgccaaggccaatggcctggtggatggtgtgtgggggtggctggagtgaggctgcagagtggtgtgtgagtcccaaattgtggtagtggcatggtgaattccagggatgctgtgcctgacatggtgatggtggagctggctttgtccccatctatcccctctcctgtgtgggtgagccagtgtgcactgtcagaggatgtgagctggctgaagtttggctcagcatgcaggctggcattgctgatgcagcaggaggagcgtgccaaagcagcatgggagatcattctgctgaatggaacatgagctcttggagcagcagaatgctgggcagcttgtgttacttggagcaggaactgacatgcaggagattgccaagatgggcaccccagtccctcggcccccacaagacatgggccagattggtgtgctgcactcctctgggtcctcgagtagctagctaccatgtgaggcccagttgggcccccactaccaacagttttgcccattgggagcccctggttccctggctcgtgtgtccacgacagtccctggcagatgagcacagaggaggatgtatgatcctactgtgtgtcccaaaatccccag

SEQ ID NO: 535062 - DNA, 367 bp, Homo sapiens
ctcgaggccaagttcttgtcgcgacccaagaagcggcttcgcgcttccgccacggcgcgcacgacattggcgggcgcggtgccaccgatgttcttgcgggcgttgaccgacgcttcgaccgtcagcacgcgatagacgctgcgatcgatcttgggctcgatcgcctgcatctcggcgagcgcgagcttgtcgagatcgacgcccttgtcggcggcgatgccgaccagccgcccggtgacgtgatgggcctggcggaacggcaggccgaccttgcgcaccagccagtcggcaagatcggtcgccaccgagtagtcggccgaagcgacggcgcgcatgcgctcggggttggcctttaggtcgcgcacca

SEQ ID NO: 535063 - DNA, 174 bp, Homo sapiens
agtctatacatggtttaacacatgaattaccacataagccagcacatccactcccagatgtatttcccccactgaactgaaactatgcctacaaacttacacataaatgataacagtagcattataatagtcacaaaggtggaagcacaccaaatgtcccctagttgatataac

SEQ ID NO: 535064 - DNA, 130 bp, Homo sapiens
tttttgggtgaaatgaaaaaaaatgcagtgtgacagtggcagcctctagccctcagcttcccccggaatcagatggatcctccccgattacgtgaataaaatgatggaacccaaaatccctgtcccttta

SEQ ID NO: 535065 - DNA, 93 bp, Homo sapiens
cctaggaaggagttttagagactgaggcagggcaggacataatggattgagaaacaggctatgccataaaaaaaaagtcgacgcggccgcgaa

SEQ ID NO: 535066 - DNA, 892 bp, Homo sapiens
atctgtgtttacactggacgacttcatggatcgcttgggtgtactggaggctggatacagccgtccgaggcagcggagtcgattacacgtgcctgtcgtcacctacgaagcttgatgtctacctcctacctgggcatctaccgggcacaatcgctggcacctctgccccattctctatgagagccgtttccagcttgggggtagtgcccgtggctcccgagttgcttgaccgtgccaagcaacgtggaactgaccgtagaggggccaaattggggagacttgccacactccacccctccatgctggtggttggatcctcctgtcttcctccttgtcccatgaaggccaaccccccagctctggggactcctaggtcgacttgggaactaccgtgcatcttcagtccccttgaacttctgccctctgtgtcagggctgactacaagcccgcatcaggtctgggggggctccggttgccctgagggatgagccttcagcctccctttgtaatgctgctcctctcgcactgcccagacagccatgagttggagtgcagacagctagaaggagagaccttcttgtgaacgctcatccccccgctataactccccttccatcctgacattctccccttctttcacttacaccgctcagggagagagaaaaacttgaaatgctttccagcgcttcttggaagccgtacatggtccaggggatagggggcccacatggctgaagcatgccatgtttgaggggaagggtaggttgagcctacttaattccctggcagaaggggatggcaggacatggactgaggttgcaatacctgcaagttacacagctgtacccatgacgcagttcttgtatttgaattgtgctggtcggcatcagaa

SEQ ID NO: 535067 - DNA, 529 bp, Homo sapiens
  misc_feature (38)..(38): n is a, c, g, or t
  misc_feature (62)..(62): n is a, c, g, or t
  misc_feature (68)..(68): n is a, c, g, or t
  misc_feature (77)..(77): n is a, c, g, or t
  misc_feature (91)..(91): n is a, c, g, or t
  misc_feature (96)..(96): n is a, c, g, or t
  misc_feature (104)..(104): n is a, c, g, or t
  misc_feature (109)..(109): n is a, c, g, or t
  misc_feature (116)..(116): n is a, c, g, or t
  misc_feature (131)..(131): n is a, c, g, or t
  misc_feature (149)..(149): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (453)..(453): n is a, c, g, or t
  misc_feature (456)..(456): n is a, c, g, or t
  misc_feature (522)..(522): n is a, c, g, or t
aaaacctcaccccaaatcaaaaacatccaaaaaactgnaggttccaaaaaagttcaccagcnatcttnatttcctcnataaaaaaaggggnaaggnagccaagnagggnaaggggnagtccctggggtggngggcatgtctcacccccnagcccggntgnagnacaatcccctccccttaaatagctgccaccaaatggggcaagcccagggctatagcatttaaaaactcccacatcccattttatcaaaaccaaagagaaaaaaaaatttcccttttcccccaaaacccaaatatatatatattttttttcttaaaaaaaccaaaactttgaaggcattaagcgttaaagtgaatctagaacaagggaatgtgaaattccctccttccttcccccttcctgtggggttcattggtgcatccccagcagagggaccggccccaaggggatgncanaagggaagtactaaaggtagataaggtcgggtggtctccccagccaatcagcagccagtgtgggtnttagtag

SEQ ID NO: 535068 - DNA, 118 bp, Homo sapiens
cagcgcactagcctcatggatagaaaacaagtgtaatttctattttagagaaaatcagattttataagacaccagacttgaaaacttcttgccagtgagatatttttgactataaata

SEQ ID NO: 535069 - DNA, 949 bp, Homo sapiens
tgccccaaaaaaggggcgttttaaaaaaaaaaggggggggccaacccgcgggaaaggcctaaaaaaaggggaaaaaatagtgcggaaccccccggggggtgggccccccggggggggtattcacaaaaactcccgaagcctgttgtagtatccccccacccaggcgccaaagcggtgggcgtcgtgcccacaccccgagcccacgaagaagtcccccaaagaggtggacgacacctgaggggtggggaaaaaacaccccccgcggggcggtgatgctcacacaaaaagcggccaacagcgtgcgggagaagccttcccccaaaggtgctgaacgacgcacacacggagcattgggggcaaccggtggtcggccccacagaggcttcgtgtgtatgaggaaggagttgtctcccccgcgcgaaaatatattccacaacagcgggtcgttcgccaccgaagccaccgtgggtttcccccgcgaaaagcgccgcatgactgatccatccacaacgctgtgcacgagaggaacaaagtgcgatcccgtcttctcgtgggaaaaaaaccccccccaaaggcgccccacagaataaccattatggtcgaccggcggccagggaaaccagggtggtcctcctctaaaatgactaatgcggcggcactgcacccccagatagaggcaccccgtgtgtgtgggccatacaacaacaccacccgcgggccgcccccccggagggataatcacccacacagacgtagtataagccccaacaccacgggccccaaaggactggacaaacaataaccccccgtggcacagaggagtacgcgagtagcccagccaggttcccggtgtgccccaaagaggcgtcccatgaaagagtctcctcggccccaattccaccacctccaggcgaccaccgggggatgcctcaacaagctgactcgtccc

SEQ ID NO: 535070 - DNA, 1201 bp, Homo sapiens
ggacgcgctgggtctgcctccgggattgcacgaagagtccgagtcatttctcagaaggtttggataggtgggccttagaggagacgccgccgagcaccgccaagacactggaaaacacacccctctctgtctgcctgggagcagccacggacaatcggcacttctctgagtgaagctgaggagaaggctgtaaatctgcccaaacaccagccttgaagtcattctattcgtcatgcaggaagtgcacggctgctggcaggcgcaggtgaacacccacaaggcagcagatggcatctggcctgggccccgcctaagcagcaagctccacctcctaggccaggaccctgtgggatgcagccactagaccaccatggacggatcccacagcgcagccctgaagctgcagccagctgcactcccacaagtagctccagcgccgtcagcgaggcctccttctccatacaaggaacaacctgattggcgccctcttggcgatcttcgggcacctcgtggtcagcctggcacttaacctccagcaagtactgccacatccgcctggccagcgcttccaaggaatccccgggcctatttcaagaccaagacatggtggctgggacatgtccctagatggcttctgggctgcaactgggttgtgtacgacttcctacgcattcagcgctgcttgtcaactcatccgtggcccgatccaagccgcaagaaactgcgcacggctacaggcacatccatacagaacatacaccattcatacaggcgacaagaggaaacacgaaacacaacagaacaccacaagacccggccacagaaggctcgagacaggacagcgaaggacacacacggccgcaaccagagcacaccacagaggcagacagccccacagggacacatgaaccgagaccaccaccagcagacccgacacagtagagcacaaaaggacgactgcaactgccaacagctcgcaacaccactccaggcgcacaactcacccccagcggaagcaacgacaggcacggagccgagaacccacaggcacaaaacagagcagagccaaaggaaacgaaacagagacagccgccggctaagcagaggacgcgctagcaatcccgaccacagcaggggagccacagcacccccagacgacccccactaaacccgaagtaagaagacacaaacgagacaccgc

SEQ ID NO: 535071 - DNA, 626 bp, Homo sapiens
cggctactgcgtacacgtggcggtgttgcgtggggactccctgaagagcagagcggcagggcgcccggaagtcgtgagtcgagtcttcccggcgctaatccactgccgggttggaggctgctgacgcaggtcggggcccaggtgctgggtcgactcggggacggctgggtgctgccctggtgccccgggggaacagcagacacacatcgtaggcttgttagttaggatggtctgtcagtggaaaagagtgagtacacctggtggagatgagctatctttctgaagaaaactgtcccattcattaagcagtaggtctcgtgatgacagataaagcccaattagcaagtaaactgtgtcctctgaaagatgaaccatggacctatacatccttgggaaccaggttcctttagaggttgcgtcttattgccgtgaagctgggcatgatgcctttatggaccacaggcatggtcaagagcatgtggtcacagttacttcaggtacacagactgtcatgtcttaaagatatacgtcaggaggaaaactgtaatggaaaaatggcaaccctgtctgtaggaggaaaaactgtatcacgtattcgttaaagctacatccatattggaatttac

SEQ ID NO: 535072 - DNA, 121 bp, Homo sapiens
ggatcccatgggatgtggtgaggaacacatagactcaaaagtaataggtgaaggatacctctaccaaggcaaaaggaaaacagaagaaggagaggctgcaatcctaggtacctgacaaaga

SEQ ID NO: 535073 - DNA, 924 bp, Homo sapiens
catgaaaagattgggtattctccatggtaattggaaattcactcactctgcgtgatggtttctcaaacgcaaatgtgtccagtgtgcttctctaatggaagtatgaggagatgtttctgctgcatttacaaaactggcaggatcagcccagaggccgggcgcggtggctcgcgtctgtaatcccagcactttgggaggccgagggggggcggatcacttgaggtcaggggttcgagaccagcctgagtgacatggagaaaccccgcgtctattaaaaatagaaaattcgccgggcatggtggcgcatgtctgtaatcccagctactcgcgggaggctgaggcaggagaatcgcttgaacccgggaggtggaggttgcggtgagcggagatcgtaccattgcattccagcctgggcaataagagtgaaactctgtctcagaaaaaaaaaaaacccggagtctctcaaaattgtaggttaatatggttcacatgtggtccacggtttgaaaacttatgggggggggagtataaagtagaataagagattccttggtcataggtcatatggtatcgggaacaatctttgagggtgagacgtggattgatcctgatcgatagggggattccatatcgtgattgggaagttggctgtggggttagaaagttcttacagtcaattggcgaatattaataggccagacagtgggggaaggcaaaggtggacttgagtttgacatggaaagagtgttaggggccagattggtgtaccggtactctataccaggattgcaggtaccttgaagaaagggggtgatgaagagcagtgtgacacgcaggttaagagtataagggaaggtgggaaggacagataataaggaggggaaacacggaagtcagtggttctgtcgcgtctcggctctgttg

SEQ ID NO: 535074 - DNA, 215 bp, Homo sapiens
tatgccaacatgtggtatgcacctgtggtcctatgctacttggtggctgaagtagggggctcgcttgagactgaaaggttgaggctgcagaaagccttgatacgccactgcactccatcctgggtaaaatgagcaatgactctgtctccaaaaaaaaaaattattccaccaaacaaccctttttttttggttagaaaaggggtctttgtggccca

SEQ ID NO: 535075 - DNA, 778 bp, Homo sapiens
gtgctaattaaaaaaaaaataaaattttaaaaaaacctgtagtttcattacctttttgaataatgtcatacaaaaaatgtatttgtttttttggtgctgtgagaatttgatgttggtagattaataatcatttggtttagaattacaaaatagtttttaaatatggtctgagaaaagccaaagttaatgcaacctagtggaaactgtaagaccatttgagtatgttgttttatgtgatgcattggatttggtggttgatggaatttgagccaaaaaaaaaaatacgcaggctttcctatttctacaacttggatggtacttatgcttttggtcccagtgggaactttttatactgggagattaaaaaacaaaattgggaaatttttggtgggctggctctgggtggggcccctgacaatgactggatttcaagttggatcccgggtgatggatggatgattgatagcaacgaaagtcgctttctttgagaatctaacaactttgtggcttgatttctttttccccttgtgcttatttctagcattagaaattcgggtcttaaaataaccagcgggaagttccccttttctcttctggtatggggcggtcccccctaggtcattccactttcgcacgtcctcgtccttttagtggtaatgtcttcgtaacccttggggtggctctcggggtcaaccaagtctcggttctcggcctctggactaccggtcttgcaacagccttctcgccgttttggggccgttgggcgtccttaccttta

SEQ ID NO: 535076 - DNA, 576 bp, Homo sapiens
agcagaagtggtctggctctcgtgcttctgaatcccttccgggctctggtctatcttgtctcttagctgagggcctacagtcatctagagtaaaagggatggttaaaaaaaaaaaaaaaggcaatcggaggcaaaattgccagaggagaaacattaaccatgtaattggaatttaaaatgctcatggaatatggaaactacagtgctgacccatgtgagcagggtcacttgcaagggtcctgaaacgcacctgtctggccaggagtttctaaaaatatctctggtatcttctgtactagaccttaggtgatgccgactgtgggctgggaattatccagctcccctttcccatatggagccttaaggtttagtgtatcctgatagggggatccctaggccttccctccaggtctcttctttctttctgagtgaagatgaggcccaggatgtcgtcctggcttgagtgccaagagaccatggcccttttcattgcctattctcttccccctgatcccaaccattgtttgcaaagttggcctggtgatcccattggtggagctgtcagcaacgcaggtg

SEQ ID NO: 535077 - DNA, 498 bp, Homo sapiens
atcaaggacaagaccggcaagacgctcgccagcggcatttcgaaggaaggcgacgcgcgtgatctgaccggcacgccaccgttcaaggtcgtcttcggcaatgcagaagccgttgaatcgctggccgtgggtggcgcgaccgtcgatctgcagaagtacgcccgcaatcgcgtggcacgggccacgttgccctgaaccgtcttgtaattggcgcggtgcctgtaggcagtgcgccctgtctgatcatggaaatctccacacctctcgattgcgctccagccttggtgggcccgctgccgcgccggaactcgcgcgccgcgcaaatccgctggggtgatcgtgttgtgcacgtcggtggcgacgcgccggtctgcgtgcaatcgatgacgaataccgacacgtcggacgccatcggtaccgcaatccaggtaaaggaactggcgcgagccggctctgagttggtgcgcatcacagtggataccccggctgctgcggccg

SEQ ID NO: 535078 - DNA, 913 bp, Homo sapiens
  misc_feature (27)..(27): n is a, c, g, or t
  misc_feature (298)..(298): n is a, c, g, or t
  misc_feature (456)..(457): n is a, c, g, or t
  misc_feature (496)..(496): n is a, c, g, or t
  misc_feature (647)..(647): n is a, c, g, or t
  misc_feature (703)..(703): n is a, c, g, or t
  misc_feature (723)..(723): n is a, c, g, or t
ggaagaggccatgagtgtatcactaanaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacanaaacaagatgaaactgtgatgcttgtgaaagaaagtctcactgagacttcatttgagtcaatgatagaatatgaaaataaggaaaaactcagtgctttgccacctgagggaggaaagccatactttgaaaatctttaagctcagcttagattacacannagataccctgttacctgatgaaggttcaacattgagcanaaaggagaaaacttctttgcagatggaggagctcagtactgcagttattcaaatgatgactaattatttctaaggaagcacaggatagagaaactggaacgtcttcagatcatctccactgaattatagatgagtccctacaatgatcagntctaaactgatcattttctaaatagccaaggatatactgactatgagtatgcacanaagtgaaattgtaatgcccngatggagcttggcattgctttgcagattgcccatgaccttctttgagacatacaccaaagtgagagaaaatcagtttacagacttcttaatgtgctgctataaagggtttaatgctccaagtttgtttgccttagcagattgaggtagtaaccaatctgtaaaactggaaaactcttctccaataaaggg

SEQ ID NO: 535079 - DNA, 159 bp, Homo sapiens
ggagaaccccatttcactaccttggcccacccagaaccaaacttttagcccaaacactcttttcaccccaatttgaacggtattaggcgttaggaacctagggtaaaaccctgggcccccatattaattttttttatgttacccaccaacagccccaaa

SEQ ID NO: 535080 - DNA, 223 bp, Homo sapiens
ctgcctcagcttcccaaagtgctaggattacgggtgtgagccattgtgcctggccaaaactttatttctcatagaattacaatatatcagcagctttggaaaggaaggataatcagcaaaacaaaattttcttacagaatttagagggacgggtggatcggtctacagaggggtaccacctgggtcacaattggaaaagaatcctgtgaatgatataagacgg

SEQ ID NO: 535081 - DNA, 202 bp, Homo sapiens
ggccacctcaaattatctttgcatcatttgtttacttcgtcactgccagtatctctgtgacgatctggaatcttctccctccatccctgctgtatctactgcccctagcccgtgaaaagggctcaggactacttttaaaagaaagcaaggaaggaaagaagagaggagggtgtgtcgttgagcacctactatgcggtaaaag

SEQ ID NO: 535082 - DNA, 611 bp, Homo sapiens
tagcttggtgtctgcccaaatggctgcccagttttgtgcttgaaacccgggccctggtggtgtagacacctgtaggaatcttctggtctgcaggttgcaaaaaccgtgagaaaaacatagtatctgggctggataacaccgtctctcatggcacagtccctcatggcttcccttagctaggggagggagttccccaactccttgggcttcccaggtgaggtggtgccccatgctgcttctgctcaccctcggtgggctgcacccactttctaaccagtcccaatgagatgagaagggtaccgcagttgaaaatgcagaaatcacctgccttctgcattggtctctctgggagctgttcctttttggccatcttgccagatcccatgaataaggacttttatagctaaagaggagaagtcagtacctggcttgagagcttcaaaggacaggctgactctcttgtcagaggctaatgtaagttggtgatatatagttaaagctgatgttcattaaacaattttgaggatcctagggcccttaagagttaattagatatcctctcactgtgctctgtaaatagaacagtagagggtggatgttagtacatttgc

SEQ ID NO: 535083 - DNA, 387 bp, Homo sapiens
tgtttgtcacccaggctgaacgtagtgcacaatctcggtcactgcaactctaccacccgggttcaagtgattctcctgcctcagcctcccaagtagctgggattacaggcatgtggcaccacaccttgctaatttttgtatttattggtagagacggagttttaccactgttggccagactggttctcgaactcctgaccaggtggtcctcccgtcttggcctcccaaaagtgctgggattacaaggatgtgccaagcctcaaaatttctaatctcatattagacttctcttccagttttcttcattattggaacccgggaattgcttgccggggttaccgagcttcgaaattcggtaatccatgggtcataggcttgttttccttg

SEQ ID NO: 535084 - DNA, 1131 bp, Homo sapiens
tggaaactatggctcttaatttccatgtggataattcaaacaaagtcataagtagtcttggtccaatttttttttataaaaaacaaaaaaccctcaaataaaaaatctggggcttaaaagaaactctatcacaggagcccgtggtgggaggattcctagttttataccatgagcaaatagaatgcagaattctctctgaaagcaggtgtctcacgaaaggcaaatggtctaatgagaaaggaggggcctagataacccccaaggctccaccaacggtgatctctcagcgcgggtgcggtgagctccaccaggcgctctagggcatcatcggcgctgacataggacaccacaatacacgcctagccccggcgcgcccacttgacaaacacacaaaacctggcacgaaacagagaacaccaggcacaggggtacacgaaaaaaaaaaatggcaggaacaaccgcaacaacaacaggccaaaaccacaacgcgaccaccaaaaaaaaaaatcaccgggagcaatcaagacacatagcaaaaaaacataaaacaccacccaaaacagcgagaacaaagccaacaagcgggcggtcaaaccggaggagataagaacgggagatacaaacatagagtaagatcacgcaaaaaatacgcacaacaggaagcacagcgccgaaacttcaacaccagaaaaagacactaatgggaggacactaggagggcggaagacacgcccgacgaaatttaactttaggcaccccaccaacagcaccatctcaacgaaagaccacaaaagttgaataaatagaaagcagaaaaataaagaaaatgattcaacagatcaagaaacaaaaaagtgtaatatactgagcaggaaaactagtaaaggtcattatatatcgatccaaagtagagcaaaacactagggtaagacatacgaccaagccgcacatgaaagaatcagcccacacacaagcgacatcacaacaaaaccaatacaagcgatataaaaacattaaagtaaacaacaccatacaacacggatgacacaccagacagcaacaaaatgaagccaacaaatagatccacactcacacaaaccaaagaaacagaacctatacatgaatacacgc

SEQ ID NO: 535085 - DNA, 142 bp, Homo sapiens
  misc_feature (118)..(118): n is a, c, g, or t
aatccttttgcctaagcctcccaaggtactgtgattagtgtcatgagcaaccacacctggcctaaaagatcattgatttagttttgagtaagattttaggtgattaaataatggtatngtggtgtttggaatatctgatata

SEQ ID NO: 535086 - DNA, 756 bp, Homo sapiens
agctgaagacggaggcagctccacacttgtgaactaaaatcatattctaagaactcagccacgtcagggtatccaccatggtgctgggtcctgaacagaagatgtcagatgacagatgtatctggagatcatggggagtctgccagtcttggataagctatcaaagcgccgtggcctagtagtaatcgcctctcgttatcacgagtcgcccgtggggactcagaggagtacttcgccacttacgtttaagtgagaagatctccattcctgaggaggagtactcttgtgtgagctttcgtaaacatctgggctttcaccggaccaggttcttcttatgagcagtgcctaccatgggatccgaggaaagtgttgaagtccgatttgcagtctggaggcagtggctggatttaagttgcgtctggatccgttctgttggccacccttgtggggctgctgctccagcgggctgtgcagctcagactgggagtggttactgggctgcatcttgctgaagtatgtcacgcgtcagtatcccaagggtcccacgagtcatcctgtggcgtgatggtggagttggctatcatcggtctcagacatgcaaagaagtcattggctcagccattgctatcaatcttctgtctgtaggaagaattcctctgtggggtggcgtctcatccaccttgcagataccttggtttctctattggacaaatatggttgcggaagctagagcattttgggtttctctcgctatta

SEQ ID NO: 535087 - DNA, 166 bp, Homo sapiens
tcgggcccacgtatgttaatgtgaaaacatcagcctcatctgccctcatctgcctgcgcattggacatggagatggtccagcagcacctgagctgtgccctgtggcacctttttccatgtgtcttctctcatgctgcatgagcttctggccacatgtgatcttgaa

SEQ ID NO: 535088 - DNA, 269 bp, Homo sapiens
agaatttcggcacgaggaatttccaatcatccccagaaagtttccattttgcccctttgtacttagccccaactccctgcccccagccagcctaagctcacacggaaccacctaaatctgctttctgatcttgataggtataggttgccttttatataattacatataggtgggatgatagatatatggtcttttgtgttggtcttttgtaaaagacttttcctgatttagcagtattttccttatgttgctgacataaagggggttat

SEQ ID NO: 535089 - DNA, 1040 bp, Homo sapiens
taaaagagagaaaaaccccgggaaacgagggggggggggggagggagaagagggagagaaaagggggggagaggggtggtgaaaacaacagggggtggtgtggcgcgcggggagaaaggagggtgtggaagtgtgggtgaggaggggggggtggggaggaacgcccccgcagagggggggggtggcaaaaagagaaaaagaggggatataataagggggtgcgtacaacaaagagagagggggcacccgcggaagaagagagagagaaagagagaaaatttggcacacacaagaaacaacgggggcgcaccctcacacacaaaagagagagcctctccacacaggaggagaaacagagggggggtgcgagcacgggcgcgggtgtcaacgcgcgaggggtcacaaacaacccccacacacaaacacacaccaaagagagcgcggggaaacacagacagcccggcgcacgcgctcgcggagagagagagaggagaaatacaagagagcgccccacgcgcggcgagagggtcggcctcgcgcacacccgggcgactgcgcagcgcccgcgcgaacaacacaacaccgagagagcgcgaggggcgtgtgaaccacgcgcgcggggggggagaacaccaatatacaaacaaacagacacgcacgagcgcgccgcgcgagtgacaacaaccacacagagggggggggcgcgacaacagcagcgaccaaaacacagcgatgacggaaaaagagggggagcaaaaacaaacacatccgcgcggcgcacgccaccagcaccccacaacacccccccaccgcatgacgaggcaggaaaaaatctaccaccacccgcacgcgaggggcgcaaccacagcaaagaacagagcaggggtggagaccccacacacaacacaaaaaagagagcgcgaccagcaaaccccctcctccggaaagcagcagagagaagacacaacccaccagcgcgtgggccgctggccaaccacagcagaaaacccaccaccctccccccccgacgagaggggaaa

SEQ ID NO: 535090 - DNA, 217 bp, Homo sapiens
gtgacagtgttgcgttcatttctgcattagcagttagacacttggtattgatctgttgggctcacagatttgtttctttcccaacatcatcataagttcatgccatcctttcctcagcacactgtgcacgtaatgccgagcctctgcatccctggttcccaatcagtcttcgcattgtctccttgtagtgacctctactgccgtgtaagacaacagt

SEQ ID NO: 535091 - DNA, 251 bp, Homo sapiens
ggcggtttatttgaaaataccaatttggccggcgcgtggcttacacctgtatcccaggactttgggaggccgaggtgggcagatcacctgaggacaggagtttgagatcagcctgaccaacatggtgaaaccccatctctactaaaaatagaaaattagctgggcatggatcaagatgagcctgggcaacatagcgagatctggtctctacaaaaaatttaaaaacgttagtcagatgttgtggcacatgc

SEQ ID NO: 535092 - DNA, 111 bp, Homo sapiens
tggtgatctagacatcccataatcggaccgttcgaggaactcatcgtgggcacctggaagcaggaggacatagtgtcaggtcggctctgctcacgtgtcatttgtctcttt

SEQ ID NO: 535093 - DNA, 969 bp, Homo sapiens
agcggcctgggcgacagagcgagactccgtctcaaaaaaaaaaaaaaaaaaaagattgacagcctcactgctcaggggccaggataacagcccattttacagatggctttgggctttgcccaaggttcaccaacccttcttgaaactgaggcgttccccaaacccaatgccgggaagctggttggaggaaagtggggaaagggtttccccgcttctccacgtgggggttggaggttgggagaaaacgcattttcaggggtgtttggacattttaacaaaccagttattgcaaattcacattgcaaattcgcattgcaaattcaccacccattttctttaagccctcgacagcgctggcattgttctgaaactaataatgtgggaccctgtcccttgatgatgaccgtgggtcgggaggtgcacggccttttccctttccctccgctctttccctttccctttccctttccctttcccattctgttctccctttcctttcgccccctttccttttccttcttcccttcccttattctttccattttttcctcttcttcctttcacattcatttgtccaagaacctcccgtggcctgagataaccttaagtttgcaaaagttggcttccctgcagcccatttcccaggttggggaaactgaggcatgggcctaaggtcccacagccacaccgaggaaagcagcccccactgattgtccccatgccccaaagtgcatggccctcggtaacccacagagcggacacatgacagttggctggagttgtcaaagctgcttgaggaagctccagggcctgaataaggcttgaaagcgcccagggcgaactattggtggaattgtcttggccttgaattacaggctgcagaattggggattctgcagaaaggtccacacggacatcttcctggtcccccaagttgttttacctcctgataccccatcaattgtttct

SEQ ID NO: 535094 - DNA, 286 bp, Homo sapiens
attcccaggttcacaccattctcctgcctcagcctcccaagtagctgggaccacaggcgcccaccaacacatctggctactttttttgtattttttaagtagagacagggttttgccaggtttgccaggctggtcttgaactcctgacctcaaacgatccgcccacattggcctcccaaagtgctgggattataggcatgagccactgtgcctggcccaccatgattctttgaatagaatggctacatcaagcaaactgacatatgcattacctcctgtacttact

SEQ ID NO: 535095 - DNA, 377 bp, Homo sapiens
  misc_feature (376)..(376): n is a, c, g, or t
gaattcatgggatggggctaagagaaagccatgtgcctagccgggcgtggtgactcacacttgtaatcccagcactttgggagggccgatcacttgaagcctggagttcgagttcagcctggccaacatggtgaaaccccgtgtccactaaaaatacaaaaattagccaggcgtgcacacacctgtaatcccagctacttgggacgctgaggcacaagaattgcttgaactggggaggcggaggttgcggtgagccaagatcatgccactgcactcgagcctgggcaacagagtgagaacctgtctcaaatacataaaaatacattgtgtcataacgatttgtgaaaagttcctactttaagagagcttacatgtna

SEQ ID NO: 535096 - DNA, 133 bp, Homo sapiens
gtcactccaacccttaaaattagagctcggcacgaatttaacggtcaccgtagggcaatagctcgttaactggtacattcaaggagagacagcgaagcacgcacacgtaagcccgagcggcgtacttctcgat

SEQ ID NO: 535097 - DNA, 374 bp, Homo sapiens
  misc_feature (61)..(61): n is a, c, g, or t
  misc_feature (131)..(131): n is a, c, g, or t
ttttttttttgtccaaggtttatcaaattaattgattttggggggcaagataaaaattttnatttgattaactttctctattggtttttgttttcaatttcatttatttcttcttttatctttataatgtncttacatctgcttggtttgggctgggcacaggggctcatgcctgtaatcccagtactttgggaggccaaggtgggcagatcacttgagaccaggagtttgagaccagcctggccaacatggcgaaaccccgtctctgctagaaatatagaaattggccaggtgtggtggccagcacctgtgatcctagctactcgagaggctgaggcaggagaatggcgtgaacccgggagggcagagcttgc

SEQ ID NO: 535098 - DNA, 510 bp, Homo sapiens
agggaattgaacgaagatgacagtacagattgtgatgatgatgttcaaagagaaagaaatggagtgattcagcacacaggcgcagcagcttctcttacagcttcctctggaagtctgatggggttgcttatcattgatggaggtatagttgaatattcatgacattgccaaaatggagtaatatccttgcgactgtcatgtcgtagcaacagtaaacagtgatcaatgttgaatctgtgaatggtttaccgtttactgtgatgtgctactgtgaatatatgtctttaattactgctggttctctttggatgacactgtgtaaatatgttgttacataattgtactagtagtaatagaatgttacccgacattttgtagtggagaaacatgaagaatacaaaaagaaatagaaaatatcaaatggtaaataagtaatacaataaaatgaataggtacatataaatgatacaacaagggaagaaggtggaacatattgtatataagtgacaa

SEQ ID NO: 535099 - DNA, 395 bp, Homo sapiens
cgtaatgctgccatggagatctgcatgaatgtgctcgatgacagggcggaccttgccaagtatatctgtgagaatcacgattctatctccagtaaactgaaggaatgctgtgaaaaacctctgatggaaaaatgccactgcaatgtcgaagtgttgatgagatgcctgctgactagccttcattagctgctgagactgatgaaagtaaggatgtttgcgcaaactatgctgaggcataggatgacttactgggcatgcatttgtatgaatatgctagagggcatgctgagtactctgacgcgctgctgctgagacttgccaagacatatgagaccactctagagaagagctgtgccgatgcagatcctcatgtgctatgccagagtgattgtgtt

SEQ ID NO: 535100 - DNA, 451 bp, Homo sapiens
ctggttacattggtgttctcacatactctctgcgaagtttgtgtgttctcagtgtacacctgctcctcagcgggggaccaatggccatggcccaccacctgcccttcagtgtccaagcaggggacatgcaccctataagtaaccatggaggtgacccatacacatgacaaccaccccgaatgaccatcatcatggaagcctgctgctgactagagatatgcccccagggaggacaagggaagagtggatgctggaaagacaggacaggggacaatcaccagggaaagacttcattcttcggaggacattgaacctggggctgggtctctagtggagccgctgatacttctcctgtatccaactgttctaactctatgggctatctccattttcagctctatctttacctggccttctcattgctggttccttcaagcctcctctctattct

SEQ ID NO: 535101 - DNA, 103 bp, Homo sapiens
caatttgcaacctgaagactttgcaacttatcactgtcaacagactgagaatgccccgaacacctttggccaggggaccaacctgcacatcaaacgaactgtg

SEQ ID NO: 535102 - DNA, 235 bp, Homo sapiens
tgtatacacagctccgtggcacgcataagtcaagctagtgtgtgtctcctttatccagacaagactcctcaggctgctgaacaggtcttagtatatcctaagcgtactcccaagctgggacctgcttgtgcgtaccaggtatctgccaaatggctgctggaacaaaacagaggccggtccaagtggaggagattccggttaataagtgacttcgtggagaaagtctaacatacag

SEQ ID NO: 535103 - DNA, 437 bp, Homo sapiens
  misc_feature (14)..(14): n is a, c, g, or t
  misc_feature (149)..(149): n is a, c, g, or t
cctttaaattttcnataggtccatttgccttccttccttagtccacatcctacaggtaaatatttttaaatcaatgatcttttccctcagtataatcagtggttcctatatgactttaaagaatgagctgttttggcctgggccgtggntgtcacgcctgtgatcccagcactttgggaggccgaggcgggcagatcacgaggtcaagagatcgagaccatcctggccaacatggtgaaaccccatctctactaaaaatataaaaattagctgggcgtggtggtgcatgcctgtaactccagctactggtaagtctgaggcaggagaatcacttaaacctgggaggcggaggttgcagtgagccaagatcgcaccactgcactccagcctggcaacaggatgagactctgtctaaacaaacaaacaaaaaaaaaaaa

SEQ ID NO: 535104 - DNA, 134 bp, Homo sapiens
taaaaaaaaaaaaaagatgggaacagagtctaaagaaaattgattaatgggaggtatgattgggggattggagcccagaatttaggttaacattctggcaaagtggttggccaaaaccttcatggaaatttcag

SEQ ID NO: 535105 - DNA, 666 bp, Homo sapiens
atccctcttaccgaatggtgcctatgcagatagtcggaccaggcatgcttgaaagcaggcgggggcctagccctactagtctcaatctccaacagcatatggccgtagactacgtacaatagaccgtaaacctagcgtccattgctaaaactgaatcgtacccagacaataatatcagtaccactgacatgacttcgcaaaaaacagataattggaatcaaacaaaaatcgacgcccaggaggagtaattattcagcatcagtcgccgtctacataatctttgaagcgaaaatcaagagacaactacttgagggtgagccccgaccgtcatgcctcccgacgccacaaaaaaagcccccgtacctaatgataacgacatgagctctaccgtacgaaaacatggaaggacaacgcggaatatacacagtgagacagggcagcaagggaatctgagccgggcgagaaaacgccgacgcatgcggaaggataccatgacacgggagacgtggcaaagcagagtcatgaagacagaaatcccaccgacgtcagacgcagcggaaacgcgatcaggaggtcacgcatccacgagggcgcaacgcaaaacgagtggcaaaggccagagaacaagggagagaacataacgggcccactcagcgagggcagaga

SEQ ID NO: 535106 - DNA, 451 bp, Homo sapiens
  misc_feature (166)..(166): n is a, c, g, or t
  misc_feature (222)..(222): n is a, c, g, or t
  misc_feature (300)..(300): n is a, c, g, or t
aaggttttagagtagtgtagtctaagtagagggtggggtatctttttcttgtcgtaagaagtttattttcatggaagtctagtaaagtaatatgatttagtctagtactttttgcctcaggacttatggctttgatgtgctttccatttgggctctctttttctcntgtgaccttaagaactttgtctggtggctttgctggaacattgtcactgtttttantgtcatgcagggagcccagcattgtggctaggatggcagagacttctttgtcatcatggagaagtgccagcaggggantgggaaaagcactctacccagacctcacctcccttccaccttttgcccatgaacaagatgcagtggccctaggggttccactagtgtctgctttcctttattattgcactgtgtgaggtttttttgtaaatccttgtattcctattttttt

SEQ ID NO: 535107 - DNA, 1301 bp, Homo sapiens
  misc_feature (119)..(119): n is a, c, g, or t
ggggtagcaactggatacccggtcgctagcttcaaacgggcacgtatcctacaaatagtccggagcatatgaactgttactgcctcaattgaccgcgaaggagggatcgatctcttatngattccctagagaaagaaagcataacactcgttatgatgagtagggtaacaactgcatagacatttcctacgcattcgcgaaactacgatgacgcatgctgatcagaatggacaaaagatgagtagagcagtctaattatcaactaagacactccatacaatgcatgagcaacacgtcgagaacgaaacgacatgttctagtctagtggcaacgccttccggatgtgtctaagtctcgaaccaatcaggagacaatgcccttcgacttagagtggaaccagggtgttaaactaatcccgttaccaaggggagatctctgggcccaaaatgcgtgactcgctgggctgcgagattataccgcattggcatagcactacaatgcgtcgatcacgacaatccaacacgatggtcatgggagccagggtaatcacggacgcttgggcacaaggctgtatcaacaatatggttcaataacttggcacggccgaggatacacatcaccctgaagggccaggctgcgacacaggggcgtatacgtacggtagaggtcaaaccattggagtaccccatagtaaggattaggaggggaacgccaggtacttgcaaactagcgggtacgcaccagtaccggattagcagaacaatggcataaaccgataacccaatattggacgcctatgtaggtaaaataacgaagcacattggcgtccaggttgcaggagccagctgaccgggcgcgcgaatcgaaactaggcagcacatacgccaacggtgagcaaaggaacaccccaataagggggcaagagcctcaaacaccaacactgaggtcgaatttggacaaggatgcaggttgaagcacttgactgagagactcccgaggcaaggctaccctagcggaccaaagccgaatgagccatggcacttttacacagcagatggacagcgacacgcaagggagaaagcgtcgcaaggggccaggaaacccccgagaaccatcctgaaagcgagagacaccctggcaaaggaagaattcggaacacaacggccaaaaaggcgaaagacagcgcctaacacgacacgaaatgggcagcacgagaaagaaaccgcgaggacaacacggagagaggacaaagtatagcgccaaggggagaacagacacgcgggcgagacacatatcgctca

SEQ ID NO: 535108 - DNA, 137 bp, Homo sapiens
tacttttccaagattatacgtggaagatgagatctatgaccaaatcaaagaacatcatgtggtgtcctatacctgcatgaagatggtttggaatagcttgcaaaagtgctaagatagacctaaggactttttcagaa

SEQ ID NO: 535109 - DNA, 258 bp, Homo sapiens
ccccctttgggcccccggggccccccccccttttggcccccttcggctcccccggggccccccgggccccccccccggggggggtttttcccccccggccccccccggggggccccccctttttttcccccccccttgggctttcccccggcccccctttgggggctttttcccccccgggggggctttcggcgggggcttttccccccccccgccccccccccccccccccccggggcccccccccccccccccccc

SEQ ID NO: 535110 - DNA, 1022 bp, Homo sapiens
  misc_feature (1022)..(1022): n is a, c, g, or t
gcaactgaaaatggtggctgttgtaggacggttgcccccgagctgtcggttgcccgacatgtgagtgccattccttgtggcatttctgtcactgctgccctcaggcctgctgctgtggaatgaacgagcttgacaaattgatcgtgttcgtggtaaccagcttaagtacataattcatcagtaaaacagtttgctcatggccaatagcactcttgcttgggaagtctcaagattgccaccacgtatttaagagggtacagccgcagtcaattgtgaggaggtacaaagaccgtaaatgcctcttattgtactgtcaggggggagattattctcgtgcttttcttctatcccattttggattcatcttttgttgtgtccatacagggaaatcggtgcttttgacctgacgaacgtctgaaagctgaaattgtaaactgactagtggaaacctggttgactctatgtgcgcagtcttcagctgtgactatcccattgtatatctcaatcagtgcctggtattacattacatccaggacacggaatggggttttggtgccaactggaacatcgggctcttgttgagcacttagttaagcagattcccgcgatgtacgttgttgctgtagaaaggtcggtctgacactaacgaggtctcttcataaattgaccccagtggtgtcatcaggcttttgagcgtcagcgtctccgacgtgcgctcgagctgggggagaaaaccttccgctgggtcgctggcgttccaggcttgttgccctccttgggatcctgccaggaactggcgcggatccctatgattaggcacggccactgggccagaggtttccgagggtgacactgtgtccctttgtttgccttcacttgggggaacgactggccggttcattcaaagggttgtgtacgggcccccttttttcatccccctgtgttggggcgccaggggcgcaactttgcgtgggggcaatagacattggcgtttcttagcgcgttggtcgacaacttattgn

SEQ ID NO: 535111 - DNA, 820 bp, Homo sapiens
gcggagacggagtgtgtgagtcatgaggctttcttaggtggacatgtccatatgaattacaatgtcctttaggctgggcgtggtgcatggctgtgatctcagcaggcttggagaggctgaggcagttgaagatcactgtgtaggccaggcgttggagagcagccgtgggcaagggtgggcaagaagccgtgtgtcgtctacaagaagaagaagaagcgtctgccatcatggatgtatctcgcagaagctaatggcagccttggccttaaacctttcgaaaactgctggtgtaaagacaactcgaagaatgtgtcggctcacccatgagcatgtcctgtgccctggccatggtctacatggggcgcaaggggaaacagcgctgcacagatggcccagaatactcttcttcgcattaaaagtgggcggtcgcgatggagacgatccgaccaggggcttccagactcttctccaccgaagtgaacaagagtgggcacgcaagtacttgcttaagggtggccaagaggctctttggggaaaagtctggtgaatttcctctcatcttgtcagcagattcgcgtgcctagaaaagttctaaccaaggcagagatcggaggagcttgactattatcaagggccgtagagaagtccagaaaacacatagacacctgggtagctgaaaagacagaaggtaaaattgcggagtggctctctccgggctcagtggcatccatcgacaaggctggatactggtgaatgcctgtctatttccagagcgaaactgggatcgaacagttgacacggacgaccaccgaggagcaga

SEQ ID NO: 535112 - DNA, 96 bp, Homo sapiens
  misc_feature (3)..(3): n is a, c, g, or t
  misc_feature (28)..(28): n is a, c, g, or t
aanttcaagttcttaacgaatgtacggnggacatgagcacctccagcctgtactaagtgccattggaataataaatttgataaggtggcgaaaaaa

SEQ ID NO: 535113 - DNA, 518 bp, Homo sapiens
tcttgatgatcaaacattgaattgacactggttgaaattaggctaatcatcagtcctattactgtaaacattcaaccctgttgacaatcccgtccccgaacttgaaccagcaaccatttcacatggataaccatgattatgttaagaaatacatccaacaatatggatgaaaagccagtttattaattatgcattgtaaaaatagtatacaatgaagaaaatattagcttatttgtgattacttattacgtgttcatgacctagggacaccttaatattggaaaacaggttaaagtgtcacttggagatgaaaacttgatcaaaggaaaatattagcttatttgtgattacttaccatgtgttcatgacctagggacaccttaatattggaaaacaggttaaagtgtcactgggagatgaaaacttgatcaaagggagaagtcactgccctcttgcccttacctctcaatgcccatttttacctaaacaataaactagcctgtgagtgacacccaaaa

SEQ ID NO: 535114 - DNA, 301 bp, Homo sapiens
ttgggcgagagcaacctgcactgccactgtgccctcctgcctcctctgcctcttcctctctcctctgccaacgacatctaagccacagaactgaagaggctgccaagaaacgcacagcatcaactggagaagtgagaaaaatctctctgtggggccaggcgcggtggctcacgcctgtacttgctcacgcctgcactttgggaggctgagatgggtggatcacctgaggtcaggagttcaagaccagcctggccaacacggtgaaaccccatctctactaaaaatacaaaaaagtagctgg

SEQ ID NO: 535115 - DNA, 881 bp, Homo sapiens
  misc_feature (629)..(629): n is a, c, g, or t
gtgccttgtataatggtctgacactactgattatggtctctcatttcactcttcagttgttcctgttatttatgaacggtatcaggcatcagatagatcattatctagtgacttgcaaatgagaatgttatcagatgctatggctaaaatccacacgtaaaacaatccctggattgacagcagcacagctgacagtgataacgcccaaaataatacagtaggacgttcatctttataggggatattcatttgattatacgggggcagggtcaggcaagaacgaaccttgacgttgcagtgcagtttcacaggatcgtgggttagatcttcgatttcatagccatgcactgttgtgaggaaacattgacctgtcttgacctgccatgtgttcatcatcttaagtatgtaagctggtatgtcctgggttgtacaccgttatcatatcttgtggtcctatctatctgaggcactggtggagtaaaaaacctgttatgttttagcttcgttggcagattagttcttgacggcagtctatgtgcaatgttagccaggagatggtggagctagaaacttttaacctaaacaagtgccttttggccggttggtgtgactgtggtggtatggtgcgncgggaatacctggatcgcattatttttgcggagaagacagggtggttggttaagcacgatattgaatccgggtcaaaagtcgggaattggaaataagcttgcaccgttggtattgtacatcaggggattggggcagataagtggtatatatttggccattatagagataaatagaattatacagagaagggtagccaacctaaaatttacctacaagacccaagggtctacctaatgagcgatgagttcttg

SEQ ID NO: 535116 - DNA, 100 bp, Homo sapiens
gggagaagagagaatgttggggtttattattgcatgcaagctctacatatacccatctcactttcggcggagggaccaaggttggagatcaagcgaactg

SEQ ID NO: 535117 - DNA, 202 bp, Homo sapiens
caatgatgtgattgtcattgatgtgattgtcatgatgtgatctgttcatgatgtgattgttgttgattaaattgattggccctaagatagaggagacacctgctaggtgtaaggagaagatggttaggtctacggaggctccagtggatgggagtagttccctgctaagggaagggtagacttgtacaaccttgtttcctgc

SEQ ID NO: 535118 - DNA, 524 bp, Homo sapiens
attggtatttagttgttttttatcccaatgtcaactttatttttttatcggcgcactgattaactgagccattttgttgacacaggatgcaagctggttctggcctatctgattgaacacaggatgagataaaataactcctggcctccacaccttggaatacgctggagctggtttgacaactttacccaggatgagtaagctctgtgtggtgacctcccaaaggagcatgatgaatggcctgttgcagtgggcatgtgcctttgaccaggcgttcatagacggaggctgggagaggagtcctaaagaagttacatcctaattgtcctcctagctgaagttcatctcaattatggtaggtcaactggggatgaactagacacgatgtccatagtctgctgcacaggccgaatgtttgcgcgcttcattctactgaccagtcagcaccacttttgatagcaccccatcagtggggctaatgaggaaccactactaaacgcatcttaggaacaactggtctggaa

SEQ ID NO: 535119 - DNA, 410 bp, Homo sapiens
  misc_feature (342)..(342): n is a, c, g, or t
  misc_feature (357)..(357): n is a, c, g, or t
gtcttactcttaccctgatgcccaggctggagtacagtggtgcaattatagctcattgcagccttgtactcctgggttcaagtgatcctcccacctcagcctcccaagtagctaggactacaagcacgcaccaccatgcccagctacatttgtttctttttttttgtagagataggggtcttgctatgttgcccagggctggtctcagactgcctaaagcagtcctcccacctagggccgcccaaagcactgggaattattagggcatgagccacttgcacctgggcctgctttgcctttctttaaatggaccttcatgttcatttgttccagtggaggganttttgtttttcaggntggacccctggaggtgtttgggttccccggaagtttcccaggccacaggttcc

SEQ ID NO: 535120 - DNA, 258 bp, Homo sapiens
  misc_feature (162)..(163): n is a, c, g, or t
  misc_feature (210)..(211): n is a, c, g, or t
  misc_feature (253)..(253): n is a, c, g, or t
ggtagattagcataatgtcttaatattcatccatataatcacaaatggcaggatttctttcttttttaaggctgaatattattccattacatatataaatcacattttctttattggatcattcaagtggatatttacggttgattgatatatcgttggcannattgggaataacactggcgtatgaacatagcaggtacacaatatctnncttggacattacggatttgactttcccttttggatatacacnccaga

SEQ ID NO: 535121 - DNA, 235 bp, Homo sapiens
ggggggggaaattttattttcccgtttattttcaaatttttttacgggggtattttggggacctttaaggttttaacccttttttaaaaaattcaaggggggccactagaatttttttcaaaagttaatttttttccaaagggggggaaaaatttgtttccccttccatgattttgaaatggctgggaagaaaataaaattaaacttgggggttttattggtcccccccttggta

SEQ ID NO: 535122 - DNA, 2195 bp, Homo sapiens
  misc_feature (2099)..(2099): n is a, c, g, or t
  misc_feature (2103)..(2103): n is a, c, g, or t
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagngaanagtgtggaaacttttccaagaggccttctggattcctctggacatattatttggggaaacttgggctacttggaaggcccttaccccccact

SEQ ID NO: 535123 - DNA, 2177 bp, Homo sapiens
  misc_feature (2099)..(2099): n is a, c, g, or t
  misc_feature (2103)..(2103): n is a, c, g, or t
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagngaanagtgtggaaactatccaacagctctctggagttgactgggtcagatgtgcctctgggtcaatgttccggtcccc

SEQ ID NO: 535124 - DNA, 1447 bp, Homo sapiens
  misc_feature (1351)..(1351): n is a, c, g, or t
  misc_feature (1355)..(1355): n is a, c, g, or t
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagngaanagtgtggaaacttttccaagaggccttctggattcctctggacatattatttggggaaacttgggctacttggaaggcccttaccccccact

SEQ ID NO: 535125 - DNA, 1016 bp, Homo sapiens
  misc_feature (282)..(282): n is a, c, g, or t
  misc_feature (970)..(970): n is a, c, g, or t
gtatcaacgcagagtggccattacggcgggggctgcagacgtacttagaaaaggggtgcatactggatattcaggctaggagaagaacgcaaaaagcagtgacgtacattattctctgcatatatttactaggggaaattgtgcgtctccctattctgagtcttggcaggaatggactggtccaaccttatacagagagcagtagagcgcggcagtatagagagtacctcacgaaggggacgtgggaaaagtgtagccggggaacgctgggaaactcccggnctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaacaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaagtgtcaccacagcaccagaatttacggtcgttgggaagtagctgaccttcagactcagctaaagattgacaaagctgtggcctttcagaatccgcagactcatgtcattgaaaattttgcatgcagcagcttaccggaatgccttggctaatcccttgtattgtcctgactataggatcggaaaagtgacatcagaggagttacattnacttcgttcagaaccatttcacagtgacagaatggatttgattgga

SEQ ID NO: 535126 - DNA, 794 bp, Homo sapiens
  misc_feature (119)..(119): n is a, c, g, or t
agcggagttttggggcgcgcgctctgatatcgggtggcggtgctgcctcgagagcgcgcaggaggcttctgctgagcagagggccggccgcggctcgttgcgctgggaaggttgaggantgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaagaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtatatgggaaatgctgaggtgcagcctgtttaatgtactttatttgttgtcagtgttttagttagtgggctcatcacatctatgtggatgttataggttatttaacactaagattttcaaagttaaaa

SEQ ID NO: 535127 - DNA, 314 bp, Homo sapiens
  misc_feature (63)..(63): n is a, c, g, or t
  misc_feature (68)..(68): n is a, c, g, or t
  misc_feature (74)..(74): n is a, c, g, or t
  misc_feature (83)..(83): n is a, c, g, or t
  misc_feature (87)..(87): n is a, c, g, or t
  misc_feature (95)..(95): n is a, c, g, or t
  misc_feature (99)..(100): n is a, c, g, or t
  misc_feature (141)..(141): n is a, c, g, or t
  misc_feature (154)..(154): n is a, c, g, or t
  misc_feature (281)..(281): n is a, c, g, or t
ctctagagtatccccccatattggcctgcagtggtcgagaggtgcagcagaagaccgaccggntgctnaggtgnagctgcgantcanggactgcntggnngagaaggcacaggaggaggagcggctcagtcggcgcctgcntaacagccacganaccattgccagcctgcgggtccagtccccacctgtcaggtatgtcatcaagacagtggaggtggagtcgtccaagaccaagcaggccctcagcgagtcccaggcccggagcccagcacctgcaggancaggttggttatccaaaagtccagggtgcttga

SEQ ID NO: 535128 - DNA, 1272 bp, Homo sapiens
  misc_feature (282)..(282): n is a, c, g, or t
gtatcaacgcagagtggccattacggcgggggctgcagacgtacttagaaaaggggtgcatactggatattcaggctaggagaagaacgcaaaaagcagtgacgtacattattctctgcatatatttactaggggaaattgtgcgtctccctattctgagtcttggcaggaatggactggtccaaccttatacagagagcagtagagcgcggcagtatagagagtacctcacgaaggggacgtgggaaaagtgtagccggggaacgctgggaaactcccggnctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaacaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaagtgtcaccacagcaccagaatttacggtcgttgggaagtagctgaccttcagactcagctaaagattgacaaagctgtggcctttcagaatccgcagactcatgtcattgaaaattttgcatgcagcagcttaccggaatgccttggctaatcccttgtattgtcctgactataggatcggaagaatggctttgattgaacttgctgtgagtcatactgttctaaagcaaagcgctgaacagtttctcaacatgaggggcggtcttggattatctggtgcaaaggccaactacctgcggaggcgaaatccgagaacagaatgtatacagacttgttcatgctgctttagtagcacaaagagctgtcgagcgaggtcacaggcaaatgcatttagtgttgttcagcatgttctaggcgctgtgccacatgtagagaggggcaagaacaccaccagccttttggactaggctgtagtcaaggtaacataagaagcattttatggttctgtaa

SEQ ID NO: 535129 - DNA, 1348 bp, Homo sapiens
gctggtatacttacccacccctttcctagaagggctactgctcctggacagagtggacggatccataataaagacgtcccaaatggatggagttcggagagagctgcgatgtgaactgccccatccccatcgcatcaccccaggaccaccaacggacagtccttctgccttgtccatggacatagagcacatagaaccaggctccctgactagactacacacctaggagcactcatacctcggtagcacgacacccatgggatagcaaggacagaaccgagagcatctaccactggaagagggacccacaggcttcgaggaccaaggtggcagcaaggagaggctagcaccctagccgggacacctagaggacaagcatacagctacaggcgtaggggtgtgcgctcggggacccaattgagcacacgcagaagggacactagccaaaccaagactagtcgaacggggacccaaagtatggactgggttacacccacacacaaattacccaaaaatacacacagatgagaccgcccaaaccgtagagcaagtgagacgtaggtttaggacgagggcaaacccttctacacttcacccctactttaaacaaccctaagctacaaagacatcgaaaggggcatagccacgacaaagcaacgccagatcctacggcacggaggagagaagggagatcaaaaggtaaacctccgttttggcccggcaccatacaacttataatccttccattcacctaccgcgcaacttacctggtgcaaaaaagatcccaacatgcatagactggaaacattcaccatataacaccccaaggggccccaagggcacccacccatcggcgcagctaccaccaagggacaatgagatacaatggaaaagacaagagcacccaacatagaaaaacaggagacccacaaccacaggaggcaagcctgagagaaccaaggcagagcccatggggagagagacccatgcaataggagaacacgaccacaaagcatagcgaagaagagagcaacaacaggacaacaatgacgcaacccccatggggcgtgaaatgaaaacaaggacaaaaaaacccaccaccctgggcctccaacacctggcgcaggacaacgcaagatggagcccactcactatcacggcgaacacacacgaagaccccctgacagatgccacacaccaggacacccggaaaagagcgcacgcaagtagccacaaaacagaacgcaagcacgaacacggacaacagcgcaacaccaaacaggaaaacccaaacagcaagcagacgaccacccccgaacaagaaaacagaagacaaggcaaaacaacc

SEQ ID NO: 535130 - DNA, 141 bp, Homo sapiens
cttcgcacccacatagaggcaggaagtcaggaaagaggctggaagaggttccccttatgtgacagctagccagtcactggtgatcatggccatagatgtgtgcatcaagtgagggggcagagccagactctatgtcatttt

SEQ ID NO: 535131 - DNA, 796 bp, Homo sapiens
taaacagatatgctgatttgtaaaaggtaatcctcactgtatacagaatggggatgtatcaaaaaaggcagcagaatatatagaggcctgcagcaaaaaagaacccacccatttgctgcgtcttacatccagtctgacgacaacaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaagtgtcaccacagcaccagaatttacggtcgttgggaagtagctgaccttcagactcagctaaagattgacaaagctgtggcctttcagaatccgcagactcatgtcattgaaaattttgcatgcagcagcttaccggaatgccttggctaatcccttgtattgtcctgactataggatcggaagaatggctttgattgaacttgctgtgagtcatactgttctaaagcaaagcgctgaacagtttctcaacatgaggggcggtcttggattatctggtgcaaaggccaactacctgcggaggcgaaatccgagaacagaatgtatacagacttgttcatgctgctttagtagcacaaagagctgtcgagcgaggtcacaggcaaatgcatttagtgttgttcagcatgttctaggcgctgtgccacatgtagagaggggcaagaacaccaccagccttttggactaggctgtagtcaaggtaacataagaagcattttatggttctgtaa

SEQ ID NO: 535132 - DNA, 204 bp, Homo sapiens
gtacatccgataagcattgccttcttatttacttctttagctgtcaactttgtaagatgcaaagaggtcggatcacgtttaaatgactgtgctgcccctttcacatcaaagaactactgacaacgaaggccgcgccctgcctttcccactctgtctactctatctggctggcagggacacggaaagcaaccttgcctgctcggc

SEQ ID NO: 535133 - DNA, 1172 bp, Homo sapiens
tccggcatgtcgagttctgtattagctggggcttccaacaaaaaccagagtcactgacagagggaacagcagagaccattgtaggtattcagcatgtgatggatatagagaatcagaggcaccttgttttcacaactaggataaaaatatctgcagggtcgctttccattcctatttagagggagtcctggctccatgaacccactccgcgagtggcactgtcccaagccagcatcaggctccacacgcagcaaacagtgcaggctgcacacagggggggctcatggcacagcagcggtcagggcagtccaacggcagcacagcatgcaagatgcaatgcttgcaatgcattcacacagtagtgtagtagtccccagactagattcacatcctattacgccgatgcgtggtaggaggctgggcctcatctggactagggtgccagtgaataggcacagcagggtattcatatatactagcaatgggccaacaggacgcatatagaggaggatgagcaggagggtaggcagactggctggccatgcaacatggggactggacgtgacggcagacaagaaagacagaagataaacccccaacaatcccatgcaaggccctgagtagatagaagatggaatctggcttccataggattagggcaaacattaactgcagcatacttgtagcatacacaagactcccccttcacagcccagagcccgaacactgggtcctcgacaatcgcgcagtctacctccatatccagtacgactacagtcggacacacagtccaagctgccagggaaccctccagattagacaaacaagcaccgacacacaagcacaaaggaaagacggccacaacagagaggaacacactgaacggttacccatatacaggatcacacaaactaccaacaagaaagagatcacgcaaacgaccagaaaccccgccaccaaccaccaaaaacgaacaaacaagagcagacagaacagggaagacaagcaggagaaacagacgagaacaacaagagaaagagaacaggaatggcaccacaaggtaaaagaacaacgcaaacaacgatagaagagaacaaacaccaacacaacaaagaaaagcaacaaagacggagaagaaaagtaagtaggtcgattcctatgcaaaaaagaga

SEQ ID NO: 535134 - DNA, 295 bp, Homo sapiens
  misc_feature (159)..(159): n is a, c, g, or t
  misc_feature (219)..(219): n is a, c, g, or t
caaggacacatgagtcaagctcaaatctgtctccctctgctggctttcaggcagtatttttattagaaaaggttaggaggtggattctgagattattgggtaattagtggaaacaaaggagaagtttggaaagtacttgagcgtgcacagttatttctncatgttacttcatgggtttcatgtgcaaatgtgaggggagttagtataaaacatgcagtnggaaattcaggctgtgacatcaacaagctccttctgcccaaacttcctgggtggccatcttgggtccaatttccag

SEQ ID NO: 535135 - DNA, 236 bp, Homo sapiens
ccatctcaaaaaaaaaagctaaatacagactgcaccccagcctgggcaatagagtgagactccatctcaaaaaaacaaaattgcgttaaatatgtttaggcctagaaagtctttattattcattcttttcccaactaaaggttccaattccttaagatctccttgatttggcttccttctgtattagtatattaaaggtaaaagagaccttagacttctccatttctgtgatgtcg

SEQ ID NO: 535136 - DNA, 131 bp, Homo sapiens
tggaggcagatagacctagattggattctcagcctgcatgttagtagctgggtaaccacgggtaagttactctctaagactgaattttctccttgcaggactgattgaagggttatattacatatttttag

SEQ ID NO: 535137 - DNA, 167 bp, Homo sapiens
taaaacaattaaccaggcttggtgttgaacagccataatcccagctactcaggggagctgagagctggagagttgcctgagctcaggagtaacgaggctgtagttagctataattggcccactgcaccccagccttggcgacagagcaagaccctgtctgtaaaaat

SEQ ID NO: 535138 - DNA, 212 bp, Homo sapiens
attacgtaaaagacaaatataacagatgccagtcagactgtgcagaaaaaggaactcttataaactgttggtgggaatgtaaattagtacattcactaaggaaagcagtaggcaggcttctcaaaaactattcatagaacgttcatataatccagcaatcctgctattggcattatccaaaaagagtatgatatgtcaaaagcacgccaccc

SEQ ID NO: 535139 - DNA, 144 bp, Homo sapiens
gagaacaccaagaaggtcatccagtatctggcgtacgtggcgtcgtctccaaagggcaggaaggagccgggtgtccccgcctccgtcagcaccgtgtcttatggtgagctggagcggcagctgcttcaggccaaccccatcctg

SEQ ID NO: 535140 - DNA, 732 bp, Homo sapiens
tcactatctttgctcttttaactcgtaacaacatagtgataatcctcctcaggttttgatttccctaataagttttaccgcgttctcctaggtaccccccctctttcgattgggttgcggtgactaaccggccctcctacggccgctccctccgtcagcgccaacggggcgcgctgccgtcggattactggtctcctccaacggcgctcaatagtaacggccgcacttggctttaccacggcgttatggagactgctaaggaggcggccggtcgcggtttcgtggttgtattaggagatgtttgtggtccccccgcgttccgcgagagcgttctcttgccatgagcggggttccctccctctttcgctcgcatacgcaataggtgtcttcaccgctacagcagcttgtaatgtacaacactcattcccatctgtgcgggaaggcgactcccgtacctcggaccctctgcctcttgctgactgtctctgtccaccgagcccctgcatggtccccgccccgcctcccgccatctcaagagattagatgcaggtaggctgtcaggtccttgggcccggagggaaggccatctgccggccaacttggggcagacacagacactctaaggatctgtgcacaggaaggcgtcctttttccttgtagctaacgttaggcctgacgtagctcccctccatcctcgtaacgctccattacctcctagcgtgacggcattcc

SEQ ID NO: 535141 - DNA, 796 bp, Homo sapiens
  misc_feature (35)..(35): n is a, c, g, or t
  misc_feature (62)..(62): n is a, c, g, or t
  misc_feature (83)..(83): n is a, c, g, or t
  misc_feature (99)..(99): n is a, c, g, or t
  misc_feature (101)..(101): n is a, c, g, or t
  misc_feature (123)..(123): n is a, c, g, or t
  misc_feature (135)..(135): n is a, c, g, or t
  misc_feature (138)..(138): n is a, c, g, or t
  misc_feature (155)..(155): n is a, c, g, or t
  misc_feature (166)..(166): n is a, c, g, or t
  misc_feature (168)..(169): n is a, c, g, or t
  misc_feature (179)..(179): n is a, c, g, or t
  misc_feature (183)..(183): n is a, c, g, or t
  misc_feature (202)..(202): n is a, c, g, or t
  misc_feature (247)..(248): n is a, c, g, or t
  misc_feature (251)..(252): n is a, c, g, or t
  misc_feature (255)..(255): n is a, c, g, or t
  misc_feature (258)..(258): n is a, c, g, or t
  misc_feature (265)..(265): n is a, c, g, or t
  misc_feature (272)..(272): n is a, c, g, or t
  misc_feature (282)..(282): n is a, c, g, or t
  misc_feature (295)..(296): n is a, c, g, or t
  misc_feature (340)..(341): n is a, c, g, or t
  misc_feature (348)..(348): n is a, c, g, or t
  misc_feature (410)..(411): n is a, c, g, or t
  misc_feature (656)..(656): n is a, c, g, or t
  misc_feature (663)..(663): n is a, c, g, or t
agcggggtggcggcagtggacggctgtgaagcgcngagccgggccctgggcagcagcggcancgcggtaggacctcgcgcagngtccgcgggctccggngncgggggcgccagtggtcgaagncctcctccccgnggnaggctgtgtgacctggngtggagtctcncnnagtcctgggngatnctgctggtaggcacggtantcgatgcatcagaagctgttgaagagcgcgcattacattctgagnntgnnggntgnttaccanttactgngccggtcctntttaccccgtggnnatcctggctgtacacctacgatgcagatccctcgggtccctcannggacaanccgtacttcagcaacggctaccgggcctacctgccgtccaggctgtgtatcaaaagtttgtnnattttatctaatgagacagtaaacatctggagtcatttgctgggtttctttctcttcttcaccctgggaatatatgacatgacatctgtgttaccttcagcaagtgcgtccagagaagatttgtaatttgttctatttgtcttttctgcttccaggtctgtatgctttgctctgtgggctatcatcttttttcctgccatcggtcagaaaaaacatgtcgaagatggatggcattagattatgcnggaattnctattggaatactgggctgctatgtctcaggagtattttacggcatttaattgtaataactactggcgtccaggtgtacttgatcacagtgcttgctatgatcctggcagtgtctttggcgcagattcatccc

SEQ ID NO: 535142 - DNA, 175 bp, Homo sapiens
gccggcccccagttacacagctagtacaacagctccagttatacagctagttacaacagctccagttacaacagctagttacaacagctccagttacaacagctgaggtccatgcatacttaatattatacttgaattcaatacgagctgttgtaactagctgttgtaactggag

SEQ ID NO: 535143 - DNA, 158 bp, Homo sapiens
gtcacaagttttggtggcattgttagctcagtgtctgtgctgagtccatttcccagagatttcctcaggtatcctgaatttttatcatgaattcctttttattcaactgtcgttttgttaaaatcagtccgttcaaccttaaagcaattgtataatta

SEQ ID NO: 535144 - DNA, 193 bp, Homo sapiens
gtctacagaatcacatacggcagagttgttcccgtaatttctcaactctcataatgtgagcacgtgctcaaaggtactgtgatccagttactgacatacaagacaaatcgagatgcagaaaatcagcctatcaaaatatatataaaaatttatcctgctccgggcacagtagatgatgcctgtaatcccaaca

SEQ ID NO: 535145 - DNA, 154 bp, Homo sapiens
caggtacgcagcttctttcttccttgctttaacagcttctacccacagtctcagtgttactacttgctaccctggccagctatgtcacatgttgttgtagttgttgttgctgctggtgctgctgctgttggtgatgttgttactgctgtgatgg

SEQ ID NO: 535146 - DNA, 384 bp, Homo sapiens
caacctcaaaagttagtatgaaaaacgctcttaatatgcccagaatattcaaaagtctcatttatcatcatatacgtgcactttcaacaggcgctaaaatatttgagggttcaaaggttgtatatgcccctttaatttgtcaacatttaggcctagagtccaaagctcttgggttctaaaaccatctgacacatttctaagatatgcattgagaagccaatccaacatagggggaccaaaatttaaaccgacaagctgtggaccatggaatcggctcacctacccataatttagcttaaaagttccccttttaacagtccgaatacttctaatcaatggttgcattgtacccatttcaccattagcttgaatagtgccagaaac

SEQ ID NO: 535147 - DNA, 556 bp, Homo sapiens
gcataagtgctgggaaggagaggtgaataaacaggcacttgtcctgcctttgtggagtttatagtctggttggatgagacagatattaaacaaaaaaaatccttactggaatgtaggggtcacagtctttgtctgttgcattcattgctgtatctctagcacccagtacagtacctgacatgtagtagatacttaataaatatttgtggaatgaatggatgaagtggagttacagagaaaaatagaaaagtacaaattgttgtcagtgttttgaaggaaaattatgatctttcccaaagttctgacttcattctaagacagggttagtatctccatacataattttacttgcttttgaaaatcaaatgagataatctatttagattgataatttatttagactggctataaactattaagtgctagcaaatatacattttaatctcattttccacctcttgtgatatagctatgtaggtgttgactttaatggatgtcaggggtaggtccctaattgcttcttgcttctatcataacagtaagtcttggattcaaa

SEQ ID NO: 535148 - DNA, 770 bp, Homo sapiens
cagcttaattgtatttcatccgattaagtgcctgagtaagttgggactcgtcaagcttaatagagttaaggtattaattgaagtgatacctctctcaattatttcgtctaagcgctgctttatacaggcgctatacctgtgtaattatatggcatccatccataggcatccctctgtccttctatcattgtcaactaaccaccaaactccgttcgttatctaagtaagatttaaccaagttttatcctataacacctggacttacgccttatcttcccccaaaagcaccaccccttttcacacgcttccaactttaccactttttcaacttcttcaacttaaccggcctgtccacacttgggcttcatacttcccttgggtttaggcccccaaggcgttcccttgggggcccttgggctttgtccccccagattaattactctgcttacgatttaaaagtttcgtggggacacaaacgggtcttaagaagcgtttgttcgaaaaagcgtttgttagaggccactaaaaaggccttttctacatttccctccacaaaaattatcgtttcccgcccaaaaagttatctttactatccccattgcgtaaaacttttccgggtatagagtatgcataagatactcccccggtatttatttacccgagtttatatgcccccgccagatattatataccgagttgggggcaacaacactaaaggccggttgagggggactgggggcgcttttaacgggcacaaacgtttgactcct

SEQ ID NO: 535149 - DNA, 243 bp, Homo sapiens
accgggggtctccaagccccttttcctggacatgccacccttgaatgggggatgtgcagggcttcaaacccccctggcaggagccctgtggcagggcaaagggaccctgctccaaattttttgttggctgcgcttttgtatccaatgcttttcaaagggtattccctcacccccaaaaataaagccctgtgctttaggggtgactgtcatatgccttatttttaataaaatttttgaaaacca

SEQ ID NO: 535150 - DNA, 924 bp, Homo sapiens
  misc_feature (266)..(266): n is a, c, g, or t
tggagacgtgagtttctcgttcttgtttgcccaggcgtggagttgcaataagtgcaatctgggctcacttgcaacctccacctcccgggtacaagttgattctccgtgtttcagcctcccaagttagctcagattacgggcttgtgtcaccagtgcccagctaatttggttggatatttagataagagacgggattttcaccacgtttagttcaggcgtggtcgcaaacttccgtgattctcagggtgatttcactttgcctcagncctcccaaagtgtgcgtgggatttacaggcatgtgggccatcgccaccgtggccagaatttacctcttttaaacaacggttgtttactcacgtggggcaattatacgactagaattcacatttaatatagtggcatttggaatttttctctctcaaagcaaattagaacctttagtacgtgccaagattgccattataattatatcctctttaacatgtgaaaatggaggcatttccacacatttcaatctgttcaacattagagaaatggggctactatgggtggttcaataccttcggtgcctatatttaaatccagttcacataacgtggcttaaacattccatttggtataatggtctcataatgcctgcaaacctaaatgttgtcacgcattatttttcacccacgttggggcaaggggtttacatagagcatgctatgttctgagaaagccccccaagtgggacaatatttctacaggacccagaagttcttaccccttgtttccacaaacttcccattggggtctatccagaccatatttgttggaataatttctagacttttatgccatttccttgcaagcaccatggtttgcacacacaagaagacgacaaaacaaacagttcggggcgtcgaccagagaaagttgaac

SEQ ID NO: 535151 - DNA, 356 bp, Homo sapiens
  misc_feature (244)..(244): n is a, c, g, or t
ttccaatatagtgttgaataggagtgggaagagtagcttccttgggttgtacctgatcttagcaagaaagcatctaacatttacggggtgaaccccgtctctactaaaaatacaaaaattagctgggtgtggggatgcacacctgtaatcccagctactcagatggctgaggcaagagaactgcttgaacccaggaggcagaggttgcagtgagccaagatcaggccattgcattccagcctgngcaacaagagcaaaactccatctaaaaaaaaagccaggcgtggtggctcacacctataatcccagcactttgggaggccgagacaaacagatcacctgaagtgaggagttcg

SEQ ID NO: 535152 - DNA, 801 bp, Homo sapiens
tggcagcaaccattaataaatgccaccacattctaccagcacaaggaaacataggcagcactgaaaaaaaaaaaaaagctcatataattaaacggacaatatggcctgggaaggctccccctgttgtggacccaattgtgccaggggccttgggttgctcgtgcaaaacacgggtgttgtgggttgggttttgtgttggcaaaatgagccaaaaaaaaaacacgggttcccccgaaccagcttgccctgtgaaaagttaggggtgtggcggcggcggcgcatgagtattatatacatttaagatccagaccctccttggcggggcattcaacctgtgcttgtgatgtcgcaattccagattccagattgtgaccctggttaaggggagttaaacaaggggcttgagttcccacccaattgtgcataagcgtgttcactttctcaaattattgcaactctggggtacgtgcagctgtgtgtcattgcaattattatattattcaccaaccccagttactcacaaaacctctcattagaaaaattatcatgtgtgggcccggggctgggggggggtccccacaactgtgggttttgcaaacactggcttgggtccacgggtccacgtacaccctcaagtcttaaaaaaccctctcaacatttcagttctgaccccaattttcctggtccattcattaataatacaggaacggcaggttattaaaagtccaaaaccctttccgaaggtcaaaattaaaatctcttcccttgggaccctttctttctaaaatttccccagcgatt

SEQ ID NO: 535153 - DNA, 91 bp, Homo sapiens
agatcactaagaaattagaaacacgtttaagtctagcctctgcgtggcagacaggtatggggagggagaatgcttttcccctcccagtaat

SEQ ID NO: 535154 - DNA, 344 bp, Homo sapiens
gtctttttaaccctaaactgtttaaggtgaagccttttccaatgtttgggggggaacatccttttaaaaaggggccctgggctttccttttggggaggcggtccttagcaggtgaatcataaggcatttttgcatatgttttattgggggtggccccccctctcccccccagcctttgccttttggggtggtggggtgctttccccctactttggtacatttttatagtttagttgggttttcttgaatgatttatgtttaggggggaaattaaaatttccccttaaatttgttttaactccccctgcaaataaaataaattaagtggccgatggtaacgggga

SEQ ID NO: 535155 - DNA, 326 bp, Homo sapiens
  misc_feature (187)..(187): n is a, c, g, or t
  misc_feature (231)..(231): n is a, c, g, or t
  misc_feature (287)..(287): n is a, c, g, or t
cactgtttgaatttggcacaaaaagtgactgtaggatcaggtgatagccccgggaatgtacatgtgtcttgagtgcaccaaggactgccgttcttaaacggactgacagtaccgtctggacctctaactggaggcatgatgagtatatgcccatagacccgagtggttgacagtgatccacttcccntgttggcgagggccgtgtaggctagacgggcgagctaggtactngctgttttcctcacgtcggaaagcaggcacattgacgtggggtgaacagggatgtnaggagtaagacggctcgtatggttagaggtggtccatct

SEQ ID NO: 535156 - DNA, 311 bp, Homo sapiens
cgtcgaccaactcgctagtggtaatcagatcaggcggaatccaccctggcatccacgacttgccaatcatccaactgatgcggtaaccgcctgagtaaccaccacaagtaaccacctcgcatgtttaccatccatcacgggatcgacgtcacagagtctcccggcgcccgccatccttgacaattgttaacagggtgacaggttggccaacctctcgcgggactaactttagctaacaggccgcgagcgtcgctactggctccaggcagatctgatgtcaacatttgtcatcatcgcacctggccgtcgac

SEQ ID NO: 535157 - DNA, 113 bp, Homo sapiens
ctcggctgactctcgaggatccctcgaaagagtgagggtggtctcctcaaagctcaatgtgtgatgctctgatgtgccgtggtggacattgcctatacagttcaatgcgttcc

SEQ ID NO: 535158 - DNA, 186 bp, Homo sapiens
acccccaccttcaccattttacagtataaaaaagcactagctccatagagaattcacgtgttgtatggtggtatcaagtgatatagggtgatataggtggtatcaggttgttatagggtggtctagggtgttatagggtggtatggagtggtattgggctgctatagagagtatagggtggtatag

SEQ ID NO: 535159 - DNA, 195 bp, Homo sapiens
  misc_feature (91)..(91): n is a, c, g, or t
  misc_feature (114)..(114): n is a, c, g, or t
  misc_feature (146)..(146): n is a, c, g, or t
tttccactttttggctattaagaataatgttgctgtgaacatttgtctatgtattttcaattctttagggtatatacctagaagtagaatngctggatcatataactctgtgtntaacaatttgaggaactacaatattctatgtnttttttcaaccattggcatatatttaaaaaaaattctctgaaaaaaaat

SEQ ID NO: 535160 - DNA, 499 bp, Homo sapiens
ttctggactaacagtttccattcttcagaagatagtccagaatgatgtagtttttgctcaatgcattgagtaatagattctctagtggatctccctagggatgggaagggggcaccttgagggagagcctggagaggagcccggggagcatgggttctatgaacttgaattgattgagttgaaggaggaatacaagtcaacgggtattgtagtgcagaatgttgtgcaagtgatcatggcatgggacattggtgtgtgtagagattttagtttaaaaagctatgataaaaacgattgatcgaaatctgtgcagtattcatatttgttcccagtatgtttcttttacagctctgtgacttaaaatagctatgaataccatacataagaataactaacatgaaacgtcgataaaacacaaaatagagaagggagacctaataaggggtggtagaccacaagttgccccccataagtgacacaaaaaaatgttacccaaata

SEQ ID NO: 535161 - DNA, 537 bp, Homo sapiens
gactagtctagatcgcgagcggcgtcatttgacctcagccccaaaaaaaaaaaaaaaaaaagaaaaaaaaaaaaaaaaaaaaaaaaagaaaaaaaaaagaaaaaaaaaaaaaaaaaaggggggcgttaatatattagttgagtggaggtgaattctaagtgacatgtttttttggaagatgtggcgaacagggactctatattatacatagagagaggcggggggccgaaagatgaaaccaaataagcgagagtaaggtgagtaatgatacttttatgagggaaatcgtgcgcggaggcaacggtattatagctggggggagcggtctactctctgaggggaattcacctcagaggaaaaggtaagaaattgcacctccgtgggggatgaattaagaaaatataagcaagcgagttttgtggggcgatgatgaaagcgtccagatttccgtcaaagtcaagactgattgcatagaaaaaatatgtatgtaccaggatagatatttttaatcacgggagttctttaaaaaagtcccct

SEQ ID NO: 535162 - DNA, 116 bp, Homo sapiens
cgcagtgattaggacttgtctgggtatcggaaagcaagcctacgttgctcactattacggtataatacctttacacattcagatgcctgaggaagtgaaccatggaagaagaggaa

SEQ ID NO: 535163 - DNA, 910 bp, Homo sapiens
atgaaatagcacactactgatccaactactgagtatgactatcaatactgaatagcttacataggtaaagataactcttaagagaccttccattatatgactccctaaatgcactaatgttaaagcccccgatcgatggcgtccatagttagcgtgtgtccgtagtatcttcgttgcgaaagctagggcggataatggatagtacggtatgtcgcgttcataactacagtccttcaacacctccactgatcacaaaaacaccactaacacataaccccattactcttgtatactcattccctagtgtagcgacttaactttgtaagcacattacttccaatacatgacacgtactgcacatacatgagaacctaaacaaatcggaacactagacatacgctctattcagactctagacccatactagatccgtcgatagatagaccagtcgatagctccatccccaaaatcccctctgtcacagctctccaccggacagaccagttctactcgcgtcgctagatccgtcccaacgagtactctgaccactcacgtgcatttacataattcctggctttaagtatactgcacaatagtcacgaaaatgccacatctacgagaatcggccatccctaaagtccgtcattttacaaggtccctttttcatcacatcgtactccccaaattacataggctctcattgattgagtttcttaggggatagactcccgtcatgacacacggccgtcccgttaacacctccgacttaattaaaacctccaattgatgaagaacactcattcgggtgggtaagttaacccgaagtttcctccatgcatcgataattaatctagtacttcctataatttaatcgtgacttcaatataaggaagtccacagtccttattct

SEQ ID NO: 535164 - DNA, 420 bp, Homo sapiens
ccaaaggacaaacaatagcctgtggacaagttatgagaggtgaagacccgcctgtgtaacagcgagaccatgtctcaattgaaaaagaaaaacaaccaccacaacaaacagagggaatccttgtgacacaccacatgccgggaatttcccaaagtgggaaaatcacaaggaagataggctatccatcaaaaaaatgacagctccagaggcccataccccttcacatggaggaaactgtccatcctcggaggataaacctactttgggtaatattgagatagccactcacccaatgacacagctttgaagaacttttcaaagtacgaagatacaacttcatctggagacaacccatgttgtggaatgggaaggggggtgttacagaaaataaataaagttatggcttcttgttggaaaaaa

SEQ ID NO: 535165 - DNA, 926 bp, Homo sapiens
  misc_feature (187)..(187): n is a, c, g, or t
  misc_feature (194)..(194): n is a, c, g, or t
  misc_feature (197)..(198): n is a, c, g, or t
  misc_feature (211)..(211): n is a, c, g, or t
  misc_feature (223)..(223): n is a, c, g, or t
  misc_feature (228)..(228): n is a, c, g, or t
  misc_feature (236)..(236): n is a, c, g, or t
  misc_feature (253)..(254): n is a, c, g, or t
  misc_feature (283)..(284): n is a, c, g, or t
  misc_feature (289)..(289): n is a, c, g, or t
  misc_feature (311)..(311): n is a, c, g, or t
  misc_feature (314)..(314): n is a, c, g, or t
  misc_feature (326)..(326): n is a, c, g, or t
  misc_feature (338)..(338): n is a, c, g, or t
  misc_feature (340)..(340): n is a, c, g, or t
  misc_feature (350)..(350): n is a, c, g, or t
  misc_feature (354)..(354): n is a, c, g, or t
  misc_feature (370)..(370): n is a, c, g, or t
  misc_feature (379)..(379): n is a, c, g, or t
  misc_feature (385)..(385): n is a, c, g, or t
  misc_feature (405)..(405): n is a, c, g, or t
  misc_feature (410)..(410): n is a, c, g, or t
  misc_feature (412)..(413): n is a, c, g, or t
  misc_feature (420)..(420): n is a, c, g, or t
  misc_feature (464)..(464): n is a, c, g, or t
  misc_feature (580)..(580): n is a, c, g, or t
  misc_feature (620)..(620): n is a, c, g, or t
  misc_feature (641)..(641): n is a, c, g, or t
actaattaaatctataggattatatgacctacttataaagtatctaaatgtgctatgtaatctaacattctttgagaactggcaatcattaattcttaaaatgtttttaaagctctatgggtatttaaaagaaatgtgtactacaattaggatttatttttaaatattaggctgggtacagtggctnacgcctntanncccagcactttgngaggccaagagncaggnggaatcanctgaagttagggagttnnagaccagcctgagccaacatggcagaaannccgtntctactaaaaatacaaaaattngcngggcatggtggngtgtgcctgtantnccagctactngggngagctgaggcagaatngcttgaacncgggangcagaggttgcagtgagccnagatngnnccactgnactccagcctgggcaacagaggtgagactccaactcaaaaaaanaaaaaaatagctttagtcactaaatataaagcttatgaagaattaatttatttttctccctttgaactaattatatctattagattatatgacctacttataaagtatctaaatgngctatgtaatctaacattctttgagaactggcaatcattntctttgtttttgctctatggnttttgcactgtgccctacacttagcattcattctacctattaggctcgctacagcggtttacgccggaaccctcagcactttgcgcgcgccccctggcggactcaccgaagccggccgttcagaccacgccgcccaccaccccgacctcccgctcttactcaactccccctaggcccgccatgacctcgctccctcccgtcccactctccctcgcctctaccacccctgtctctcccttcgccgggcctctctgttcgcgccccgctcctccctctgccctcccg

SEQ ID NO: 535166 - DNA, 1390 bp, Homo sapiens
  misc_feature (322)..(322): n is a, c, g, or t
gtgagccgagatcgtgccattccactccagcttggacaacaagagcaaaactccgtttattaaaaaaaaaaaaaaaaaaaaaaaaggcggtatgcactggtgggtgggggtgtggtttggtctagggccacaagggtggatttttccttgtgaggtgttcataatgaaacagtctccgctccatgtgagacattgttgtttgcagagcgtgtgtggaccattcttgctcccgtgccgtggggccagaggtccacgtgggatagcacattcttgtgtgcccatgcgtgataaaattgccccgtttgtcctcgtgtttgctcantctcgggggaaagaagctgttggcgggcatgactagtggcgcatgtatttctcttggcacgtattcaaaatttggtctccatatattattcggaactcctgtgtggtgacaaatagagaaactagttacaagaaccattatatgtctctcttgttatgtcatcgccgctctacttgcagcataaccctagatttgtgcgcgctccaactgtggaaatgctctccaccggttggtacacatacattggtacatctgtccataaaacttctttttcgcaattgggagagaaccgtggggcacggaattccgggggaaacgtgagaaagtgcgttcgggcgatatcaccccctcatagggtggggttcgcgtaggaaccccctctcctataatatttcgcggggaattagcgatcgcttttcatacaacaaggaaaaattgggcggatttctctcgcttgtcgaaatcttcttttaaagaccctccgttggctcataaggtttataagggcacccactttgtgcgctcctctttttaacacaactataaagagagagatataccccaggataaggcggcaacagagacaaagggcgctgtatcatttctctcccccaagtacgtctcccccctatctttgtggggggcgcctttagatctggggagaaagcacaacaggcggggtattaaataaagggttctccaagagaaagcacttttctttttaacgcctttttgtgggcgcccttcaagaggataaaaaactcccccaagagttttttgcaacacggagacacacaactacaagcgacttgatataggcggacggtccattctgaaacagtttaaacaaatgtggcgcttcatagtgggacttttttgggggaaaaagggggcactctatccaccatttattaccctcccatggaaggccgtggatgtttggacacacaccccgaactttgtgtgggcaaacacccccccttgtgggtgttaacagtgaacactcaaagggactccattgggcagtgggtttcacatataaagcatcttggttttttcccccctttc

SEQ ID NO: 535167 - DNA, 815 bp, Homo sapiens
gctttccgctcggctgttttcctgcgcaggagccgcaggccgtaggcagccatgggcccagccggaatggcatggtcttgaagccccacttccacaaggactggcagcggcgcgtgccacgtgggttcaaccagccggccggtaagatccgcagacgtaaggcccgggcaagccaaggcgcgccgatcgcccgggccccgggtcggggtcccatcggggcccatcgtgcgctgcccccagggttgcggttaccacaacggaagtggttgcgcgccgaggccgggggatttcaggccgtgagaggagaagctcaggggggtggccgggccatttcaacaagagcgtgtggcccggacacaatcgcgcgcatttttcgtggtagagaactcccaggagggagggggggaaaacaaatgtccagcggaggttccccttggagagggccaaattggttgccacggcggtgtctggaaagggaagtaaccgggtttcaccaaaatttcaatcctttctctcccccccgagagataggcccttgcggcgcccccccaaaaggaggggggacggacagaggtgtccttggtttggaagaggaccgttggaaaagtggggcgcaaccccaaggttggaacgcgggagccggggtcacaatgggccccgggtccgaggggaaaaccgtcctacatatagagaaggggagagacaacggatcccgaaggtccaatcacattgggggcggacgcgcagaaccgaattttccaaaaagggccttccgggtaaggctctcagaggtagttgggcccgggtggccaaac

SEQ ID NO: 535168 - DNA, 125 bp, Homo sapiens
ccggctacgagtttctttgccaagcggagttggtgacacttttctcagctcccaactacggtggcgagtttgacaagtgcgtggcgccatgatgagtgtggacagagaccctctatgtgctcttt

SEQ ID NO: 535169 - DNA, 540 bp, Homo sapiens
gtctcttcgcgtcgctgctccccgactgtgcgctgagtcgattttcgaagcttccttcccctctgcgtcgttctggtggtcaggcctgcgtgtgggtgtgcgccgtgcctgtctagcctcgatgtgggtcctcctcctgagtctcccagtctgcttgcactgttgggccgggctgtcgtccaccgaggccgctactgaccacctgcggggtgtgtgccaactcagacgcctgtagccgctttgcaagtgcccatgtcgccctgggaagcccagtctcccagaagcaccaggcaggtccctggccagcagcttagcaaccaaaccttggctgaaaggcagttccatggagtgggatctaggggaacacaaaccagagggaatgggggcatgactggaggactgtcgtccccgctgttgttaattaagtagtaaaagggattgagagctagctatggctggatgtgactttagcactttacattcaccttatttaattcttacaattacttatgaagtgatcgattcagagtggccccaagc

SEQ ID NO: 535170 - DNA, 650 bp, Homo sapiens
ccctccacgttgcgttaccccagcacctgcccccgccctttccacttctttgagccttgaagcttaactctcttagagtctaactcttggttccattccgcaccggtaccatagcatgaccttatttgtttaaaaagtttaataatatatgaccatgaccatatatatataatttgtctgtaagaattatgttttaaccgctgctgtagaggacccttttttaagtgaaatcttaccgtggagtatattttttaagcccccaacttggtgcccagactgggtgagaaatgtaccgtacccccctattattttgacggtgtttttttttcggggccggggaccttacctgtagagacttttcaaagattttcctccctcctgtttcaggtgggtcaccttctgatgaatgtttcccttgtaccagatccccgcttatggccttgaccccgccgtcctcaccagatgccgggtgaccctctagctctctctgcatctcccaccccccgacaccctgggaccctcgaccccacccttctttcctacccgccccgagccttgctggcttgtaccgttttgaaactcccgttctattttatgatggttgatcaatagtccgtaacctaataaaggaacgtttgtttaaatatcca

SEQ ID NO: 535171 - DNA, 868 bp, Homo sapiens
gggcttgttcgcaagcgtggtttgcctgctcagtaacacaggtgtcgtgaaaactacgcccgtaataagccaaacatgggaaacggaagaagactcatatcaacattgtcgtcattggacagcgtagattcgggctaagtcccaccacatactggcgcgtcgtgagtctataaaattgcgtgttgggcatcgaaccaaaaaaggaacccattgacaacaacatttggaggacagggaacggcctgccttgagaatgcggaaaaggggcctcccttcacaaggtattgcactggagtcttcggacattaacacctggaaaggcttgaggcgttgaaacagtggtcatcaaccattgtggatatcctcactttgctggcaacattctgaagaaccaagcaaagatacatattggtgaacctatcaattctgattgcccccagggaacaacagaagacgtttatccaaagacaccagttgatttacacggtggacacaattcctcacgggctcggacttggtgcgtggtccccggactctagtctgcttcgcatagaggtcgataggggacgaactttctcgaatgcctgggtattcattccaatagacattgtggccacgaaccccgaaggaaggcaattgcccccttttcctggagcttttacaacaacatcgggcattgatggaaaaacacaaagcttacacgtcggtccgggctggcttcaacaccaaaacactggggacatttcccaacctggaaggcacagccccgtactcaagacacaggaaagcacgactactcgcacggcaacaacttgctcatcaagggcgaagaagcttcagggcacatttaccacttctcacagcaaca

SEQ ID NO: 535172 - DNA, 832 bp, Homo sapiens
gaggtacgcatcaatatcatcacaacaattatcactataacaccccctgcataacccaatagcgaaacgcccctcttcgtctgatccgtcctcatcacagcagtcctacttctcctatctctcccagtcctagctgctggcatcactatactactaacagaccgcaacctcgaagactcgaccgttcttcgacccgcgcggaggaggagaccccattctgatagcaacacctattctgatgttttctggtcaccctgaagtctagattcttatccgaccaggcgtcggaataatctcccatatcgtaacttactactccggaaaaaagagaaccattgggatacataggtatggtcggagctatgatatcaagtggcttcctagggtaatcgtgtgagcacaccatatatgtacagtaggaatagacgtagacacacgagcatatttcacctccggtagcataatcatcgctatccccaccggcgtcaaagtattgaggtgatcgccacattccacggaagccatatgaaagtgattcttgctgcagggtcggagccctaggatcatctggcttgtccaccggaggtgtgcggactggcattgtgttagcaaacgtcatcacgtagaacctcgtactagacggaaagtacctacgttgttggctcaacttccaagtatggtcctatgaatgggaactggattgccgccaacggaggtgccatacatggtttcctattttcgggtaggctaacaataggcaaacagttcaaacaaaacggggacatacttgccacacttcggtcgagcggtcgcaccggaccagacacttggt

SEQ ID NO: 535173 - DNA, 149 bp, Homo sapiens
tcctagcggagctcctatttgcaaatttgcaaatcattctggtcctaagcaatctcaggaaaacatttctaagaaccaaagaggaaaaaaatccttttttttttttgagacagagtctggctctgtggcccaggcaagggggggatctg

SEQ ID NO: 535174 - DNA, 206 bp, Homo sapiens
gctgtgcccccgagctgctccctttcctgcacctcccaggaccgcccttccctgaattgcttgtcccgtgagcctcttagttcccgctcactcgctcgtgggaggaccttggcctgttgcatgagcagagaagatagaactggccacacttatgaccccttagctccccccctttccgccacagagagagcgtcgggtaccgagct

SEQ ID NO: 535175 - DNA, 151 bp, Homo sapiens
caactccggtatgatcaatccccaaacagttacattctttttacaaatccttgcgcctcccattagcatagtgaacaaactccggtattctcatgaacgtttagtacggttagctgctgtacagtgacacattggccatggaaggactaaa

SEQ ID NO: 535176 - DNA, 411 bp, Homo sapiens
ccattgatcccccttcatttgatgtttggaaaattccaggaattatcattttggcaacgaaaatggataccccatagctctttggtgtttcccgcttttcaaaaataaagtttttggttcccccggtgaactatttatgagtttttttggtgtgaaaaaaggggtcatgttgcatttccagccattgtttcaaagaacctttatttgttcagtatcggtagaaaatccttcccgattaaaaacttcagacttggtgaatatcctgcaaagtcaaaatgcccgatgttcagttgggtggatttgcccacgagtcagatttgaacatcagtctattggaacccaataggtgtcattgatggcggcaagccatagctttcaagttttaataaaatgcccaaaagaaaaaaaaaa

SEQ ID NO: 535177 - DNA, 698 bp, Homo sapiens
  misc_feature (361)..(361): n is a, c, g, or t
  misc_feature (440)..(440): n is a, c, g, or t
  misc_feature (508)..(508): n is a, c, g, or t
  misc_feature (510)..(511): n is a, c, g, or t
  misc_feature (515)..(515): n is a, c, g, or t
tccgtctagatagtctcactcacctcttcgtttggcggtcagcctctatccgcaatgtgcttggcctctttgagtctgcatctcctgaatctccatacttctcctcatccttcatggcccggttttctatcgccttcattcctctgcaaggagcaatctcatcaggacggccgttcactacacacccctccacccacctctcatctatctttactttcagatggagtctcgctctgtcatccaggctgaagcgcagtaggcacgatctcagctcactgcaacctccacctcccgggtacaagcgattctcctgcctcagcctcctgagtagctggaataacaggcacccgtcaccatgtcnggctaattgcgtgagacaccacccctagtcccatctctcatctaaatgagtctctgaatctactgagcactgtaacacnctgcaaagatggaactctgtgcacacatttccttcatcttggttttttttttttttttttgagatgancnnacancggctcataaacgctaactggctttggggaacggaactgttcattttaacctcaactgctgactactgatagtagaatgcgagtcaatgtccaattatctagataaatcgggaaataaattacatgaagtgtaaacacaaatgattcttacactgtaagtcaagcactgtgcagaccacgacc

SEQ ID NO: 535178 - DNA, 245 bp, Homo sapiens
gataatagcaagaaaaaaaatatcatagctgaggaataataagttatggaatagatatacacatgatccataatgatatatataactggctaaatatacagtaggagttcaaattaatgtagagagaataacagcaatagaacattctacgcagttagtcaaactgccatagtaataactgttgcaagcatatatcattacctgtctcgatgactgtgtcaatgttgtctcatgcgaacctatga

SEQ ID NO: 535179 - DNA, 300 bp, Homo sapiens
acggtgtggataaggggtgtagtgtgccttgtgttaagacgtgggctaggtcatttttaatcttagagcgaaagcctctaatctctgcgcccgttcataaggggatggccatggctgggttgatagatagttgggtgggaggagtcacatgagtgaggcaggagtccgaggaggtaaagtatgtggcaataaaaatgattaaggatactagtataagagatcaggttcgtcctttagtgttgtgtatggttatcatttgttatgaggttagtttgattagtcattgttagcgcgtgctgt

SEQ ID NO: 535180 - DNA, 779 bp, Homo sapiens
  misc_feature (65)..(65): n is a, c, g, or t
  misc_feature (160)..(160): n is a, c, g, or t
  misc_feature (392)..(392): n is a, c, g, or t
  misc_feature (557)..(557): n is a, c, g, or t
gccgatgggcctggtatggagctcgggctgagcgggtgctagagcttgttatcctagtcacgtgnccaagcgacagaacatcgctggtcctgggagcacgcgacagatggcactacactacgcggcgtcggtcctcgcggcctgtggcgtgccacctagncccttgatagcgttgtcctgcggatcacgtctccgcggtgactggactgacctttgcgcggactgacgttcgtgggaccgtctgtatgaggactcgagagggggtccaagtagttaggtctgtacgagcggtgaactgaggcagatagaacctgaccacaggtctgccacgtgactttgtcagacattgcgctgtgcgcctgctgtcagagggaccgtcgacgaaacacacnacggatacgagcgcgtcatagtcgcactcacacccctgcacggccatggggagttgggagccatctctgtggcaccaggaggcagtgtcacgcctcatgacctgcgtgtttggcagtcggagcgatgtagcagaaggccgaccctaggggcaagagtggatggcntgccaccaagtaacatccacaaagggtctcagcctgccttcgctttgccccacacttaacccgtaaggcgacgcaggctcgaacaccagttagggagaagacgccccttgtgctgactctcttctgtggggctgggcaggggaaggcgcgaaacaggacccatgctttcaatctttacggggggaccgttagattggacccaaggggttgactcaccggtcc

SEQ ID NO: 535181 - DNA, 897 bp, Homo sapiens
agctggtgttggctgggtgctgcacgcgctgctctgtctgcaccgacgctcacctcctggctccgcgttcggttcggcacctggaactggatctggctggcgctgctgcctgcgccgcctctgccgcggtcctagcgccgctcggcttcacggctccgcaagcccccgtgcattgtctgtgcagggaaccgccgtcaccacctgtgcacccgctgccgggtgtgtggtccgtgcctgtgcagccctgcacaccacctgtgatgcgctggctgctgctggactgtgtcgttccttggagaagctgcctgtgcatattggtgcctggtgatcaccgaggtgtgatgcagtgaacccagcttctcgtgacatcgcgagcctcgtggttgtggtgtatggccgtgggcatctcctacattagctgtctacgacaccaaggtattttcaaaagaaataattccagattgatggatgaaattttaaaacaacagccaagaacttctgggcctagatttgttcaaaatactcaccagaatttgcaaatagtaatgacaaagatgatcaagttttaaatttgccatttggcatggtgaagtgtgctgtctccggaagatggaaaaagcagaatatttgtaaagagcttgtcagtgacattatgccaggttaatgtagcccagaagcaaaaaggagacccacagatttggattgtagaatacgttagccagttactttagttcaaatggattgtcctgatcctgaatttaggacttgaaagttcggtccctgtggccacgcacactaagcttttcttcccctgggccatcagacttgacttgggatcgctcttggcatcccactaaaataattttaggacttatatgcctgccaagatggcggctg

SEQ ID NO: 535182 - DNA, 274 bp, Homo sapiens
ggacctgcgtagccttctccattctgaggtcaactaggagtcataatagttacgatcgggatcaaccaggcgagcctagcattcctgcgatcatctagtacccactgccttcttcaagagccagtactagtaatgtgctccgggtccatcgatcgcacaaccttaacaaggaacaagatattcgaaaaataggaggactactgaaaaccatacctctcagttcaacctccctcaccattggcagcctagcataagcgggagtacctttcctcac

SEQ ID NO: 535183 - DNA, 657 bp, Homo sapiens
tctattaacacacgaagagataagattagagctttcccccaccatcaaatgatcacaccctcaaactttctgttgtctgcactatcctatcatcaaaattagaggcaatccctgtattcccccccgcccagaattttatttattctatgatgcattttctttataaactattatggaccaccattcataaaatttccttttcaggttcactgtgcagaaaagtgacaattttctagataaaaagtctatcatatctaaagaaaattttctctagcaaaacaggtcatcacatctaaggaaatttttctctcaattgagtgatttcgcaaggacttgcaaaatttcctagttaattctatttactcatttaagaatgttatgtacatttcaatgtctatctggctaacatgcttaattctttgattcactatatgatataactgtcacctaaaaagatcctggcgaagtgataaacaatttaaaccagctagcaagtttgccaaactgttcatgagggcttagtcacctttcttaagctgtctttggcttgcttcggattgctttacagtacttagttcctgaggtacttcagccagtactctcacaaacagtatggcctgaaattgactctaatacaaagtactctcgtcccagact

SEQ ID NO: 535184 - DNA, 408 bp, Homo sapiens
ttgatagcccaatcccagactttgggaggccaaggcaggcagatcgcgtaaggccaggagtttgagaccagcctagctaccacagtgaaaccctgtctctgctaaaaggtacaaaaattagctggacatggtggcacacgcctgtaatcccagctactctggaggctgaggcatgagaatcgcttgaacctgggaggcagaggttgctgtgagccaagactgtgccactgcactccaacctgggctaacagagcaagactctatcttaagaaaaaaaaaaaagaaaagaaaaaggatcatcatacaaataggagtagggcagcaacagtggttttgtgtttggaacacttcctcatccgtctggttcgtatcgttttccttcctcctgggattgggctatcaaggtac

SEQ ID NO: 535185 - DNA, 152 bp, Homo sapiens
cgtgtagacgtgagagcccctagcttacgggacacgctctgaccgaggtcggctcgcagacggacgtaagttaagcctgcaggatagtgtagcacgacgcagaaccatgcagatcgaagattccaattacgcagctctagatatccgacttt

SEQ ID NO: 535186 - DNA, 820 bp, Homo sapiens
cccacgcgtccggccacgcgtcggactagtcctgtatgtgaggactattaattgtttatgggtctgttgatgtgtggatttgtattggtgacgatggagatctccactcgtgtgtgcccaaggcgtggagcgtgcaaatggcgcagtcttggctcactgcaatctctacctcctgagttcaagcaattctcctgcctcagcctcccaagtagctgggattacagtcactactgtcgggccagtaggaacacgggaatggctacattcctggcaggccgggacatgacgtggtggccgataggagcctccctcttcgaccagcagcgagggctctggcctcttcataggactggggggctcaggcgcggcaggaggtctggccgtggcaggcttcgagtggaatgccacgtaacgtgctgctggcactggacatgggtgttcgatgcccatctacatctcactcagagatcgtcacacttacctgagtacattcagaagcgctacgggggccagcggatccgcatgtacctgtctgtccggtccctgcatactgtctggacattcaacaagatatcgctggacctgtacgcgggggctcagatagagccacatctgcctgggatggaaactactagcctctccaacatcatcacgctcggaatcaaagcccagagcaccatcgcagctttagagcaagaacgagaggtaacgggcagtaggcggcaaacctagggccagacaatccctccagcaacatgccaaacaacagtcaagctggacagtcagaccaatgaaaagtaacaaaaccaataagggaacg

SEQ ID NO: 535187 - DNA, 260 bp, Homo sapiens
gtcgacgctaaggaaaatacacattgttgcttcatgagatgctaacatgcgcaatttttcctttggaggcatcggtgtacggccttccatacgcgtaataatcactgtttgagatacattaggtagtgtatattcttgtttcaaagccgctgctgtagcaaggaaagaacttacacctggcacgacttcataagaaatacccatgccagctagtgcatccatttgctcttgaatcgcaccgtaaatagcaggggtcgacg

SEQ ID NO: 535188 - DNA, 145 bp, Homo sapiens
tgactaaaccggttgatggtagagatggtaagacggcatttactcagccccgccctgctcagccacgggagcggacgaatactaagcgtggtggagtgcgatgaatgacgcagactggtaagagcgtgtgaggactgagcgtgca

SEQ ID NO: 535189 - DNA, 293 bp, Homo sapiens
  misc_feature (1)..(1): n is a, c, g, or t
  misc_feature (94)..(94): n is a, c, g, or t
  misc_feature (184)..(184): n is a, c, g, or t
  misc_feature (199)..(199): n is a, c, g, or t
nagatcgttcttatctataatagacatctgagcctggccatccatgaaaccaggctgtagagaggatgaggcttaagtttgggttaatgacagntgcaggtgtcgctcatcagggaaaggggtaagtgaaaatgctgtataaactgcatgatgtttgcaggcagttgtggttttcctgcccagnctagcaccaccgcgncatgcggatatgttgtccagcccaacaccacaggaccatttctgtatgtaagacaattctatccagcccgccacctttggactttacctcccgg

SEQ ID NO: 535190 - DNA, 701 bp, Homo sapiens
aagtggtatttgcattcaagttgaagcagagcataaatgttgggaaaatgtgcagcctgtcgatgtgatcgaaaagaaaaccccattttcttgggagaaattcaagtttgctgcagaaattcgcataagtaatgaggagtgaaatgttaatcaccaagacaatggggaaaatgtctccagggcatgttagagaccttcatggcagccccttccatcacagaccgagacctaagaggtaaaaatggttttgtgggctgagcccagggaccccctgctccatgcagccttgggacatggtgccctgtgtcccagctgcttcagctctagctgtggctaaaggggccaaggtacagctcaggccattgcttcagagggttcaagctttaagccttggtggcttacctgtggtgttaggcctgtgggtgcacagaagtcaagaattgaggctggagaacctctgcctagatttcggagaatgtatggaaacgctttggatggtcaggcacaaggttgcttcatgggtggaaactttatggagaaccctcactaaggcaatgtggaaaagtaatgtgccgttggattccccaaaagtcccactaggggaattgcttctggagcttgtaagaaaaggccactttccttccccccagaattatcaattcaaccaccagtttcccttgaatgcttgagcttagactttt

SEQ ID NO: 535191 - DNA, 947 bp, Homo sapiens
  misc_feature (913)..(913): n is a, c, g, or t
ggcatcccagcccgctgcatggccgcctacaaactggtgctgatcctggcactggctgagagcgacatggacacctgtgagaacctgcttcagcgtgctggtacgacgccgacctcgagccctggcgtggccacgcaggagtgcgaacgcgcggcgggcaggcgcgtacgagatgctcggctatgagtcttgacatcgtgcttccacctcagtgcagaaggagaagccgaatccgggaacccctcctgggcaacaggttggcttagaattgcccaattggcatccacacatgtgggcttggccaagtgcgtcgacggaccattgggggcccttcaagtgagccgggcacctaatcgggggatctacaccgtgtctacaactacagagcacgacaacctgcttgcacaacgccatgggtcgcagtgccgcatgtgtgcaagactctcggacggccgcatcactaatgagtgtacccgagcagacgtccgcattggagaccctgacacactcctgttctcacagcgcaacatccaggtacaggactcgccaggctatcgcagaacgctcaacagcaagcatcacgctcacccgtccctgtcgagcagtcttgacaggcatcactcattggccagagatgctcttgcccgtatcgtggacatgagagaagatagattcgccgcagaatcacagggcagggggaacactgtgttactggcattggcaggaacacaatggacacacacggccttcacgagaggaacattggtcaacggcagtcatgagaggggtactcctcttgcaagcagcgctagtcactgcgaaggttgaaccactgacaggagatggatatcgacgcgattggtcatcatgaagtcgggacagagaagactgtgaatgcactcatccaagtcancaatgcagggatcaatgaggggattgaagcaggc

SEQ ID NO: 535192 - DNA, 1702 bp, Homo sapiens
gccacgcgttctggacatcgtcttgtaaaccactgacgctcggcaactcactcggtggacgcaaccgatcgctgagttgcccagggaaggacagcgggcgatctgtggaatgctccaactaccttccttaagatcatccaactattggcaatgattatccgcagaagtgatttccattggtagggagcacgacatatgtggagcgtccaatccagcatgcagcatgatccgcatgtccgcttcgcgggaaggctgtggtgctgatgggcaagaacacacatgatgcgcatatggaccatccgagagggcaccctgtgtaaaacagaccgcagctcgtggatgaacactgctcgcctctattagtcctgtgggcgaagtgttgagcgttctgatgttcaccaatggagagactcgtcgactctgatagtcaggggacattgcttgcgtggcctacataatcggtgctcagcgtgcttgcccggtgctggcgtgcgcaaaacgcgccgcgatagtcgaaggtcacgttgtgccaagcgcgcaagatatactggtcgtctgggtcccgagaagacctcactattttccaaggctttgaggtaatcatcgactaacaatctcccagggggcggcatttgaatatcctgaatagaagttgcaaggttgatctaagaattggtgacagatgtgcggagccaagcgaaagccatgctggatgagacgtgctcaagatttccccctttttctttggggctggcctccaggcagtgttcacaaatggggcctttaaaccctgagatcctgtataccgcgggaaccccggattttcggtccggagagggtcccatgttgcccgcttctccgaaaggttccccctgcagtgagaacctcatttaaaagacaaaaaaagcaaggcgcggttgggcacccaacataagaaggacacactacggagacgtgcggcgtccacgctcgtcttttctcaacctatcacctttcctctctcttacctcttcgatcaacgatgacaaaaactgagaagaaagagagaagaacaacatcgacagaacagcggaagacaagagagacacgagaaaagacgaaaggaaacaacaagcagcagaaagaaacgagcagagagggaacgaggaaagagcagaaacagacacaaaagacccacaacagagcagggaaaccggagcagggccgagcgaaagagagacaacagcaaaaagacaccacgaagagcaaagcagcagacgaggaacgacaacgaaagggagagaagggaggagaaggaaaaaaaaaggaggaaaaacggagagaagcgcgaagcacagacgaaagaaagaggcaagagaagaagaaaggaaaagagacaagacaaacacagccaggagcaaagacaaccagaagaaaacaccaaagaagaaaaaaagaaagaaggagacaagaagacgaatagaagacagacaaacgagaggacagagaagagacagaaagaaaccagaacagaaaacacgagagaaacacatgacaacgagacaacgcaagacagaaaacagacgagacgcaagcagagaaacagacgcacagacacaggacacgacagcagaggagacgaagagaacgacacgaataaacagagacagccagaaaacagaaaaacaaagggagaagacagaccaacgagcaaacagcaaac

SEQ ID NO: 535193 - DNA, 513 bp, Homo sapiens
agggtgactgatggcttgagacacattgctctgcggctggatttcatggttactattccatcccgggacctgacgcggatcagtctcccctttcctgtggctggaggggcacactccgtccctggagagcgtctggtaggggcttgtagaggggcggggaggacttccagaggcccgaggacaggcgccaggcttggcttcggggctggggcagctgccatgtgctctcagagcactgagggaggagcgggggagcccgggggcgagaaacccacagcacagggaagggaagggcagccttgaaactgcaagttgggagatcacggtttcctcacgtggccaccatgagggctgaggctgtaggctggccgctcctgcccctcccgaccaccccctcaggcttccagcctccttgctcagccacctaggctgggctttcaggttcacaggcagccggccctacaacatggaggcccaggctgggctttcttcaggagtggcatctaaacttag

SEQ ID NO: 535194 - DNA, 5943 bp, Homo sapiens
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagacaccagaccagtagctgactgtgtccgccgagcccatccccgtgtaatgtgaaaacagcctctgaggctcccatgctgggggtgcaccacttcctctctgggcgacaccccagggtccaccgggagccagaggtgggtccagtgccaacgagagccgctccctgccacagccaagagagccctcggcgtcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcatgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcaaccggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggttttccatttggcttctcacctgggaaatacaaaaatagcccctcctgaagataaaatcgttcagaaacagagcaataattctgactcattaacttctacctactcaaaaaagtctgccatgatgatggaccgaagtgaggctttttaacccacaagtaacctttttatttttttgagacggtcttgctctgtcacccaggctggagtgcagtggcatgatcttggctcgctgcagcctcgacttcctgggctcaagtgatccacctcagcctcccatgtggctggaaccgcaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcaggcctctagtcccagcactttgggaggctgcagatggcggatcacaaggccaggagttcgagaccagcctggccaacatgatgaaaccctgtctctaccaaaaatacaaaaattagctgggtgtgatggtgggtgcctgtggtctcagctactcaggaggctgaggcaggagaattgtttgagccccagaggcggaggttgcagtgagccaagatcgtgccattgcactccagcctgggcaacagggcaagattccgtctcaaaaacaaacactattagaaaatgctctggaggtggcggggagttgttgatttgtgaggacagattgaaagcaactcccagggtggccttgtccacctccccatcgagaatatggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaataggttgatttcctgtgtaacgctgctctggggcctcttcctcatcctggcagaaggagcctggagcccatgaggcagccagcactgtgcccttgctcagtcgtgctgtcccctccctctccctcagtctcttctccatgcccaagtcagtttccagccgctggtcttcatggcattcccagcacagctggacaccaagaggcaaaacccaaggcctggcttggccgtgttaacgattgtacagacatttttttaaataactttgtgtaatacttttctagaatagtaagttcttgttgaactgtcacagatgagcttctaggaacacaccgggtgtggttacttccactgggtgtgtccatggtcgtggtctgtgcctttgtaaacaaacagaacacttgaaccaccttccgaattgggtcatcggcttctttacattgatacttagagatttgcagctctctaactttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtttttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacgggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatggagaaagaaag

SEQ ID NO: 535195 - DNA, 555 bp, Homo sapiens
  misc_feature (428)..(428): n is a, c, g, or t
  misc_feature (516)..(516): n is a, c, g, or t
tagagatggaggtcttgccacgttaccaggactggtctcaaactcatggcctcaggtgatcctcccatcttagcctcccaaagtgttgcagttacaggcaagagccaccacgcacagcccagcactctcaatttccttcaagaactttacctttgcattcacaatgtgactaagtgtttagcacaagagacctagccttcagccagtcttgcattttgacatgccttcctcactaagctcaatcatttctagcttttgatttaaagtgagacatgcgactcctccttactcttgaacactcagaggccactggagggttattattggtgtaacttggaatatttttgtgtcttaggagatgggggggccgaacagagggagagagactggaaaacagccagttggtgggagcagtcagaacacacgtnaacattatcatttaagtctgttgtcttattatgggcgcatttgtggtgccctaaaataattacattagttaacatcaaaggtcactgnttcacagatcaccataacaggtttaccattatttacaag

SEQ ID NO: 535196 - DNA, 833 bp, Homo sapiens
ggttcactgggcggcatggcggtgtgtgctcgcctttgcggcgtgggcccgttggcgcggatgtcggcgccgtcgcagcatgctgccgtgggcccgtgctgatgacgtgtggcggccgactgccgattccggagctcagagccctgaggaggatgcgcattcgaggtctatgcgccggggttcggggtgcggtcttgtgtctgcgggcccctcggccgcgaccccgtgctgatcgctgctggagctggcgctccgatgcatgctggtggagatcttcgtcgtcggcatgccggggcactggaccttactccaatgcgttggccgcagggtcgtgcaactgatagttccaggcgctaattctccactaccgtacaccaattcttggaggagtgcgtagccggtgaggatgtatgcgtatttgcggaaaacttttgcaggacacgctggagaatcacgaggcgatgtcttatggtctgtgacagctttcatgcgacagcctgcattcatcgcgagtcattgaccacaatatattgcggaattgttggccaagcctaccaatatcgggccaatcacggagggaacttgtcgtgcaacggtgtggtggttgtaacggtcgtgatgtcatccattcgttgttgagatgttagccatgggctccccagtgtatctctggacggtcagaatgcattgcctagtgcagatgccagagcactctgctctgaggagagtccacgctgattggagaggacaggctggcaccagtggcgtgccattgtacgggcaccaccaggagccccgaccattgggcagtttccagactggtgacacgaacg

SEQ ID NO: 535197 - DNA, 380 bp, Homo sapiens
agcccttcgatatgtgatgattatctcacccaccctgccagagttgtgaagagcactgtttactaaaaggggatgtctacatactcatgcgagggaagtgccgtgtttaaagccttgtgctggtgccagtaactaactcgtgcgcgtgttcgtatttgatcgattatggagctcggctaatagctcagctgtttggcgtggcctctttatgctcctgtgctagctgtggggcctctttctggtgccaatctcgaggtgtcctcctgcggttggcctctttattgagtgctaaggggggtcgtcttgagttgtccttgaggtgttcaagctcggcgttgactgtcactgttggtttcctttggcttggccattaccatggc

SEQ ID NO: 535198 - DNA, 482 bp, Homo sapiens
  misc_feature (1)..(1): n is a, c, g, or t
  misc_feature (9)..(9): n is a, c, g, or t
  misc_feature (32)..(32): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (106)..(106): n is a, c, g, or t
  misc_feature (110)..(110): n is a, c, g, or t
  misc_feature (113)..(113): n is a, c, g, or t
  misc_feature (116)..(116): n is a, c, g, or t
  misc_feature (120)..(120): n is a, c, g, or t
  misc_feature (126)..(126): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (141)..(141): n is a, c, g, or t
  misc_feature (143)..(143): n is a, c, g, or t
  misc_feature (153)..(153): n is a, c, g, or t
  misc_feature (162)..(162): n is a, c, g, or t
  misc_feature (164)..(164): n is a, c, g, or t
  misc_feature (166)..(166): n is a, c, g, or t
  misc_feature (176)..(176): n is a, c, g, or t
  misc_feature (188)..(188): n is a, c, g, or t
  misc_feature (201)..(201): n is a, c, g, or t
  misc_feature (214)..(214): n is a, c, g, or t
  misc_feature (217)..(217): n is a, c, g, or t
  misc_feature (231)..(231): n is a, c, g, or t
  misc_feature (238)..(238): n is a, c, g, or t
  misc_feature (240)..(240): n is a, c, g, or t
  misc_feature (249)..(249): n is a, c, g, or t
  misc_feature (253)..(253): n is a, c, g, or t
  misc_feature (255)..(255): n is a, c, g, or t
  misc_feature (257)..(258): n is a, c, g, or t
  misc_feature (266)..(266): n is a, c, g, or t
  misc_feature (302)..(302): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (330)..(330): n is a, c, g, or t
  misc_feature (335)..(335): n is a, c, g, or t
  misc_feature (340)..(340): n is a, c, g, or t
  misc_feature (342)..(342): n is a, c, g, or t
  misc_feature (349)..(349): n is a, c, g, or t
  misc_feature (352)..(352): n is a, c, g, or t
  misc_feature (364)..(364): n is a, c, g, or t
  misc_feature (368)..(368): n is a, c, g, or t
  misc_feature (381)..(381): n is a, c, g, or t
  misc_feature (387)..(387): n is a, c, g, or t
  misc_feature (396)..(396): n is a, c, g, or t
  misc_feature (399)..(399): n is a, c, g, or t
  misc_feature (406)..(406): n is a, c, g, or t
  misc_feature (415)..(415): n is a, c, g, or t
  misc_feature (447)..(447): n is a, c, g, or t
ncttccaanccagttttttttggggggtttcncnttttnttnaagccgcccgcgcagtttctttcccaatttcccttcccggggtcttgtggttttccgggtcccngggntcnaangggnatttcnaaatgancnaanccnancccccccccnaggggaatngngnttgggttggnttgggatgtttngcccttggtttcnggggttccccggnacngggtcccctttccntgggaancngggggggtnccgncnannccccccgnggggaatgtctttttaattggttggttccccgggcnatttttttccccccntngnaaatttggnggggnacccngnccccgcnggnggggggtgccgncccnccccggtttcccngggggnttttgccanccnggggtcngcgggtgtnggcttttgggcccccaaataagggccgtcccngggggggggggggaaatgggggagggccggccgtc

SEQ ID NO: 535199 - DNA, 1651 bp, Homo sapiens
  misc_feature (1602)..(1602): n is a, c, g, or t
cagaaattcttttatcaccatcatggtttcgtagccatgtttaaatttttgtcttttcgtgttcgctctatacaggaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaaggtaaattttttttatttaaaatgcaattcatacagttcttgttcatgcatgtcagtaccagttaaaaattacactccccttgttgttaaaagtgccttttgttataaaaaagttaaatatctggctagtgatcttcagagatcttaatctagaaccctgtgagctaaaggtaaggtggttatatatctagttttcccagagcagtagcagtttacacctcaagtgattttttttctttttttacctcaagtgatttttaaagtatctttttactctgagaagtccccattttatgctcanggtgtcagcaaattcctcaaaattgtgtgcaaaattttgtatgtttaca

SEQ ID NO: 535200 - DNA, 472 bp, Homo sapiens
cctaagagctctaacaaccatagttgtgcccgtgtcttacaactagaggcagtcaccagcttattccacgaggatgctgagaaatgtgtacgggcacttttttggttgtcatatttactacgggcttctgttggcatttaagcctaaagacactcacccctggttgtgcattggaaaacccctcccgatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaacaagttacatgtcgat

SEQ ID NO: 535201 - DNA, 232 bp, Homo sapiens
tagagggaaagcctggtttttttacacagtttaatcacaacgggagcactcatggctccccatacgcttccccccccgggttgaaggtggctcccatccttactcgcctagatcacggggcccgtcggaccatcccacatcccgcgtaaatcttgtgtgtcgtctagacgcaaagccatcaccccatccaactacgcgaggcacaaaagtggcccgaaattaaagaccagct

SEQ ID NO: 535202 - DNA, 729 bp, Homo sapiens
  misc_feature (489)..(489): n is a, c, g, or t
  misc_feature (530)..(530): n is a, c, g, or t
  misc_feature (532)..(533): n is a, c, g, or t
  misc_feature (538)..(538): n is a, c, g, or t
  misc_feature (563)..(563): n is a, c, g, or t
  misc_feature (574)..(574): n is a, c, g, or t
  misc_feature (609)..(609): n is a, c, g, or t
agcggagttggaggcaggcgctcgctgaggcaaaaggaggcgctcggcccgcggctgaacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatgggaaaacctcacatcgtccactttccagtatgaggtcaccgaggtgaaaggtctctttctttggggatgcagtcctgttccagccagagcctgttncgtagaaatcccagatggcttattacgctgatgggagcaangnnggatngttagcactgctagagtttgctgangagaagatganagtgaactatgtcttcatctgcttcaggaagggcngagaagaaagagctccactcctgaagacttcagcttcttgggctttgagattgtacgtccaggccatccctgtgtccctctcggcagatgtgatgttcatgggtatcccctggaccagac

SEQ ID NO: 535203 - DNA, 250 bp, Homo sapiens
  misc_feature (141)..(141): n is a, c, g, or t
  misc_feature (197)..(197): n is a, c, g, or t
  misc_feature (238)..(238): n is a, c, g, or t
ggacgctctcagctctcggagaacggcccagcttcctacaaaatgtctactgtacacgaaatcctgtgcaagctcagcttggggggtgatcactctacacccccaagtgtatatgggtctgacagagcctatactatctgngatgctgagcgggatgctgtgaacattgacacagacatcaagaccaagggtgtggntgaggtcaccattgacaacattgtgcacaccccgagcaatncacagagacagg

SEQ ID NO: 535204 - DNA, 312 bp, Homo sapiens
taagttccctccccttgccctccacaccccaaaagtccatggtatgtgtgattcaccactttgtgtccatatgttttcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttaaaaaaaaaaa

SEQ ID NO: 535205 - DNA, 334 bp, Homo sapiens
tttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatttctatattccaattatttttaggtatttatggccacccgtattattgcaatgctttgttctgccactcaatggtacagactttattattaaaggaacttgaaaagtcctaagtcattgtaaatgtatgtttgtttttccactgggcttaaa

SEQ ID NO: 535206 - DNA, 837 bp, Homo sapiens
  misc_feature (284)..(284): n is a, c, g, or t
  misc_feature (597)..(597): n is a, c, g, or t
  misc_feature (638)..(638): n is a, c, g, or t
  misc_feature (640)..(641): n is a, c, g, or t
  misc_feature (646)..(646): n is a, c, g, or t
  misc_feature (671)..(671): n is a, c, g, or t
  misc_feature (682)..(682): n is a, c, g, or t
  misc_feature (717)..(717): n is a, c, g, or t
agcggagttggaggcaggcgctcgctgaggcaaaaggaggcgctcggcccgcggctgaacagggacttagcccgcagagatcgaccccgcgcgcgtgaccccacacccacccactcatccatctatccactccctgcgccgcctcctcccaccctgagcagagccgccgaggatgataaacacccaggaaagggaatgaactaaatctcagtctaaggaaacattaaattggattcaaaaaaaattgagcagatctaaagccctgttgggtccatccgaaaaanaaggtggccaatacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatgggaaaacctcacatcgtccactttccagtatgaggtcaccgaggtgaaaggtctctttctttggggatgcagtcctgttccagccagagcctgttncgtagaaatcccagatggcttattacgctgatgggagcaangnnggatngttagcactgctagagtttgctgangagaagatganagtgaactatgtcttcatctgcttcaggaagggcngagaagaaagagctccactcctgaagacttcagcttcttgggctttgagattgtacgtccaggccatccctgtgtccctctcggcagatgtgatgttcatgggtatcccctggaccagac

SEQ ID NO: 535207 - DNA, 645 bp, Homo sapiens
ggctaagtgcgtcagttgtggaggtggcggtagacgagttaagtcctggtctgcgtggaggtcgacgactccggtcgcagactacggacctgtctgggtctcagcctgggcaatagaccccgtccggaagtactagccggacatcatgagtggctgtcgggtatccatcgggagagctaaatccagcggccagggagaaggacggtgggaaagattcttcaagggatatggacggataagagatatggagtgctgaaaagaggtcgtcgtggctgggacttggaatgtggaggagtccaagggactggcggaatgatgctggggttactgattgtgatggaggaagaggggctgtagtgattgggttactattgaaggagtgttagggcctcggttcacgatgctggaaggagtgtagaggaggatagcaacgggaactggtcctcggggtcgctaggcacctcgggaactgacgcgccattcataacagcggccgacctggtgcaggaactagagggcagccgtgtgcctccgtatgaagaacgtggcatcccctacggggagcacaagctggcacaggagcacaaacggatccaaagagattacagccggggaagcgagagggaccgtggaccggaatcgcgc

SEQ ID NO: 535208 - DNA, 160 bp, Homo sapiens
cacgctcatcgtcatctcgcacgaccgcgacttcctggacggctgtggtctacgtcatctgtccacatcgacgatgcgcaagctcaagcgctattcgggcaactactcgtcgttcgagcgccagcgcgccgcccagctggagctggcgcagggcatgatg

SEQ ID NO: 535209 - DNA, 345 bp, Homo sapiens
tcgagacaggttcttgctgtgtcgcccaggctgaagtgcagtggtgagattatggctcactgcagcctcaacctcccagggtcaggtggtcctcagcctcccaagtagctgggaccaaaggctcgtgtcactatgcctggctaattatttttgtagagaggaggtcttgccttgttgcctaggctggtctcaaactcctgtgttcaaggatcctcccgcctcttgcctcccagctttcagggaggggagaggtgggaagataagctttgagcccagggagtttcgagaccttgcctggggcaattattagttgagattccctttttccacaaaaaaaggggagaa

SEQ ID NO: 535210 - DNA, 295 bp, Homo sapiens
tgaagaggcgctttaggctgctctaggcctcgtccatcataggtagcttttgctgggatataactacccatgctaaccctcctgtccactcagcggatcctagaaccagatgatttcctggatgacctcgatgatgaagagtatgaagacgatactctcaagcgtcggggacaggggaaattcaagggtaggggtgtgggcagtgtccgtaagaagctggcttgcttccatcctggaggaccgggataagccctatgcctgtgacagtgagtgcctcacaagtggggtgggtaga

SEQ ID NO: 535211 - DNA, 390 bp, Homo sapiens
  misc_feature (55)..(55): n is a, c, g, or t
  misc_feature (99)..(99): n is a, c, g, or t
  misc_feature (103)..(103): n is a, c, g, or t
ttacgcagctgacttgcctaaatcttacctgccgaagctgatcacaatacgcacngacttcccctccggcttccgtgcctgcgtcctctccggcttccngtcngctgcggtctcacaggcacaagggtcccctacctccgtgtctccggcacccagcggacaggaccagcggcagtgaccagctggtgactccatcagaaccttgcatgtgatcagtcacctggctgggtcctcacggtgctgccgcccactttacagatgagccacctggctggcacggcgcctcttccttggccaggattctctaaacctccctgttccatgaggctgattccttccttcttctcttccctccttcgttcattcatgggaaagtcagtgcgtatgggg

SEQ ID NO: 535212 - DNA, 445 bp, Homo sapiens
  misc_feature (48)..(48): n is a, c, g, or t
  misc_feature (51)..(51): n is a, c, g, or t
  misc_feature (156)..(156): n is a, c, g, or t
  misc_feature (187)..(187): n is a, c, g, or t
  misc_feature (354)..(354): n is a, c, g, or t
cccccgcgctgtacgaattctgcacgaggatatagggaggggagaccnccncgctgattgtcgcaagcgccccctcaaggcccccgtccaccctctacgccagacattccgagggtctcgcggtcgccgcccattggcgccgaggtccccgacgtnaccgcgacccccgcgaggctgcttttcttcncgcccacccgccgcgcggtgccccttgaggagatagaagcccccgccgcttacgccattatgtttcccgaagaggaacttgaccggtaccaacccgaacctctttggaagcggccgcctgtcctccccctgtttgagttggtcggggaatattgtaataacaccagnaccgaccgtttactataccttgtcccccttttccccatattgaagaggtttcccaattttttcagagccccccattttttttgtacctttt

SEQ ID NO: 535213 - DNA, 112 bp, Homo sapiens
ttctagatcgcgagcggcgccctttttatttttgttgctaactgctaaaaccattctcttccacctggtttacactgtaacattgggaaaaggaataaatgtcgtcccttat

SEQ ID NO: 535214 - DNA, 1203 bp, Homo sapiens
  misc_feature (959)..(959): n is a, c, g, or t
gaagcttctagacgatccggttgtgcgcaggcccgagtcaggtaagtgaacatggtcgatatgctggtatccgtaggagatcctggttcatgacgtacgtgcttggattctcaagctggttaaacacatggcccgggcgggaagcggacgcgtgctgagcgtaactcgagatgcgagtacgtgatggtcgctggactgggaatgtgctattgcaagcagggagatccaaaggcgaggtcgtcgagtggtcaaaaggttaacgtcgccacgcggccctttgcaaactttcctaaggaaacgtggtgacgaaatacgcatggcaaatggatctcgcgagtcgtacataaggaaagcttattccccagagatgagggacgtctgcttgtgcatacgctggggaccttccaccatttagcttgaagtttggcgccgcgataacttttgactctctgaatgcatattctcccctttactacaaatcttaactcgaccgaggtctgcaatgtgaagcatgtttccacaatggttaagcgtcctttgggactggggccttcccttgccgcatttgatcaatcgtggcggttcgcccagcttaggtaaaggtggcctttatcaactcgagaacattgggtcgcaatgatatacatctaacgctcatggacaatggggagtgtatgaccacccgttaggtgagattgcaaatgtgtacgtaagttatacttgtgtaccgtttgtacggtttgggttcttttctctaagtgatgagagcaatataagtgattgtagtgagtgtgccattgtgagacaggctggggaaagtggtgtgaaacacacagaatggtgtaaggcatactatatgaggttatattaaggatggcatggatactctagggcggttcagttcaatttatgtgtgggggtttaacgatgtttacacttcgttgactttgcggaccatntaattgttgtttgtgggcaaataccctgttaatataattcttggtgctacaaaaggagctatttagtgatagtggtgagggtaaattacagaaaaaaagtcgcgaaaattatgacggtgagaggaccaaagagattcaggtgtggttgagcccactttttttgagaggtcttgagtgaaagaagagcatgtgtatattaacgccacagaatattatgaaaaggcttatagggagtgggctaaag

SEQ ID NO: 535215 - DNA, 340 bp, Homo sapiens
  misc_feature (335)..(335): n is a, c, g, or t
gccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgaggaacctgaaggaggaaccaatgggaaagcgggaaggagaaggcaacctgagtgcccagcgttgcccagctgccctgttgggcagaaggcctgtgtctgtggccacacctgccacggtgggcaggtggggntaccc

SEQ ID NO: 535216 - DNA, 169 bp, Homo sapiens
  misc_feature (141)..(141): n is a, c, g, or t
tggttctaagtggtgagagagaaaatctggttactgtgttgatggagtcaggtctaggttaattttagttcaagggatgcctttggggaatttaggtggacttgaagcagaagaaaacagttaatggatttaggcttctgnctgctgagtctttgggttctttccagag

SEQ ID NO: 535217 - DNA, 240 bp, Homo sapiens
gttgggtcgacgggatttgttccgggtgagccgcttgctggcctgtgcaggttgtgtgtgtgatctgtatgggagtacatggctgggggttctttaacgcctatttacagtgtttctggcttgtaatgcctgcactttgtgattacaggcatgagccaccgtgcctgtccctcctttattttatttatttatttttgttggagacagaatctcactgtcacccagtgcttcagagtcctc

SEQ ID NO: 535218 - DNA, 260 bp, Homo sapiens
cttagcaaatcaagaattcctccatgaatccccagaatggcatgaatgtcgatcctgcttcgacaggctgtgtcttcctacagacgccggcggacgcttcacagtcacacacgctgatctctaaaggtggtcacttggactttattctggttatccatgagcttgacattgattttgtagtcacccacctctaaggccatcatttggcttcaaaagtgatatatgtcttgggcttgcgtcgttgtactgaaatggtccaa

SEQ ID NO: 535219 - DNA, 682 bp, Homo sapiens
ccccgtacaagcaactgaaaaccttctggagaggattcatcattctagatgccattaaggacatttgtgattcatgggagaaggtcaaaatatcaacattaacaggagttcagaagacattgacctcaaccctgatggatgatcttgaggggttcaagacttcagtggacgaagtaactgcagatgtggtggaaatagcaagataactagacttagaagtggaacctgcatatgtgactgaattgctgctatctcatgataaaacgtgaacaaatgaggagttgcttctaatataagagccacaaaagtggtttcttgagatggaaactactcctggtgaagatcctgtgaccattgttgaaatgacaacaaaggacttagaatattacataaacttagttgataaaacagcagcagagtttgagaggattgacttcaatttggtagaatgttccactgtgggtaaaaggctatccaacagcaacacatgctacagataaatctttcggaaaggaagagtcagttgatgtcgcagccttccttgtggtctcatttaaagaaatctctagagacacactaaacttcagaaaccaccacaccgatcattcagcagccatcaacagtgaggccagactgtcttccagcaacaacgactcctgaaagactagattatcgtagcatc

SEQ ID NO: 535220 - DNA, 704 bp, Homo sapiens
ttattaagagaggttgattattcattgcagctcagctaaagtacacagcttgcttacacagagagatgatatggtctatggacagttgtgttactaccaactaaaagcagtcattgcagacgaaaacaatagatggcctgctacagacaatatactaaccggataatgatataggagaagtagggataaagggggggcacatggctttatacagagctgatgagctaatgtttcgtccgtcttagagaaggctacggtaacaaaatgacagctgctctgaaatcagccggctgctcatgtattcctagagcgatacgtggtgacatttgatgtcttccagcttatatgcaagaattaaataaatgccgtacagatgttgatgataactaacttctataatgagagtttgacgccggcctgattgctaaagttcgggggatccgctaatcttggagcgttccctcctcggctggcacttccttattgtgtggacagcaaggtggctaagtttggagcccggctttttaattggacctaccctggtgcgaggggataattcggcaaaacgattaaaaattgcctcccggaacaaacgcaacttaagctttttaaacgaagagacttgttgtttgccgaatggatgcaccaaaacaaaatttaacttgagtttgggctatagttggcctgggtttcatttaaaaaag

SEQ ID NO: 535221 - DNA, 203 bp, Homo sapiens
ctgaactgtggtcatccatgctccctcggggctgccagtggcggctgatgttccacggcggtggcgatcagcacctatgaagttgggatatgtttttgtgatagctcctggtctctcttgcagtggaaattctcttggctcccctggtctctgcttctggaatgtggccggctggggttgcggccctagaagaggtctcagcg

SEQ ID NO: 535222 - DNA, 244 bp, Homo sapiens
  misc_feature (74)..(74): n is a, c, g, or t
  misc_feature (89)..(89): n is a, c, g, or t
  misc_feature (104)..(104): n is a, c, g, or t
  misc_feature (165)..(165): n is a, c, g, or t
  misc_feature (175)..(175): n is a, c, g, or t
  misc_feature (199)..(199): n is a, c, g, or t
  misc_feature (203)..(203): n is a, c, g, or t
  misc_feature (207)..(207): n is a, c, g, or t
  misc_feature (212)..(212): n is a, c, g, or t
  misc_feature (214)..(214): n is a, c, g, or t
  misc_feature (234)..(234): n is a, c, g, or t
cgagctggactcaagcgatcctcccatctcagccgtctgcatagctggaactacaggtgcacatcactgtgccnggctatttcgttaanttttttgtagagacnggatcttactatgttgcctaggctgggctcaaactcctgagcttcagcgatcctaccaccncagcctcccnaagtgctgggattacaagtgtganccgncatncccancngggactaacatttaataaanattaaatgct

SEQ ID NO: 535223 - DNA, 779 bp, Homo sapiens
gcaagctttgaacctccttccacagccgcatcttctcatgacacaaagcttttgataagtactttcctgtgggtcgctcagcgcctcatagcatctcattcaattgcaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatgtggaagggcagacagcaagttccctgtgaggacaccattcacaccagtgtgttccgtgttagccttaagtgtgttcttgggaaaaacccaaaagactccaaacccctttcaggtggcattgcaggacaaggtctccgcaaaaagggcattctctgtgttgcacagattagaacagccgaaaagcttggccagaaccctctcctgtgttattgccttctgtgccctttgttccgtggtgggtttagagggggtctctgcaccaggaggccaccttacgagccaggcacagttgaggcttgccaatgtttcccctttgagacacccgagcttgccttcttccccgagcttcgtgttcccctgtgtgtagttcaacctgtgccggtgtgggccggaggaatccttcttccctgtgggaattaagcagctccccgagcccccggtttactcaggaaaacaaccggcgccaaggccaaattgggaaactgtgccaaccccaa

SEQ ID NO: 535224 - DNA, 308 bp, Homo sapiens
ttttttttggaaaaaaattgctgtggcagtaattgcatgtggtacgataatagctcactgcagcctgtgaacctcccaggttcaaacgatcctcccattgtagccttctgagtagctggaactacaggcacacaccaccacgcctgactgattttaatatttttggtaaagatgaggttccaccatgttgcccagaggggtcttgaactccggggttcagatgatcctccctattagccttccaaagcacggggactacagatggtgagctactatgccgggccccgtgagctctttcttttaaccaa

SEQ ID NO: 535225 - DNA, 288 bp, Homo sapiens
ccaaaacaaaaaggggctttttattgaaaacaacttctttaaaacatttgcggggcaaatatcccatcataaattttattctgaattacaataaagggctgaatgataattccctgaattttttttagtccttttcacttattttaagtaaaaaaagccctttttggggcattaccaaatctgggattgaccgagtgtgagacacagagaaagaaaaagacaacgggaaagaaagagggggagaaagaagggaagaaggagaaaagaaaacgctcccttccagtaagg

SEQ ID NO: 535226 - DNA, 461 bp, Homo sapiens
agcgatatatcagacataatatgttctgaggctgcagcaacatggaagtcacataatgtgactgagttagccctcgttactctggctccagggcataacttgtgttctaaatcagccctgccactcactccctgcctgacctcaggcaaccactctaggcctccctctcctcataagtaaaacaggatggtgatcttcacttcaggagctcactgacaggactcagcagggctctgtgcatgccaggcagcaagagcacaaggaacggcagctctcttcctaatacaactagagaataaaggtggagcccaaggcggtggtcccaattccactggcagccttcaaggaaaaaggctgtgattttacttcagctacaccttccaaccttcccaggttccaacaatagtatcatctaaagataaaaagtactgaagcccaatacttacccttgtggttaaaaa

SEQ ID NO: 535227 - DNA, 523 bp, Homo sapiens
tacttttcacaggcactagcgtcatgttaaagactgggtatttaggtaaagaggatctggggctcgtggtgtatcttcactgatgttccatgcactgtattaaagcatagtgccctgaacatggagacccccaaatcctctatgtgccaaagattaagttgtagagaattacatcaatgtttgctgttggtgtgcaccacagatgagaccaagcttcctggtccggctaagtggaatcttccatgcactgtgcaccactcagctagaaagtcaactaagcagaaaggagataaggaatggctatggaatacctgacttctttatcttggttatgtgtccacaattttcataaaaataaataatacacattaagtcaaaatctgggctcaaatgtgtaacaagaaaacaaaaggacaacaatctggtattccggttttttttttttttttgggaaattcggctccaggtttgggccttggtcccctccactggcacaatctcaccatcattctgggagggctcc

SEQ ID NO: 535228 - DNA, 349 bp, Homo sapiens
cggtggctggccgggcacgaggtgctcctcacatcccagatggcgtgtcagctgggcagtaggcgctcctcacttcccagatggggtggccgggcagaggtgcttcccatttcccagatggggcagccaggtagaggcgctccccacttcccagacgatgggcggccaggcagaggcgctccccacttcccagacggggtggccgggcagaggcgttcctcacttcccagatagggtggctgggcagaggcgctccccacttcccagacggggcagccaggcagaggggctccccacttcccagatgatgggtggccggccattcaacgcctccgcggaggcgttgaat

SEQ ID NO: 535229 - DNA, 163 bp, Homo sapiens
tcaacctccaaatcacacggagttcaagaatatctcaaatatcgaccaggtgcggtgtctcacacctgtaatgccagcactttgggaggccgaggcgggtagatcacctgaggtcaggagttcgagaccaggctggccaacttggtgaaactctgtctctact

SEQ ID NO: 535230 - DNA, 467 bp, Homo sapiens
ctgatcagtgcttatgttatgattgtctgcataactatacctaaagtagatagccttgcagagactgtgaaatgtaaaataaagatggtatgctgcctgtcagctattcatcattaggaaagttttaacttattttactccatactagaaactgtaggagactatagaaccgagttagtttctaggacagtctgtgccactgcactgttgtgtatacaagaataggtgtacgaagcagagaacaattgtggtcattgatgatggaatagatgaattgcaggctttgaagtctgcagaattcaagaaagagagctgctaatgcatttttgtatcattattctagtactcacatgctttacactctaaagaaacattggggaataggggaaatgaaaggaagccagaagacggagtaccaaaacatgcaatatacttattcatcgtaaactgtctggagtatgacatga

SEQ ID NO: 535231 - DNA, 237 bp, Homo sapiens
ttcgtgcgggtgatctagaggatcccgacgctctctcggttggggggcaaggtcggcatttttaccggtattatcccattggatgctcaccacagttcggtgaaataggttacattattatccctatttttaaagtacacaatggttttaccggttctgaaaggttcttaaatttggtaggatttttttcctccccacagagagagcgtcccccacagagagagcgtcgggtaccga

SEQ ID NO: 535232 - DNA, 428 bp, Homo sapiens
aattcggcacgagggtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgcggacgccgtggtcttccaccaccgcgagctgcagacccggcggtcccacctgcccctggcccagcggccg

SEQ ID NO: 535233 - DNA, 889 bp, Homo sapiens
gctgttacaagcccagtgaccaatcagtggtcgccctgtcgcccccatgagcgtgccccgataagcgcatcggggtgggggtcatcgatggccagatctatgccgtcgggggttcgcacggtgcatccaccacaacagtgtggagaggtatgagccagagcgggatgagtgggacttggtgtggcccaatgctgacactaaggatcggggtgggcgtggctgtcctcaatcgtctgctttatgccgtggggggcttgacgggatcaaaccgccttatattcagacctgacgatgttagctacccacgagaggaacgcagtggcgaatgatcacaagcagagtgatacaccatccgaagcggggacaggaggctatgagtggtcacacgttcctggacgagtgtggagtgttacgaaccagtatacagacacctggagcgaggtgagccgaatgacatcgggccggagatggggtgggcgtggtgtcaccctgtggagccctgtacggtagagcatgattgagacacgtcagaactgtaccctgttgagggcatcttggtttcttgggcaatgatacagtccaaatgggggagtatcattgtgtggtacaagaaccggggctaagacagaatacgacgaggactgggagaataactcgcatctctccgtgagaagggaggcgaggatgtcctcagtgttagaattggccatctcacgaaagaagtgccgtaggcgggaatcatgtggccctcagcggagcccccggggggtgtccaaggaatgcctggctggacgggggggggggacaaggcgggttccagggagacgggccgcactttggccgggtaaagccgggcccttcaccatgcaggggcggccgggacatcggg

SEQ ID NO: 535234 - DNA, 584 bp, Homo sapiens
taaaaggctacctaggaaatacttcagtgaattctaagaaggaaggaaggaaggaaggaaggaaagaagggagggaaacagggagaaagggaaaaagatgaaaatgagaaagatgaaaataggaacaaataaagacaaacaacattaagggccatattgtaagatttccatgttaatgatctaatataatcactcagtgcaacattgagaatttttttttaatggcttaaaaatggaaactgaaagcaagtcatggggaatgaatactttgggcagaatcttcctgatgacttcttagctaagaggaggaaaaaaaggctgaaaaaatagggaggaaattttctttattaaaacgacttcaagtggataacaatatttataagaaatgaatggaaggaaatatgatccttcctgaaactaaatttgtatgttaaggttggaactaattgaatgtttttgcagaggaagtattttaaaaaaatttactttaaatcccaaggcctgattaaaaattttataggtttatcagaaaaagctttaaaatttaaaattggatccacaattttggaaagacaaaaaaatat

SEQ ID NO: 535235 - DNA, 518 bp, Homo sapiens
tggaatttgggaaaaaaccttttaattaggagtttcttaccaagttatgatttaatatttatcagatgtgtaaatatacatgatagcaattttaaaactgtgtaaatagtgggccttacaaaattacaacacactgtaaataaatccttcccacattttatacaaactacatggattttggatatacaaagattctggtttttatttacactggacaatggtcacaacaaagactatttacaatggcaaaaagttatataacccacaatttaccagtctggctacgggcagccactatagtttaggaggtagctttaattaaccgaacatgaacagaagccacatttcccaactgtggtgtctctaaaaataatttactttaagataaaaattcattatagtgcacagtatgtccagtttaattattaaccgtgcaactctagcgggattttttagtatattcagaataactaactagtggcaggggggttggcatactggattatagcacacggttc

SEQ ID NO: 535236 - DNA, 263 bp, Homo sapiens
tcatcagtcattgcaggcatcctcttcaacaatacaggcggtcatggtctaatacgcctcacactcattctcaacccccgtgactaaccacttagcctagcccttccttgtactatgcctatgaggcataattataccaagctcctagtctgcctacgacaaccagacctacaatcgctcattgcatactcttcaagtcagccacatagccactcgtagatcacacgagcattctcatcgcaaaccccctgaaggagaactct

SEQ ID NO: 535237 - DNA, 260 bp, Homo sapiens
acttagggatgagcacgcttgctttcatttccagttcgcactcttcgtgtcctcctgcgaccgatcagctggcgatggcccttcctatccaatccacagcaggtttgctaaaatgtcatcattctccagagtgtacatgacctttcttgatcatcctgttgaaaattgcaacagccgggcacagtggctcatgcctgtaatcccagcactttggaaggccgaggtgggtggatcacctgagatcagtccgttcgcatgtt

SEQ ID NO: 535238 - DNA, 105 bp, Homo sapiens
tgtactctctggattgctccaaccatctcccattgatgaccacccgccttcatacactctcacgttgggggacaaaaaaggggggaaggagggggcacgaatggc

SEQ ID NO: 535239 - DNA, 798 bp, Homo sapiens
gtcggtgctcctacgccttcatgctgccggtctcaacacccccaaactccatgccttctctactggacacttgctggtcaaagacatggtgcggacgggcctgctgatgaacctgatgggtgtcctgctgctcagcctggccatgaacacctgggcacagaccatcttccagctgggcaccttcccagactgggccaacacccatgctgctaacgccaccgcgactgcctccagccttgagcaacaacacagttcaaaccttctgagccctgctggggactttgttttaggctgggccttcttctccagaaggctgttgctgtcacttgctgctaggagcctccaagctgatcaagcaattctttcctgtaatctgataggaggcagcaagcaaggacatcctccagtggtttcctggagccaccgggtcactgtctgcaagcacctgtctctttctttctcatgcatttcaaagccagctatctcctgcactagctgtctgtggcctgtagaacaagcttgattcaccaagctggtctctggccaggtgcaaggacaagtcccacttcagccaccaggagcaaggctgaaatggcatggttttcacacctggggtcaggggtatcgatagtcacggctgcattggcttaaggtctctggaccagagacaggagagggctggactccaaagctctaggcaagaagtcacagtgttcgcagcagggtcgattctgcctctcttttaagcatctcctggtagaggatcgggcagaaagataagtcaatgcctgaggagag

SEQ ID NO: 535240 - DNA, 577 bp, Homo sapiens
catcacactcaatgccatgttttcttcgcctatgtctgcaatctgaaatcatgctgtgtctgtctacccagagcgccctgagcaacatggaaaatacgagatctattgttattagaaaatagtaaatagcaattgactttgcaaagaaaatccagtgagaaggattagattcatcttccaaggtgtctcatagctggttaccccattgtcattctcgggggatatccagtctcttgagtggctgggactccattacccactttccttcttacgtaggtccaaggccattcccaccaaagctggctaaaaaagccgacaccccactcccgagtctgagggttcatgaagatgtggacttttttttttgagacaagagcctcaccctgtcgcccaggctggcacaatcttggctcgctgcaacctctgcctcctaggttcaagagattctcctgcctcagcctcccacgtagctgagatcacaggtgcccaccaccacacctggcttattttttttatttttttatttttgtaggacgggttttactatgttgtcataaagaaggaaataaggtccgcc

SEQ ID NO: 535241 - DNA, 112 bp, Homo sapiens
tctgaggatccctacatgatgggctttaaaataaattggtacaataatttcctcattttttcagtgctattttatccaattttggctttatattggtgggtcagaacataag

SEQ ID NO: 535242 - DNA, 114 bp, Homo sapiens
cggagcttagaggctgcagtgcaaggcaagaagtatcagcacaggagaaagacgaaaggtggaagactcagcaaactagctcatcccaccttcttccacctgctttatacgagt

SEQ ID NO: 535243 - DNA, 431 bp, Homo sapiens
cccttccctaccctctccgaccaaatcttgagccattctatttaatctttcatttgagtatgggtctagccatgctgagtgcattgtcttttccctagcaggatcattgcatttgtcagcctcttactcccgtgggtcgagcaactcctccccagcctcccaagtaactaggacctctggtgtaaactgggctttccagccatttatatggtacaagtgtacagcctccaaagctactgggtttttccccccgtaaaatctcacagggggtattctcctggccctattaatagcatattcctccattcccttgggatgtgtttgtactttataatggaaaacctaatgtttttatttccccgaaactatggtagaattttttttttgccctcaaggggtaatgtataaagcttcctatcctcggggtaata

SEQ ID NO: 535244 - DNA, 238 bp, Homo sapiens
  misc_feature (67)..(67): n is a, c, g, or t
ggatggatagcacacaggtggtgcttcaaaaaggcaaccagatggcctcacttgcctcctggggggnacgagtcgctgcgctctggaagcgcagatctgttttacagtcctgagcaatttctcgcaccagacgctggaagggacgtttgcgaatcagaagttcagtggacttctgataacgtctaatttcacggagcgccacagtaccaggcctggaacgataaggtttcttcacccc

SEQ ID NO: 535245 - DNA, 211 bp, Homo sapiens
tgaccatagaggatccctaagctcccaacaagaaggtctgcattgaatctgagcacagcatgtacactctgcttgcaacctgaagaaaacaggaagactgtttcctaccttgtgcttgagtagcaggggctggtccccacagcccacagtatggacaacaggggcaggatgttgatcctccccgctgcttccagacagacctggggactag

SEQ ID NO: 535246 - DNA, 297 bp, Homo sapiens
ggggcagtatctctcacccagtctggagtgcaacagcgtggtctccgctcactgcaacctccacctcccagattcaaatgattctcgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctagcagccgcata

SEQ ID NO: 535247 - DNA, 404 bp, Homo sapiens
cgccagaacggaacattggcctttgatggttaggatgtaagcccaatcgatttaagtatttccggttgtctcaaagggtagcgattcggtgggcaatccctgatcagttcaaacctgtaggtctaaactctatgtcacgggagctccacagcttatcactctccctccaaccaacactccacaagcaccatttccatcttccatagcatctcccacagccctctcactctccattcaaacaagcatgccccattacctctaatccccataccatgtctactgctgtgattcatcctctggatcttctccagtggccggtgtctccacaggcaccagtgctatgattgatggctgcacggaatacccttactggcccaaaccaaactcgtgccgaatcctgcagc

SEQ ID NO: 535248 - DNA, 324 bp, Homo sapiens
tttttttttccccttttttggccttggggcccattttttttccatgccccccttttcaggcagctttatttttgcagagcccaagccgggcctgtttaaatttccataaaaaacccttaaaggaaagtttgtgggatccctaggggctaaaaactggggacccattttttccatcttccccccaggtggggtttttggattcttgagaagaaaaaatattatggattttgattccttaaaaatgggaaatgttttaaatatatggatataaaggggttgctggattggggccaaaatgggtatttaaaatattaaaaaagttga

SEQ ID NO: 535249 - DNA, 115 bp, Homo sapiens
gggtgatctagaggatccctccatttaaaaataaggtacttagcatatctggtacttacagcccagtgattgttaggttatattttcatcaccatggtaaccagtgtggagagag

SEQ ID NO: 535250 - DNA, 580 bp, Homo sapiens
cctggctctgaacttaggaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagattctttatctccagaccagaagctcacctattaaacgttcgctgtcgacagcccaatgtaaatgactgctacctcatgaatcagctgcgagcactgccagatggagagagatctacacacagtctatagcacaggcgtcactccattgatcagagggcggacggtctggtgtcttgaggtcgtcagtgtagactgactggcatggggactacatcaggggatcggactagccgtcccttgatgcggcctctcatcgagcttcatactacgaatcatctatggagcttgcgaatacgctgcattctcagtattgccctacatatcaggaccagtcggcaacctattgtcagaatccgtaaggctttgcgatcaattcgaagtccagaactgaact

SEQ ID NO: 535251 - DNA, 110 bp, Homo sapiens
ctttttttccccctaaaacttttagtttcagctcagtgatcagctcccccagctcggcgggggagcggaaggcttgaatttttccgccctgtgagcggcccctggcccca

SEQ ID NO: 535252 - DNA, 204 bp, Homo sapiens
ttttttttttcccctgggggaaatcacccccgggggaaaaaaaaaagttttttaattttttttgttttaacccgggaagttttttattaggggggcctttcctttttagacggttggggggggtgatgataaaaaatttggggcccatttttaaaaatgaagggtttggttttacatgggaggattaaagctttcccttagcca

SEQ ID NO: 535253 - DNA, 165 bp, Homo sapiens
ctcctcaatcctagcttcatcaaacactgattcctggaatcctttcttcttctttcttcctagattcacttaatccacttctttttagcaccttggtcagctttcaattaattctatgtcctcagattttaaaaaataatctgtaactcaaagtccaattcaaaa

SEQ ID NO: 535254 - DNA, 128 bp, Homo sapiens
caagattctgcgacactcaagctcgaagtacgctgcagatacgccggagggaaaatcatcctcgacgtgtactcaacacggacagccgggtcgagaccacggctgcgggaatcgggatcaacaccaag

SEQ ID NO: 535255 - DNA, 125 bp, Homo sapiens
ttaaagccaatgagcatacgtggacgctgtgtgtgctgtggtaccccgacaacaaccacagccgtcacagtgtcctcctgacgtttggggcaccctgcgctcagctaccaaaatgtgccccgact

SEQ ID NO: 535256 - DNA, 820 bp, Homo sapiens
ggccctttggggtgcagcggctgtggtcttgggcgtagtgtgtgttccttggggcgttctctaggggtttcttccggtgggaggccccgcctctattgttgttccccgtttggtggtctggcggttgtacattctggtgggcgtatttgttgtgccgcgcggggtcgcgcacgtttgtctgcgggtgtttcccccccccggcggggctaaggttcttgttttgcgtgagcctccggccccgcacttcctccggggttgccccaatatgtgtacggtgacttcttgcgtcgcacttgctttgaggccctagggttcagtctgttcttgttgctcccgtatggtggcctgtctcggccttgtagttgccgagctcctcactagacattcgtactacacgatacgtactacgtgtgtaggtcacttccgcctattgtcctgatccattggggctgtatttgccctcattggaggcctcattccctgatttcccctatttctccgggttctccctaggcccaacctgtcgcccagatccctgttcgactgatcatatgtgatcggcgtagatgctgactttcgtccgcgccacactttttcggcctatccggatgccccgacgttactcggggctatccccgatgcataccccccctggacatcctatcatctgtagggtcattcatttttctgacagccgtaatataaattttcagaattagaaccttgttgaaaggaaaagtcctaatatagaaaaaccctccataaacctggaagaaaaaaaggaagcccccaaccaaaaaacaatagaaaaaaacccaca

SEQ ID NO: 535257 - DNA, 302 bp, Homo sapiens
atatgtgttgttgctggtgtgtgtgtcatgctacacgtttatcccctgagcgcagagtgactgatgccacatccgaattgagttggctgtgctgagtgacgatgttgcccaattcctggaccacaatagtgtccttctaatacctaaaatggctgggcacccctccagcacacggggactagagattgtcgatgtcgcggccacgagtttgcccaccgatgcgggccccttcctgaagattggtcacgcattcccggtctttgtagtcatagaagttacacttggcgcgtacgggccatcag

SEQ ID NO: 535258 - DNA, 355 bp, Homo sapiens
tggccagagagtcagacaagaggaatcttgataggataacatgaaaaataaccacaatgtccatgcatatgtggcacactccctgtgtggttaatttaattgaaccatgaaagacaggatgaccttggaccaaggccaaacttgtcctccaatgactcacttaattgagtgggcatgtgatgtcccatgtggaaatgatgaaccatgccaatgcttgaaacaatgacaagaatttgaatgaatgaagattgtatgccaccacatgcctgtgtacctcaacccaaatggatgatgaatgaatgccaatatgcctgatggaaactatgtggtggtgattggctgacacttgtgttcc

SEQ ID NO: 535259 - DNA, 1322 bp, Homo sapiens
gatctcctactcctcattgttcccatttgctaatcgcaatggcattccgtaagtgcttaccagaacgacaaattctaggctatattacaagcatacgtccttcggcgctcaacgttgtacgcccctatcgggcgtactacaacccttcagtgctggacgaccattagaaactcttcacctaaatagagcccctaaagacccgacgacatcttaccatcacccgtgcttacatgcatccggtcctgactcgttaactgctcaccgatcgtgtcttctattatgaacccccctccccatactcgcgaagcccgctggtcgaatcgtcagacgctaggcgctcctatttattgctatgcacaccttcttagtctagccgtcgactcaaatccgtctggtcagggttgagcagtcataaggtcaaatctacgccctgatcggctgcagttgcaagatgcacaatagggaccgcatagatacatatctcaggtacctcagaagtccaccggcgtagggcgcactctagttactgaaggtagtgcacaccagttaactacaggtaacgttcgagcctcccttttatacactcttccaagctcgttgagtcataaaagtagcatacgaatcacccttttcttgaatttgacctcccgtagaccctagtcgatgtacaccctttggctcgagtaacatatggaatgtgtgatctgctcacccacatgagacaaggaagaagtcgaaatccgatagacacaccctttgcggaacgcatttaggcccgaaagagtgtgaggtgccagacacgtaggtctctacggtcttccgaaccgattcgaagagtctcggcccggcaagagcccaccgtttccggccctcttaatgttccttctagtaggcaccggaatcttaccaagaaaagagggaattcacttcatggattaaataaatcttccgcatgtacaacctcgaagtaaacaaattcctttcccttaaaggaacacacaaggatttgattggaacggccaccattctttcctcccttttgaaattcgtctaaccatcttataacaataagttttctgttcaccccataagaaggcccttacctttcttaaagccgttcccccatcttacatttatttgaactttacacaaaacacagggaatacactcccccgaattttcccgcttcattgaaaccccagatctatcattaagctccttcctttaatataatataaaaatctttccacttagaccaggttcaacacaccttaaaaattttcaccgttcatttgttagacatcactcgcttctccccaata

SEQ ID NO: 535260 - DNA, 156 bp, Homo sapiens
ctcgtaactaacactgacacgaacaacgaagtagctgcacgatccactactgtcctctcaatcaggagctgtataagccatcataggaggcttcatacactgataacccctattctcaggctaacaccctagaccaaacctacgccaaaatccatt

SEQ ID NO: 535261 - DNA, 137 bp, Homo sapiens
gcccccccctttgggggcccaagtcccttccaaaaggccctggtcattgggaattgggtaaacccctttggggataaggtgggggggctaaaaaaaaaatttatattgtaagattaaactgacttttttggccttta

SEQ ID NO: 535262 - DNA, 167 bp, Homo sapiens
  misc_feature (3)..(3): n is a, c, g, or t
  misc_feature (14)..(14): n is a, c, g, or t
  misc_feature (42)..(42): n is a, c, g, or t
  misc_feature (68)..(68): n is a, c, g, or t
  misc_feature (110)..(110): n is a, c, g, or t
  misc_feature (113)..(113): n is a, c, g, or t
tantattattctanttttagataagtcagaagtgcagcaaantgtaacccatattggtatacacaaanctggtaaggtaattcggaaaaggacagagggaaaattaccanacntcaggagaattaactctgggggaaacagggagtgtcaagaggggacacacagag

SEQ ID NO: 535263 - DNA, 892 bp, Homo sapiens
gacgttctccaggtgaccggggcggaatcgctatctccacacttctcatctagttgtcacgaagaacagccttggtatctggtcaggtgaatgacaaccaattggaagaagatctgtgtggttacaccaggagtatgggaaaaggttgctaactggccaagggacaaatacactgtcgacctgttggatgctgggaaatagccagtagcgcccacctgttagatagggaaagctgtaaattgatgtcctgtgaataccctggttaacaagctgttggctctggagcagagggaacctcctttgactgtcccgaagggaacatggacagatcaggtcacactgcatggaatacaatgggctcgttccatgcagcctgtcatcctcatgtccaagtagagctgttgaacaatatggaaagccacgttcacagatgagtgaagggcaggacaccgagagatagcctagcaacgtggggtgtgtaccagccccatccgaagtacggcagtctggacactgggcaactgcctccaggtaaagggactcctcttgattgctgcatcatgtagagaagcactgaggcttgtgaggacggtaccaggtggatccagatgacggcctctggcgtgtgaaatccaaattccaagtgtgccccaggcacttaatctctagtatagagtggacatcctgtgggtggtttgcagttcaggctgccatagtgagcgccaagaagggccccctaatgtcttaatgctggagtcagcggttccctcaagtggcgctgccctgtgcggcatccctcaagggtggaaccgggaccaacgaaataccaggatgcttgagtccctctgatagtggccgggacgtctgaatcctgcattcggttggccaatgt

SEQ ID NO: 535264 - DNA, 405 bp, Homo sapiens
tcgtgtcgtgatcggcattccctcactgttcaccctgcagtcttctccctcactgttctcctcatcctagaggagggtctctcactcagactcactcactcactcacagactcacttatatcccactctcaatctcactcactcagactcactcacgatctcattcactcacagactcacgatctcactcacgatctcactgactcactcacgatctcattcgctcactcacagactcaggatctcacgatctcagtcacgatttcactcatgatctcactcacaatctcacgatctcactgactcatgatctgacaatctcacgatctcagactcatgatctcacgatctcacaatctcactcacgatctatctcacagacttatgatctcactatctcactga

SEQ ID NO: 535265 - DNA, 404 bp, Homo sapiens
ccaaggggggccacaaaacattctcctttttttctgaaggttttacgatgcattgttatcatgagccagtcttttactactaaacttaaatggccaattgaaacatacagttctgagaccgttcttccaccactgattaagagtggggtggcaggtattagggataatattcatttagccttctgagctttctgggcagacttggggaccttgccagctccagcagccttcttgtccactgctttgatgacacccaccgcatctgtttgtctcatatcacgaacagtaaagcgacccaaaggtggatagtctgagaagctctcaacacacatggtcttgccaggaaccatattaacatggttagcttcaccagacttcatgattttaggccatctttcagcttt

SEQ ID NO: 535266 - DNA, 329 bp, Homo sapiens
  misc_feature (10)..(10): n is a, c, g, or t
  misc_feature (58)..(58): n is a, c, g, or t
  misc_feature (220)..(220): n is a, c, g, or t
  misc_feature (226)..(226): n is a, c, g, or t
  misc_feature (231)..(231): n is a, c, g, or t
  misc_feature (236)..(236): n is a, c, g, or t
  misc_feature (305)..(305): n is a, c, g, or t
cagctggaanccccggaggggacttcccaggtccataggtaggtaagagaaaaatggntgcattcttttgagtttcctgatgagcctctccaaatgaggcaatcagatatgcatttatctcagtgagcagagtggtgactttgaatagaatggaaggcaagtttgccctaagcagttcccagcttaactcgtccctttagcttagtgattttggggcccnaagatntattntcctntcacaatactataaaacatgttaatgcacctctattagttaggtccttttgattgcaagcaacaacctnccccaattcaatatagcttatgaa

SEQ ID NO: 535267 - DNA, 877 bp, Homo sapiens
caaggtacagctcgggccgtggctgcagagggtgcaagcctcaagccttggaagcttctatgtggaattcaacctgtgggtgcacagaagtcaagaactgaggcttgggaacctctgcctagatttcagaggatgtatggaaacgcctggatatccaggaagtttgctgcagggacagggccctcatggagaacctctgctgggacagtgtggaaaggaaatgtggagttggagtccccacacagagtcccaactggggcaccacctagtggagctgtgagaagagggccactgtcctccagaccccagaatggtagatccaccgacagcttgcacatgtgcctggaaaattggcagacactcaacaccagcccatgaaagcagccagaagggagggtgtaccctgcaaagccacaggggctgagctgcccaagaccatgggaacccacttcttgcatcagcgtgacccggatgcgagacatggagtcaaaggagatcatttggagatttaagacttaactgccctgctggatttctgatttgtatgtggaccagagcgcctttgttttggccaatttctcccatttggaatggctgtatttacccgatacctgtacccccattgtatctgggaagtaactaacttgctttttgatcttacaagctcctaggcgaaaggaatgtgccttgtctcagatgagacttttggactgtggacttttgagttaatgctgaaatgagttaagactttgggagactgttgggaaggcatgactggttttgaaacgtgagaacatgagatttgggaggggccagaggcgggatgatatgggttggtgtgtcccaccgaaatctcatttgaattgtaactccctaa

SEQ ID NO: 535268 - DNA, 371 bp, Homo sapiens
tgctgcttctccctcggccttctgagtgtgacaatagcaagagtctgtctcagatacgcaaaataataaagataaatgtacagatcctgccctccttccctgccaggcctgggacatttctatgggcagggaagagagggaaggaagggcaagaatcccaagagtcacttgttcattgaaagcaagagaagacctcaatcagcccgtggtgcaagacagttctgcataggacggggtgtaactgggctgtcgcagcatcaccacacctggagacctctgggggccagagtgggatgggacacacgctttagggggaaccacttccctttggcaagcgaaaaggcaagcatagcagatgggctgaggggacg

SEQ ID NO: 535269 - DNA, 114 bp, Homo sapiens
gctgcacagaaggttgggcatcaaccaggcagtccgcctgaaaagaagcttttccttgttaattgggttgtgtggacagagtgagagaacctataaaccacaggttgctgaaag

SEQ ID NO: 535270 - DNA, 250 bp, Homo sapiens
  misc_feature (23)..(23): n is a, c, g, or t
  misc_feature (25)..(25): n is a, c, g, or t
  misc_feature (38)..(38): n is a, c, g, or t
  misc_feature (69)..(69): n is a, c, g, or t
  misc_feature (78)..(79): n is a, c, g, or t
  misc_feature (122)..(122): n is a, c, g, or t
  misc_feature (143)..(143): n is a, c, g, or t
  misc_feature (188)..(188): n is a, c, g, or t
taaaacattagtatgctacagtntnatatggcactatngatgggagtcttacacaactagtactttttntttaaagtnngtggctgagttccagaaaactaaaattgtccttatttggtcantattacaattgggttatattngattggttcagcacaaggaagactcaggtttctcaaaaataatanagcagaggagtgaaaatttctggagttggccaggtgacatgagaggggccacatggcgaaag

SEQ ID NO: 535271 - DNA, 1216 bp, Homo sapiens
ggtctgctatgctttcggttcgactgtcaacatgacgcacgtgatgcgctgaggtccagtggagacgtgacaattagaggttcccaagatgggtttggcatggcccttcgtaggcagctacattactcgagcatgggactgagacaacgaggagcagtggacacagcaatgagttcaaacaaagagcaccgtaggatccgcagaagtaagggccggacacatgcccgggcgacgccagcagtcaggccacgaagcacgccagggatccgagagtgccagtcacagcgagcaagtcgcagctgctgcggccataggtttcgcgtgcctattacagaaaggtagcgcagctgaactgtgggtatttagttccttgtaagtggagcctcagtgagctgtgccgtgttcatgcgttccaccaacaagaggtacggtgacctactcaggatcatgacttgatggattccttgtagtggaagcaggaaatcgatgtgtccagcggtagtactacggtactaagtccgaagcggttgacgaaagtctcatgtaagggtagcttgcccgtatcgcgaaatctcaagtcctttcgtttgccccacggtaaagctccttctgggtcccctcggaataagtgcgaataacagattgctttgccttggataggaacctgtcattctcgtgtgaccaacccagggtgtatccgtgtaccgggatctatgaccccggtacctggaaacggtcctaatacagaaaggggacgaaaaggcctcggaaatcagtccactgaacgacagcaggaagcaattttcaaaagggcgtaaccgcgtaggtcttccgtaatgtgccgtggccaagcggcaccgagcgtctttccggcgcgataccgggcacacacagagcccaaggaaagggcgcaccaaccagggatgatgaacgccaagaaaattaaagccctcctgggagacttgaagtcacaacgtgaaaacaaagaggccgaggagagtgtgagaaatgaggggcgaagagatgacagcccgcacccggaggaagagcacccccaatacaacaacacagatacaaaacaatttaacacaaaccccagatgtcatcataaccaacttccagccgaactacaaaacaaacctacataacactcacctctaagacagaacgacacacaatagcaggcaacacaaacactacagcaaaatataacacc

SEQ ID NO: 535272 - DNA, 333 bp, Homo sapiens
gaagcgcttgttgggatagttaagaaacgctgcctattggatggagggagaggcttagtgcatgaagccctattactttgcaatggggcccttcagaagtctgctgggctcagcaaggctcttagtcagtgcttgagagtgagccatttcgacagagatactcgcccagacccaagcctccgggccaaccagacctgtggaggttggtcaggtggtcacccatcttcttgataagcttcacttcctcatataggaagtgagtctccaggaagtcacagagatgggggtccgtgcgggcagaacccaggacatgaagatccaacaagcgcctgg

SEQ ID NO: 535273 - DNA, 524 bp, Homo sapiens
cccttttgtgcctgtgtccccccgcaatcattgggtccaaccatgctgccgcgaagcgctttccatcgctttacccatcgacgagcctccccaactgggtgaagttacatctgccacctgaaaggccgatttaccaccgccacgaaggccttactccttcaccgatcgcggtatatcctgaagagattcaccacgggggttgcacacagtaccgtttgtgacaggccataaaattgtaacaagttcttaatctaagggacttgctcctgatcttcctgaagatctctccccattcattcagaacccacttgctgttcgaagcatctttaaaggcaccacaaggataaggatgctaattccctctgattcttatagagagcgcggattccaccccttgggtccgatattattagacccagcggagtctctccccctccccattggaaatatgaatctatttaccacgcctctgccccggtcccaaaaaatttctgggaccccacccaaaaaatggttttttacca

SEQ ID NO: 535274 - DNA, 136 bp, Homo sapiens
caccggggatagggcacaggttgtctggaattctgtcaggtcaacattcaggctccatcaaatctcaggtaagcagtgatggaggacacaagtctggctaataaggcggttaaggttagtgtatggtgaggctttg

SEQ ID NO: 535275 - DNA, 158 bp, Homo sapiens
cgcatgtagggctgagtctcaggctcaggcacgtaattcacacaatctggtgagataaaggcagacctttgcatatgcagttttcatcaatgtatcttctccagctatgtccacctgctcaattttccataagcaggtcgcaagcctcatgctctgca

SEQ ID NO: 535276 - DNA, 352 bp, Homo sapiens
  misc_feature (94)..(94): n is a, c, g, or t
  misc_feature (97)..(97): n is a, c, g, or t
  misc_feature (174)..(174): n is a, c, g, or t
ttggtttgggagcctcctcccctccccccagggggcaggggtaggttccccccccttggcctaaaaaaaggtccttaaggggggggttcaatanttntacccccccagcccggggtggccttccccccttggggaattttcccagggccccctttttggccttttttaaaaccncaggtacctggccccccccctttggaagggggctgggtttccccagtttccccatcagggggttcctggcccccctgtccaaacccccccccaagtttccgggcaacgggatcagggtccccctgggggttccacataggggtttttttccaaaaaaataaagtgaatttagggtgga

SEQ ID NO: 535277 - DNA, 1935 bp, Homo sapiens
  misc_feature (71)..(71): n is a, c, g, or t
  misc_feature (76)..(76): n is a, c, g, or t
  misc_feature (204)..(204): n is a, c, g, or t
  misc_feature (209)..(209): n is a, c, g, or t
  misc_feature (225)..(225): n is a, c, g, or t
  misc_feature (235)..(235): n is a, c, g, or t
  misc_feature (239)..(239): n is a, c, g, or t
  misc_feature (271)..(271): n is a, c, g, or t
  misc_feature (280)..(280): n is a, c, g, or t
  misc_feature (282)..(282): n is a, c, g, or t
  misc_feature (359)..(359): n is a, c, g, or t
  misc_feature (573)..(573): n is a, c, g, or t
  misc_feature (769)..(769): n is a, c, g, or t
  misc_feature (936)..(936): n is a, c, g, or t
tctctgtgtcgtgtccgtgtttcctgtgtcgacatgcgtgcgcacacgaaggggtttcccattgccttttnaggcnaagaggcgtatgcccaataggtcggtgactaaccttctccagagccgatagtaatgtcgctagtgagtcgaatggctaagtgctgtatgaagtgccgccgtggtagcgctgccgagatatgcctgatntgggncagcagtaacttggcntgccgagatnccgngtttaagaagtcgtgtataagcgcgggtcctngacgtgttntntgttagaggcgccggtttatagttgcgccgctgtcgcgcgcctgattgagataggttttgcccaagtgggtcgcccngtctttgatataagacggtggtgcccaaatatggatgcgcctcgccgtcgtgccgtccaaggaagctgggggcacaaaatggtaaaggccttttggtacactagcgcgtgtggggctccctgggtgtgttatgtcgccgctgttgtttgaaggccatgataagagccgctaagaggggtcgaaggaatgaaagcgcctgttttaaacgaagcgncttttctgtgggcaacactgggctgataatgcccagaagatttttgctgttggcggtcacaccgaacagtgaaagtgccgctgcccgcccctgatattttgtgtacgctgtgggagcgggcccggagtgcagggtcggctttctcgcttcgttgacgattactgtctggggtaacacgcaacggcgcggccaaacncccgtgtcgtggcataaacactacgactggcaaaaaacgggcgtcgggcgcagactataagcccccctttttgtgggccgcctgacaatgtgtgctccccggtgggtctccccaacatatactgagtcgtcgagcgacgacaacacgtttttcgcatctatcttgcnctgttacacgctgaaccgggctgttcgcagtaccgtttacctaatcagggcctgcggtcctggtcgcgatacactagacatagctgatctaacgcgtaaactggcgggcccgcgtttttatagacgacgacacgtgcagcaaggccgctgctgtattatgcagtgactgatgtgcctcctcccccccctgttcttggtggaggctggccgctatcttacagtcacccgtactacactgcgatgctactaactaccgccgggacgagacacaaaacgcggggcgatttttggggggcaggggacaagaacggcttttttatacagtcgcccgtgcggacgaaacacagcctgcgcgctaacaaactcaagatagtcgtaaagtcgctttttttttcccccgacaaaatcgatgcccgtggcgctctcttttctgggcggcggagacaatcagccacgtactgacacaaaccggtggggcgcctcccgagagtacaaatcgctcggggtgcaaaaaatacacgcgtttttttgcgcccgtattaattaatatagaccccgcgcgccgccacaaatgcgtgcgtacatatacagagacaatcgctctttttcccccccgcgtttattgggggggggccctctttataaaggacgagagacacgttatttatcctgctagcgggcggggcagcaacagctgcatcagtgcgcaaaagccaaccacaagccgcttttttggggcggagcctatctatatacgaattcgagggaggtacctggcgcacaaacacacctgggggtgacgtgtcgttcactacgcactaccacgcgcggcaccgactcagacatgccacgacagcgagctgtttttcgacgtcagtcgcattaccccgatgattaatagttataaaagaagcgccccgtcgaaacgagtttttttttcacgtccagctacgtatggagagcgacggggcagccacaacacccgttgttttcccccga

SEQ ID NO: 535278 - DNA, 1023 bp, Homo sapiens
  misc_feature (1023)..(1023): n is a, c, g, or t
ggcgagcctatggcattgatcttcggctccgtgtacgtcagctgcctatatgtggcacatagaaccacctagccaatgccatcctgattctctgtgtagcatactgtcggaaacgctagggtctcccgtggtggcgtgtatgcttgctcatttacgttcatccaatatcgtgcaattgcattggtgttacacttacttgagcgtacactgcaacatgcaggtcacccgaggtgctacaggaagactaggcatgatacgcagcggcgtggtcatgcgcgattacgagtaacgggcttgtcgcagggaccatacaggataggtgcgcctatcgtatcgcgcgtagcgcaactcagttggaccgctagacgttgccgtggagaatatcgcatagtgcaaccagagcggcctgtagcatttgaacgcttcagagcgccattggagcaggaatacgcgatgaatgcccttggacgaagcaccgacctagtgtttgggcttgcgtggtgaccacccgaacggtcaaggctggtgagtgtgatgccactccagttagaagtggccccagggtagaggcacttggacggtgcacacattggctttgagccatgacctagggtgatccgtaggtggcacctacatagggggaaacccaagcggttacggagccggaacgaggcctttgaaaacgtaataggccgtgccaatcgattgccacatggcggttaaccaagaggagccataagatactgaggctaggagtcccctttcaggtcccgggaggtccaattggaattttgagagcttgaatggcggtgcacctttggggcaacgattcgctaagcctatgtcagaaaggctatcgaaaattccaatcctaaaaggacgttcaatttagcctagccgtgtagaatccaaccgttgaaaaggttacccccaaatccctgaagaatgactcagcttttggtttggcccggttccaccggaaacgttaaagcaagttgggaacgcggaatggaggaccccttn

SEQ ID NO: 535279 - DNA, 1201 bp, Homo sapiens
catcaccaattcgtgctggtggctgccctgcaaggcctgcaggcatggatgaacattcttggcaccctgtgctggatgtggatctgctgtccatgtgctgtgagcttgccccatgtgcctgatgtgaatgtgagtgcctgctattgcactgtgtgctacaaacgacgttccagcccacctgctgtacaccttgcgaccattgccagtgatgacacctgtggacagtgccacctggttgaggacttataaggaatctacacaatgggtacaatttgttgtgttgtgtgtgtgatccattgtactgagttgtgggtgacactggaaccatttgccccgtcaaatactagaactcaccggtgttacagatgccaaaaagtggagcaaacgcatatcatggcacgtacagcggaaactatcagcaagatgtgacaccaacccccagtatgtgcggccagttgaggaacttgtacacgactgcaattgcggcacacgtgggaagtttcattgcacagcggtttggccttggcggtggccaagtattccccccatttaccatggctctaatggacaccgcagcatataatggcggaggcaactaaacccagggaccttgatgagaccactgtggaacagcacatgatggaattccacaagacatttgtgccacttatgggccgagacttcaagaaccccccgttaacgccggatcaacgctcaaggcacaagggagggcaaggtgacagtgaccgaagaagggtgacaccacagaattaccaaatgattcacaagatatctgggtgacattaccattatacacgagaaaacccacgcataggacaacgacacgtggtgaaagtatgggacttggtgggcacccaacacatctcacatttacatagtggtcgaggaatacaaaccgaacgattaagaccgcacaaaagatggggcacacaaatggactgttgtagggcccattagggatgggcacccagtggaaagcctttggggccacccccccaatttgggaaacacacatgtgggtggcaaagcgtcacagcaagtttggtgaaagcccccaccccatttagtatcccacaaacggcatctgggcagatatggacgccagttatttacacgagatacaggatttactacccgcacacgattcattgtggagcctaataagaggtggagttttctc

SEQ ID NO: 535280 - DNA, 299 bp, Homo sapiens
ttttggcccgggggcttttttttttaaaaaaaaaccaaccctggggaaaatccccccgggaatttaaaaaaacttaaaaaacccttttagggcttttgggggggggatttttatgggggggcccgcggccccccggcccctttttggaaaatttaattttttaaggggtttttaggggggttaatttttgggggcccagggaaaggagggttttaaaaattaattagggatttttggggggaaaaccccccaagggtttttattagggcgggggtttaattaaagggttttaacccgga

SEQ ID NO: 535281 - DNA, 260 bp, Homo sapiens
cgttaggtgagctagaggatcccattgcacgaccaaggagctaaaatcacttgaaccaggaggcgaagtttgcagtatgctgatatctgcgccattgtactccagcctgtgtacagagcaatactcttgtctcaaaaaaaaaaaaatttcaattcagggggaggtgaataagacattccggtttcctttttattcggaattacacctagatttaagctcctttgtacgttgccaattgggttcccggagctcaaattcgg

SEQ ID NO: 535282 - DNA, 144 bp, Homo sapiens
agtgacatacatgagtggtggctgcagtaatgttagcggttaggcgtacggccagtgtctatggttgaatgagtaggctgatggtttcgataataactaggctggatggagtgcagggatgtgatcacagctcatgtcatacat

SEQ ID NO: 535283 - DNA, 281 bp, Homo sapiens
ggcccgagtttagtcaatgtcctggccatctcagtgaatcttcacatgggcatctgccctcctggtgttgtgtggtgtggccctcaaggagctccgctgcctcctggagcctgtatatttgggatgctgctgctcctgttttgccacacatgatcaccctgtggaatcctcatctccactcagctgggcccagctgtgagcgaaggcttgctgggatctgtctgtagtagaacaacctatccataaatgtactgtgcaccaactccctgagtgacgacctg

SEQ ID NO: 535284 - DNA, 1011 bp, Homo sapiens
gctgccgcactgctgctgctgctggctgctgctgctgctgctgcacagaatcgtcgcatcccccagccgtgcgcgtcgtcgctacctcctcggacagaaatatatgaataagcatcagaagccagtgctaacaggccagcggttcacaactgcggaaaagggatgaaaaagagaaattcagaacccacagtcttcaagggatacacttgtccaggagcttaatgaggctggtgatgactcttggaagctgtagccaaatttctggactctacaggctcaagattatgattatcgtcgtctatgcagacacactcttctgatatcctggtggcgtaggcatggtatgcttgcgcccgtggaggaacgctgcatagatgatggtgacgaagaccaagatgaccaaccactagtgtgttttcagcgaatgaagatcatgaaaccatccgaaactatgctcacggtcttcaactacacactcagtcaggagatataacgtactccgcgagaacggagtcggggatccggtgagggtggctttctccggcttccttagaaggcttgccgaggcagatcagacccagttggcgatgctgtcggggatgctgctgggaaagtgtaccctgccgcgcatcatcacagtctcttcgcgaagttagtcaagaacggattgcggcctttttgtgtcacgctctcgacgctgcgtggcgaaaaaagatgccactccgttacttcgtcttctgcgaaagcacttacacagggtgctgaactcttccgtacaaagaatggggtacctgccaaactcccgaacccggctaacggatcgagtctcgagcaccgtcctgcgacagaaatagtatggtcacaggttttcgatccgcaagagtgatctcaacaaacggactcacagaggagcgccgactcacacatcggacgagactagactcacacacagtggcacacacacacccaaacaacagctcatctcactcattgactcgccatattcggagc

SEQ ID NO: 535285 - DNA, 665 bp, Homo sapiens
gcacgaggagagagagagagagagagagagagagagagagagagagagagagagagagagagagagagagagagagagagagagagagagagagagagattaatatgtgatgtatttatatttttagtcctgagattgttacttattttatataactctgcttaattattttccccaatatatatatgacctccttaccccctctactgactgcaagtcacactttgtctatatacgaacttctatatttatttattcatttttttaaagagagggtctcactctgtggtccaagctgtagtgcactggctcgatcatatctcactgcagccttgaactcctgcgtttaggcgatcctctcgcttcaacctcccaaagtgctgagattatatgtgtgtgtgagctatcacacctggcctagtctagtatatacatatgtctatattcttcttcaagtatgggtttcttatatacttacttccttcttccttggttttcactttatatactttaagatatcctttctaaattccttgcttccaggactttgtttttcatctttccgttgccctctttttttgctttccccctcttatggcttctgttgtgcattccttctccttttgtcctttatcatcgttttttgtttctctccccttttctgt

SEQ ID NO: 535286 - DNA, 163 bp, Homo sapiens
ctatatttcttaatcagtaaacctgggagaggtggctgcgtgcctgtaatctcagcactttggaagactgaggcaggaggattgcctaagtccaggagttgccgcccagcctgggcaacatggtgagatcccatctctacaaaaaatccaaaataattgaggg

SEQ ID NO: 535287 - DNA, 100 bp, Homo sapiens
ctgatacatcgtgtcggacagtatatagtcagagagatagctattagaatgattatggatgcggttgcttgctgtaggaaatacttaatggcagcttctg

SEQ ID NO: 535288 - DNA, 171 bp, Homo sapiens
acatggcagcaaatgacaactgaagatggcaagtagaaaaccactatctcttctatgacggcgaataccgttcaggaaaggtacacctagcctttaagcaacctggcaaagaggctagaacaccaaggaattagaattgaatatgtaggtcaccatagcaacttttccatg

SEQ ID NO: 535289 - DNA, 660 bp, Homo sapiens
tgcagtggctcacacctataatcctagcactttgggaggctgaggcagggggatcgcctgaggtcaggagtttgagactagcctggccaacatgcaaaaccccatctctactaaaaatacaaaaattagctggatgtggtgatacatgcctgtaatcccagctattcaggaggctgaggcaggagaatcgcttgaacccgggaggcagaggttgcgccactgcactccagcctaagtgacagggtgagacttcgtcatcaaaaaaaaaacaacaaccaaaaaacaaaaaaaaccaatcaaacaaaacaaacaaaaaacacattcgaggccgggcgcggtggctcatgcctgtaatcccagcacttgggaggccgaggcaggcggatcacctgaggttgggagttcgagaccagcctgaccaacatggacaaactccgtctctattaaaaatacaaaattagccaggtgtggtggcacatgctgtgtgatcccagctactagggaggctgaggcaggagaatcgcttgaacctgggaggcggaggttacggtgagccaagattgcaccattgcactccagcctgggcaacaatagtgaaactccatttcaaaaaaccaaaataaaacaaaacaaaaacacatttgattctacattataaat

SEQ ID NO: 535290 - DNA, 790 bp, Homo sapiens
tctcaaccacctgggcctaccggggattgctgggaaacttgtggttaaagggaatcagggggttgagaaaaaaaaaaaaatacctttaaaaagccggccatcgggggggagggtttctctgtggtactttacgcccattaccccaagaaatctacaattaaattaagccaattatagaaaaccggttccaagttatgtggagggtgatttccctctcctctcccgcgccaaagagcagctgtggcttctcgtgaggaggaagccgtggtttctctcgtggtagcattcacacccgaggctgtgttctcgagaaagagtcctcagtgggcacctgggtgttgtggcaaaattaacacacaagagttataaacaccctgtggaaaaacaaaacaaaaaaaaaagaaaaacacaaacaacaacaacaaacaaaacaacaaacaaacacaaaacaacaaaaacacacagactgacggactgacgacatctcaaatctatgtgcgggagggcgagcggaagacacagacagagagagagaataagcacgaaggagagcgcgcgagcgacgagcgcgcaccaacaagagagatcaagacgacagcaagccaccgcgcacagctcatacttgctgtgaagacaaaagcagggacgggaagataaacaatcaagcgcgcgcgccacacacccccctaagaaggacgggcgggcagaacaatataacaatcacaaccaaaaccagcacgcggaattaccactggtgtttattatttgctggctctcggcgaccggggga

SEQ ID NO: 535291 - DNA, 757 bp, Homo sapiens
  misc_feature (215)..(215): n is a, c, g, or t
  misc_feature (221)..(221): n is a, c, g, or t
  misc_feature (225)..(225): n is a, c, g, or t
  misc_feature (242)..(242): n is a, c, g, or t
  misc_feature (610)..(610): n is a, c, g, or t
gggtccgcaaagccggtggcgcccggaggctgcacggagagcggtgcccgcgtcagtgaccgaaggaagagaccaagatgaatgcagagcccgagaggaagttgcgtgtggtggtggtgtggccgagcggctcgtgcggatgagggactggcggaatccacacccttcctcaggtcctgaacctgatggcttcgtgtcgaagaagggagctcggnagcatngatngagtccagcagatttcntttgaggatgctctttccagccaagaggtggaggtcgcctatatctgcagtgagagctccagccatgaggactacatcaggcagttccttaatgctggcaagcacgtccttgtggaataccccatgacatgtcatgtggggggcggtcaggaactgtggggagctggtgagcaagaagggaaaagtctgtgcagaggagcatgttgaactctgtgatggaggaattcgttttcctgaaaaaagaagtggtggggaaggaccgtgtgaaagggtcgtcctcttcaaagtggcccgtgtgaagaagagggggtgttgcttccatgattcagggattctggctgaactgttggttcccttttggggggttntcttgtgtctgcacttggaagaggaaggaatcagattgaatgacggtgtctggaaagaagaaatctgttggttgggaaaagggggtaacgaaagtttggtcaaaggtggggggaagggaaggggggtaaaattgggcaaatttggat

SEQ ID NO: 535292 - DNA, 146 bp, Homo sapiens
ggtcggtatgtcttctctaggatcaggaacttgcagtccttgtgcaacaggtcatcgctctgcacacttatggtgcaggcggcggaggtggaaacgccatgttacacagccgcatgatctggggcatgtatttcttcaccccatat

SEQ ID NO: 535293 - DNA, 954 bp, Homo sapiens
gcaagagtccggtggtcctgagtatttcacacatggatgtggtcattgttattgtgtgatggctcctaacttagatgggcacttgagtcatccagaaccatcattcactactgtcctctcacagaatcagatgcattcttcagcagagtgcattgaagtactgggagatggatgacttattgatgaacactttgaagaactgggaggtgtatggaaacgcaaggcttgaataacatataaaataatcatgaattatgagagagtttaataaagacaaggatgtaagtaccgtatagatagaacaggtcgaaggagtcactacacagatgaggatgataatgagtgtctatattctgaccaaacgtgtcagatattttacactcagatattcagtagctacaaagaaaaggtgtaccatggtttgaacagctgcttccattaattgtcaacctcatttgtccacatagaccattggccagacagacaatggggattatgcatctttgatgatgtcatagaacactgtagtccagcctcattgaaatacgcagaatatttcttaggaccaatgctccaatatgtatgtgacaacagcccagaagtcaggcaagcagctgcatatggcctggagtcatggcacacgtacggtgggagattaattatccgcctttttgtacagaagcacttcccctgctggtaaagagttattcagtctgcggattcttaagaccacaggaaaatgttcatgctaccagaagaactgatttcagcagtagggaaaatcctgaaagttccaaggcctgactgtgtaacgttgtaaaaggtctttccaccattgggttgtctggggttccctacattaagattaaggaacacaatgttcaaactttccatatttggtggcacgatggaagaatcactccaagtgtcgtgacccacaaacctgtggccaat

SEQ ID NO: 535294 - DNA, 120 bp, Homo sapiens
gccaaatgaagtgggagtggagttgctgtgtgagacatagaatgatggtcaaagataacagtaaaaaaaagaagtctgaattaaacatgataaaaagtacatttaaatgacacttagtgg

SEQ ID NO: 535295 - DNA, 530 bp, Homo sapiens
  misc_feature (46)..(46): n is a, c, g, or t
  misc_feature (58)..(58): n is a, c, g, or t
acagagatgtaactagagacacatcagcaagattggaactcctcanagttactgtacncagtgtgccttgttctatgtgtttcagatttcagctgaagtcattcaggtagatttcaaattaaatataatcacagattgcaaaatgttattccaggtattttctataaaattttgtcttggtcactttacacttttctttaataaacaatatttttatagtagctttagcttcacagcaaaattgagcaagaggtagagagagtccctatattcccctttccccgttaccagcagcccccaccagagtggtacatttgttacagttgataaacttccattgatacaacaatattatccaaagtttacatttttaataaagttcatagttgaaattagttttcattttttgttcttgtacattctatgcttttgaacaaatgtataatgacagataccaccattatagcatcatacataataatttcattgccctaaaaatcctctaaaatctgcctatttattcctccctc

SEQ ID NO: 535296 - DNA, 293 bp, Homo sapiens
gagattagtattaacaaagaccctacagagtgattcatagttgcattgcctaatgttatgagaacatactgcattgagatgatggacatttttaagatagcataacaactcaatattcagattatagaaatcaaggtttaagggatattatgcgttattgttacaagttagattgcccaaacctggctgactcatccatttgtaaaaatacagatttatctagtataagaattactgttttaggaaatcctaatctgtgaataagcccagtaacttgatgtaattacaagtct

SEQ ID NO: 535297 - DNA, 310 bp, Homo sapiens
agaagcagaagcccgccagaagcggcgaatggtagaggagatcgggtggagctggttgttctggacctgccttacttgccaaaggataagctggctcagtcggtgcagaaacttcaggacttgacactccgagacctcgagaagcaggaacgggaaaaagctcccacagcttggaagcgttcatattttagacccaagtcagttggcaggaggcagcagccccccacttggcttacactggctctttggtctttcctctggcttttgggtccaattttttcaactcccctcccagacaagctttaccacc

SEQ ID NO: 535298 - DNA, 296 bp, Homo sapiens
ggatcggctcggcgcctccgcctgctcggcctcccaaagtgctgggattataggcgcacttggccagcttcatcttttctgatactacctttaactggttgttttttgtttttgagatggagtctcgcgtctgctgctcagactggagtacagtggcatgatcttggctcactgcaaccttcacctcctggcttcaagtgatccacctgcctcggcctaagtgctggaattataagcgtgagtcaccacgcctggccgaccttgttattgttaatattaagtccagaattgccccg

SEQ ID NO: 535299 - DNA, 1003 bp, Homo sapiens
gtccccatcaaccgggccactccctcctgttttttatccccggcggttactattttccccggaccgtttgcacctccgcctttttgtgcgccctagtggccgtgggtgcccgagacacggcgtgttcccgtgcgagttttccgcgggtgtgttgtcatcccccccctccccaagagtttttcattggggtgcttacacctttcttgggcgggtgctcgcttctgtgtggggaataataatttttctttgtttgtggccacagcacactctgctttccctacatccctctggggccacacgtatatttgggggcaacccctctcgctggggttgctgggtcaaacgtactaccaccaatgaagaacgaattttttttgattggcgcatagcagaagaaaattagctgctatgggagtgtattatttttttctctagaagacgaggggttcacccccacccacctcgcaggaaggtgggtcaccaccactcttttattatgtcaaaagaggaagaaattttgttggtataataatacatgccaccccacccctcgcccacaccagtggttgcttgttaattctaatataagcccagcgaagatcccagtaatttcttcctcctcgtcggctgttctgctcgttattatttatcttgggcagcaccccctcttctctgggcccactattttttttgtgggggtggtatatgactccccttggtttgttgttttgatgatgttttgaaacaccccccaagttgtatgagtggctgcttgtttttcttcccccccacttaaaggggatgatattatattgaggggggaagaaaaactctctgttttgcttcttaatgatgatgttttgtcctccccccggcttgctcctcctttaagaggatttttcccccccgggcctttttttaaggggggggtaaaaaatttttccccccctttgtttaaaaaaaaaggttataaaaaagggggtttggttaatttttgggccca

SEQ ID NO: 535300 - DNA, 209 bp, Homo sapiens
cgccaaatgggatttcatctggaaaaaccattttcagttggagcagcgtaagccttgattaggaataggtcacacgttcacaatgaataagaaagatccactgttctctcaccgttcaccctcacgttgaataattcaactcaaagcttatggctctccatgttgaatatccagttgatattcccacgttttgctggcggtacctgagc

SEQ ID NO: 535301 - DNA, 564 bp, Homo sapiens
cctcgaggacccgacggctcaacggaacttttgaaaatattacaggttatttcgcttcctgataatctatgaaagacacagagaggataaaactagagtgtgtggttaagatgagagtgtgccacagtaagactccaggatggggacattttcggctctgtggcctcagtcatggtcaagtcatttgttcctttggggtctgattcttaatttttaaaatgagaatttgatactggggaggctgaggtgagagcattacttgagcccagggaggtggacgtggcagtgagattgtgccaccgcactccagcctgggtgacagagccagattctatctcaaaaaaaaaaagagattcggggcggggggcaggggtccaggccggtaatcctaacagttggggagaccagggcaggaggatcacgggagcccaggagttcagggtcagccggggcaacatagggagacccattctctatggtaaaattaattggtaattaaggtgagaggaaacggcagttagaaccagaatgagacaactatccaaggtcccgtggaagcggtcg

SEQ ID NO: 535302 - DNA, 289 bp, Homo sapiens
tgatcacctttgtctcaaaaaaaaaaaaaatttgctctgcccttaaaaccacttcagagtccagtgggcggagacacggggtaatagggaggatgggagatgggtttccatctatcaataaattcaaaatattcccattggtgatttaccctaaaaatacaggtttccacaatctctaagggcaaaaaccaaactatttcctttttttttttttgggaacggaattctcgcttagccccccgggtgtgggcacacaacccacaattgtctcctcaaaaaaaaaacagtg

SEQ ID NO: 535303 - DNA, 746 bp, Homo sapiens
  misc_feature (174)..(174): n is a, c, g, or t
  misc_feature (192)..(192): n is a, c, g, or t
  misc_feature (202)..(202): n is a, c, g, or t
  misc_feature (278)..(278): n is a, c, g, or t
  misc_feature (298)..(298): n is a, c, g, or t
  misc_feature (351)..(351): n is a, c, g, or t
  misc_feature (375)..(375): n is a, c, g, or t
  misc_feature (423)..(423): n is a, c, g, or t
  misc_feature (457)..(457): n is a, c, g, or t
ccttcggaaaagtcatttaaataggccctaccggttaaatcctccaaaaggtacctcttatgggaaaaacttcccgcagttaacccttcctttaatttcatttttggcataaactttccactttaacccatttattaattcatattaattagataatttcaatgcctacctctnccctagcatgttacctcncaaaggcaangatcttgattccttgttggcttatggatacacctaggaaagtgtgctgtcttttagaagctataaaatgagtttantatgcaaaagaagaatctanccatttcatcctgagagttgagcctggcaagagatccatacttctgcaagttntctcagccattgatcacgtttgtntcatgttcagattgaaagaagcaattattattgatcaagttcaagccntgtggacacatagtcaaattttctaggcatgtcntgtttctaaggtgccttggaattccaactgaaattaacaggtaatagagaaaaagaataaagaaagtatcaaagaaagaaagagtgagcttcagagtaaaatattattatatagctcagactaataaaatgtgttttacttacatattcaatttgaatgacttaactttaaacatcaattcaaaaaaattgaatatcgagaagagaacatgaaaggaataagcactggagaatgagagctatgaaaaatttaaaaactcaataacaaacttacagaaattcagtatctt

SEQ ID NO: 535304 - DNA, 277 bp, Homo sapiens
tggcagaggggttttttcaggaggaaccagggctggtttttccccttgggggccattgcccttgatgtgggaagtcattggcttggggggaccttatctggctttgccagatggacactgagaaagatgttgaagactccgaatttgaagtggcacattggtccgacctggtggggacctgatcctcagtgtccttaccccctcctaccttttttttgttccacctgttgtgggtccagcaggtttttatttggggacaataaaaagtctgggtcca

SEQ ID NO: 535305 - DNA, 351 bp, Homo sapiens
  misc_feature (130)..(130): n is a, c, g, or t
gcatctcacagataagaggagctgtgtcatcattccagttcttcaactccattggcagcagacagggagtcccagggggaaaaggctgcagatacaaccccaagtccgtatcaaagggggttttctcagnctacacctggcagctctggtcatcgtccgcggaaagttcagctgctgcctcccccccgaggggaacagctgaccttgcctccacctccccagcttggctattcgatcactgccgaggacctagacttagagaagaaggcttcattacagtggttcaaccaggccttggaggacaagagcgatgctgcctcgacctctgtcactgagaccccacctatcact

SEQ ID NO: 535306 - DNA, 712 bp, Homo sapiens
tccctgtagcagctccttattgctggagaaggagatatgtgcccaagatcctttcaggatataggcatttggggcgcgacacaaatcgaggtgcagggcaagacgagaggaaagtcccctgaatccctgcaggatgaatttattcaagaagtggaaatatcgaaaatgactcaagtatgcacaaagtcttgtgaggaaacatgagggaaaagcacagaaaaatgccaaaggtcggagggaagatcgccctttgtaggatgtaccacttggatggcagaaggaaaatcctcaaaccttccgaagaagcgcgtaaggccagggaagcagaaggaaacccccaggagtgagggccgaatcagcctgtccaggggatttcaaagatggacactacccgtagggcgtttggaccctgattgcaatgtgactaggaggagtacgaatgagctttgacgacggcttagggggaccagagatacgagacctgaggtaaagaacaccacagtttgttgactagactcgcattctggaacgccaagatgacttttccacggcagcacggtcctgtaaatcccgggggttgctaaaagtcgccttagaggttacaatttggcctaacctattgcaaactctggggccccaagcgtttctgttccgtgtcaagcatttccctggatgtacttacttggaccgcccatttgcactttaaaacatc

SEQ ID NO: 535307 - DNA, 470 bp, Homo sapiens
accgcggggacgcctcctctagtccacgcacggcttcctcttgcggctgggggtgatggcagacactggaaaaccaacaggactcccaggacaaggactgctgccccacgagctcccccctcctgcaagtgaggggcccggggcggtcccccagcccagcctctgctggtggaagccgctcactgatcaggaaagtgcttgggcagcagctcaacggtgaacagggtgcccggcctcagcacctcttcaggaaccttctccatgcccatgtggtggacgaagaggtgcaccagtctgggagcctcctgcggtctgcaaggcgctcatggtcacagtacagcgtctgacgtggaccacacagatatacgtagccgggaacaacatatcagccagggccgaggatacaaggcccagagcgtgaacagaccaatgggagccaggcacacacaatagaaggggggccaggtaca

SEQ ID NO: 535308 - DNA, 121 bp, Homo sapiens
gctccattctctcaggcttgctgccaaaagccttttgtgttttgttttgtatcattatgaagtcatgcggtttatcaccatcgagtgtttcagttcttcggaggtgttcctgatgctccaa

SEQ ID NO: 535309 - DNA, 676 bp, Homo sapiens
gaagaaatccaaggatacagtctcagaggacaccattaggctaatagagaaacagatcagccaaaggccgatgacacagggcagaacggacaggcatctggcaggaagaccagagaactcctggatgaaagtccacggggccagcaatactccagagcccagtttctgctggatcccatggggtggcacattgggacttctctcactcccccatctacagcagaagactgtgcaccaggctgacagaagcctgtgccttgtaaggcccagaccttccaggggaaacactcagacatgtatcattctctatcactgcttgctgactctgggaccggtgggatggctgctcagaaaatacttgctgctggcagaaggcctgtactcaggcattagcattgacttgatgttgccaagggactgaggcgcatggcaggcttgagtaccacctgcatcctcatcttaggagtctccttttcaaataattaggctctgttcccatgtttagaactctgatgatcggccttcagcctgtgagctggacactttactagaggcccattttcagctaatacaataaaattctacataaattggaaggaataacaaccacaataggacacagaatagcagctcggtctggactcgactgactcactgaggatctgtactgctgagg

SEQ ID NO: 535310 - DNA, 630 bp, Homo sapiens
gttcagagaacagtgtgacgtagtgcgttaccatatatcgaccatggagtggacgagcatagtaactccaagagtctagtaaatatcattccatacatacaactcggttactacatcgaccatcaagcatgtgccatataaaaactacaaagcctctcgtcatcaacagtcgtcaccacttaaaaacgccccacttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcaggtataccgtttaatttaattatatgatttgtctgcactcagtttattccctactcaaatctcagccccatgtagttctttgttattgtcagaacctggtgagttgtcttgaacagaactgttttttccccttcctgtaagacgatgtgactgca

SEQ ID NO: 535311 - DNA, 430 bp, Homo sapiens
  misc_feature (36)..(36): n is a, c, g, or t
  misc_feature (246)..(246): n is a, c, g, or t
  misc_feature (254)..(254): n is a, c, g, or t
  misc_feature (268)..(268): n is a, c, g, or t
  misc_feature (289)..(289): n is a, c, g, or t
  misc_feature (304)..(304): n is a, c, g, or t
  misc_feature (307)..(307): n is a, c, g, or t
  misc_feature (312)..(312): n is a, c, g, or t
  misc_feature (314)..(314): n is a, c, g, or t
  misc_feature (318)..(319): n is a, c, g, or t
  misc_feature (326)..(327): n is a, c, g, or t
  misc_feature (329)..(329): n is a, c, g, or t
  misc_feature (335)..(335): n is a, c, g, or t
  misc_feature (337)..(337): n is a, c, g, or t
  misc_feature (342)..(342): n is a, c, g, or t
  misc_feature (345)..(345): n is a, c, g, or t
  misc_feature (351)..(351): n is a, c, g, or t
  misc_feature (357)..(357): n is a, c, g, or t
  misc_feature (359)..(360): n is a, c, g, or t
  misc_feature (362)..(362): n is a, c, g, or t
  misc_feature (365)..(365): n is a, c, g, or t
  misc_feature (369)..(369): n is a, c, g, or t
  misc_feature (372)..(373): n is a, c, g, or t
  misc_feature (376)..(376): n is a, c, g, or t
  misc_feature (386)..(386): n is a, c, g, or t
  misc_feature (397)..(397): n is a, c, g, or t
  misc_feature (401)..(401): n is a, c, g, or t
  misc_feature (405)..(405): n is a, c, g, or t
  misc_feature (409)..(409): n is a, c, g, or t
  misc_feature (415)..(415): n is a, c, g, or t
  misc_feature (423)..(423): n is a, c, g, or t
gaattgtaaggtgttccttttttgaaagctgcattnggtctatggtcaggcaccttttttccagcggagacaatgcatttttaggaggttgagttctgcggttaggaagggagatgtacccctcgccacctccccttgtcacctcccgccgagaatagaaggtaaaatatttttgagtattagtaattttcttttttcctttatcacaccggtggcttggggtctttcggagtcttacagatattnggagtatnaatttgaggactcntcggcctgcacaggaattttngcgtgtggatatttngcntaaantngttnntcctggnntnatcacntnggctngantagttncaccantnnantcnagcntgnncgncagaacaganccgtctcaaantaantaantaantaaaantaaatgtngatcagg

SEQ ID NO: 535312 - DNA, 362 bp, Homo sapiens
cactcattagtactcatcatggctatagccctacaactaggaatagacccccattacacatctctgagatcccagaggatcacccacaggcacccctctgacatccggccatgctacttctcacatgacaaaaactagccccacatctcaatcatataccaaatctctccctcactaaacgtaagccttcatcctcacactctcaatcttatccatcatagcaggcaagttgcggtggaatatcaaaccaaaccctggctgtgatgcttgctgctgtgcccataaccctgtgaatgtgtgattgctctgagcccattaccctgtggctgtgtactagctctgagcacataatcctgtaaccg

SEQ ID NO: 535313 - DNA, 139 bp, Homo sapiens
tgctgcggcgcgctggaggaggcagataaccatgtcagccacagttgtagatagcagttaatgctgcacccctatcgggatccaaagaaatgagtttggaagaaccaaagaagatgaccagagtcctcccccgaggcat

SEQ ID NO: 535314 - DNA, 196 bp, Homo sapiens
ctcagctagcagctcttccgttgccggcgcaggagttccgtttgacggctagctccctggacgtggggatggatgtcagcccctctgagaccccctatgggaactcctgaccgatcttccgcagaatcttcagggtgaagtctgagccatcttcccccgtgctcttccgtcctcgcctcattttttttgtgttttt

SEQ ID NO: 535315 - DNA, 349 bp, Homo sapiens
caagggctcgaggagcatttatgaataacagaaccctgtttggactttctctgctcactctgagcgtcagtaccgggcaagctgcgatggccgccggcgagaaaggctagggatttatcgaaggcagcagcctgaccattctcaatcgaaatctctacttcaaccgcgatttccgtaaagcgccagtccagcagctcgcgtagaggctattcggaagagagggcgcatggcgcgataggcagattcgagtctgggttcaccgagggcaccataggctttggtgccgacgcctttgccatgctagggctcaagcttgacaccggcgacggccgtactgcagcaggcggct

SEQ ID NO: 535316 - DNA, 407 bp, Homo sapiens
tactattttacatcgtgttggtgctctgttgtttttttagactgagtctcattctgtcacccaggctggagtgcagtggtgccatctcggctcactgcaacctccgtctcccaagttgaagcaattctactgcctcagcctccgagtagctgggactacaggcacgcaccaacacgcctggctaatttttgtatttttagtagagatgggtttcaccatgttggcgaggctggtctcgaactcctgacctcaggtgatccacctgcctcgggctcccaaagtgctgggattatccgcatgagccactgcacctggcctctggagtagctagtcttccactactttactttcataataaacttgctcgcccagaaatcttttgtttttttgagactgaggtcgacggg

SEQ ID NO: 535317 - DNA, 194 bp, Homo sapiens
  misc_feature (20)..(20): n is a, c, g, or t
  misc_feature (62)..(62): n is a, c, g, or t
catttgaacatatgactatnctcccagagtgaactgtgagtttcataggggtgtgggtgganttgggactaagtcttatgcatttttgtgttgatacattttcatgtgggttggtgcataaaagacactaagaatcgatgaaaggaggaagaaaggaaaacaggaagaaaaagagggaaagaagaaagaaaagg

SEQ ID NO: 535318 - DNA, 445 bp, Homo sapiens
agcggttgttctcttgaggtcagggatttgagaccagcctggccaacatgatgaaaccctgtctctagtaaaagataaaaaatagccgggtgtggtggtgcgcgcctgtaatcccggccacttgggaggttaaggcaggagaatcgcttgaacccaggaggcggaggttgcagtgagaccgagatcccaccacctgcactccagccagggtgacaaagagcgagactctgtttcaaaaaagagaaaatttgattgggtattaataaaaataatttttaaagtaagtggagaatatctgggcatgggaggctcagtgagtgtaatcccgaggagttcaggagggcaaggcaggtgaagcgagatgaggtaaggagttgagagagaacgaggcttgagtggaaaaatggtagaaagacgtgtatatgcaacaaaagataaaaataag

SEQ ID NO: 535319 - DNA, 119 bp, Homo sapiens
agactgttcgcacaggttggggtggagggagtttacaggaagcagacaggtgccaacagttgaaaccgatttcctgtatctgaggcaccaacgtccaaggcggacacatctgcatattg

SEQ ID NO: 535320 - DNA, 680 bp, Homo sapiens
agcgggcgtgcgcgcggcgacctggaggacgcgtaacgcgccgtggtccccgcctgccgctgctccgccgatcgccgtccagtctatccggcactaggaacagccccgagcggcgagacggtccccgccatgttgcggcatgagggaggaggttcgaccggttcctgcagcgagaaagaactgcatgactgaccttctggccaagctcgaggcaaaaccggcgtgaacaggacgcttcagtcgctcttggtgtcatcggactggtggccttgtacctggtggttcgggtatggacgcctctctcctctgcaagctgataggatttggtacccaggctacatctcaattaaagctatacgagacgttcccaagaaaagaatgatgatacccagtgggtgacctactgggatagtgtatggtgatgttcacgcactgtgctgaactactgtctctgatgatctttcctgtcaatggtttcccactgtctacgtacatgctgaatgtgtggctctaccgtgtagctggagcatggtccccgagctagtctaatggggttgaaattgcatctaaaagcgcatcatccggcctttcttcctgaaacacgagtcccacgatggatgacgtgtggacaaggaccttaaagaccaaggcaaactagacactgcaagatgcatcaagtt

SEQ ID NO: 535321 - DNA, 121 bp, Homo sapiens
gtaggaaagaaagcataaatgaacgtgatcctgaagattgagggacatctaggaatttggtttttaattacaagctatttaaagagatgaatgtggccaaagttttacacaattgaaaata

SEQ ID NO: 535322 - DNA, 1279 bp, Homo sapiens
  misc_feature (829)..(829): n is a, c, g, or t
tttgtggtgtccgacagacgaggggtgtgttggtgggttggtgagggccaaggtgcgagccggttggggcgggggggcggtggtggtggtgggtgggatcggtggatgctgtttctggtccgggtgcgcagtgtgttggggcgggtgtgttgtgtgtcgcctcgctccgtgttggagtggggctgttgtttgtgtgatgcgatggggtgggggctgttgtggtgtgggttgtgtgtgggagcggaggcgttggttgtgtggtggtggcgcgcgcatcgtgcgcgggtgtggggttggtggtcgccctccttgctgtgtgtgttgttggcttgtggtgtgtgtcgcccctggagacgcgctgcgcccagctcgcgtgtcgttgctctcggctccctgccgtcgcgcgactctgtgggtgttgcatcacgtgggttgttgttagtagcttgaggtgggtgctgtggtctacctctgcttgcttgcgtatggttgtgttgcacgcggtgctggttggttttcgttccgcgactctgtctgccctcatgatgtgtgtggggtggctctttcactctgttgtggcgtgttttgtgtggtaggttcgttgttgtggggtggtgtgacgtgccccccctcgcgcgtgtttttggatgggggggggcccaccgcgctctcgcctggtctacacgggcgctcgtctgtcgtgggtgcttcgtctcgtcgctgtcgctctcgtggcggggttggtatagtatagttgtgcaggcggcgcgcgcttgcgccagcacgcgcgcgtcgcgtcgctggcgctcgcgcgtgttcgctcgcattngtggacacacgcctcctgcttcgtttgttgcacgctctctatggtgtgggtccctctccacgcgcgcggcggtgtccgcgcgatgtatatagtagctcctcgttttccaccgtgaggtttccccgctcccttgtcgtctctactccccttgctgcaccgtagatgtccttcggagggcctgtatccctctcccacgagtcggcccagccgcctcgacagtggttgttctcgacgtatccggcgctcgtctgtgtttgttgttttttgttcgggggggccgctcttggtccccatgtgtttttgtgttggttgttttatacatttatttttttcattgttgtttttgttgttgtaatacttagatcaaacagggccccaattgaaaaaattgaaagaaaattaatccctgtttagggagaaggtttttataagaaaaacaataaaattaaa

SEQ ID NO: 535323 - DNA, 1522 bp, Homo sapiens
  misc_feature (228)..(228): n is a, c, g, or t
gcacaggcaggttgagcgtgtaatgagcaccagcgtcaccgtctcttgattgcacgtgattgtgcaatcgcgacgatagcgcggattcccgatggaacgctctctgtgcaccatgagaggcagtctcaggcaacacacagactaagatacatagcctcagcaaggacgcacgtagcaggacataagagtcgtggaattttcatccgataactcacatttgtgagcaanactactcaggacatgatatcatgatttgccaggctacctagtatgaattggccacagtcggagctacagaagactgtattgtggacactcctgtgtttgcaacacctgggtcaagggaacaggtggtaataggcactgagagacttcaggatctcgagcctgtttggcaagcaagcagtggaactgtgctgagctatgtgatgcgacggaggattgtgcagcttacaccgatgctagagttgcctatacaaacgttgagggccaaatggtctgcagtgacatgcttgacgctgtcacagacgagacatgctgcgttatcttgcaatacaaaggcttcccaggctcaagaattgccatagtaagtgcggtagccaggaattaccctttgtggaaatgtcctgaatgggaccaaggttcggggactttcctggcaaaggttccctatcctggcacaacaattcatgttgtttgaacccaatcaatgcccatatactttgtaaggcaccctattataggaacgaaagccccaaaaccgagaaggccccaaagaccccggtcccttcatattagcccggcggggtcaatccatttcagggtttccaggtgggtcgtgacatcagaaagacagagttctcgacgctatggtgaaaggcacaggaggacatttaagcaaaggtggcaggtttttgacaacggaagcccaaagacaaggaaatccaatacgaaaatccagggaaaccactagcagaacaccaggacgtacacggacaaccgggcacatacaagaacagatgctagaaagccaagacacaacgaaaaacaagacaagacgataaaaatcagggaagaaagggtgccgaactatcaccacgggaggcacaaaaaggccaggcagcagcaacaggaaacccaaaaggatcccggaagggatgaaaccagagggtcacagacaccggtagccccgtggcgccgcagaacagaaagcccaagaagataaaacaaacaaaggagagaagagaaaccgaaacacgggcgaaccagagagaaaaacgaaacagagagtagcaaggagaacagcacacagcaaaagaaaacacaacaagaaaaaacagcaagcaagcaagggaaacgacaaaaaacaaagtagacacacgaggagatagaacgacaagacaacaatacacggaaaagaaggaaagaaacgatgaaaactgaaaaaagcagccaacaaagagcgagagaaaacaaaaaagaaaagaacaaagacgaagacgacacaacacaagaagaagaa

SEQ ID NO: 535324 - DNA, 1035 bp, Homo sapiens
gatatgcatgcattttcatcaacaatatagtatgctgagtttccgaaaatcctcaaatgcacttcagaaatggtgctatcatgtggttcgtttgacccctgcaaatctcatgttgcaaatttgatccccattgctggaggtgtatagagcatggagcggatccctcatgaatgtcttggcgttgtccttgcagtaatgagttcttgctctattttacctcccctggaagctgattgtttaaaagagcctggtatcctccctccctttcttctttgcttcctctctcttgctgtgtgatctctgcacacacacagctcccctttgctttctgccatgagtggtctgaggctctcaccagaagccaagcagaggctggcaccatgcttctagtacagcctgcagaactgtaagccaaataaacttcttcttagtctaaacaaaggacggaaaggacaaccgacaacagacaaataccccagaccacaaggatatcccgttaacacaccacaaactgcgctaagacacaggacaacagggatacgcaggcacctgagccaagacagacatccaacacacaccggccacgacggaagcacgacgaatggcacccatgacacctgcacacacagccacccacagtcagcggccacgcacacaggcactcacacaacctacacctggcaagtcccctcaccgctcagcatacaccacaacagacccccaagcacacaacacatccccgaggacagaccaacacaacaaccgccaacaaccacgaacctaccacacacacaacaaaccacccacacgacacacacacccggggaacaaacgaacaagacggccacacaacaaaggagagggcaaacacacaaggccaacgcgagagcagagagaaacgactaaacaggcacaatagtacaacaacgggaaccacaggaacgacagaacgcagcgcaaacaaacaacaacacaaacacgaagaccgcgaacaaaacaaaaacgcagaacagcagctccgcctgccgccctggg

SEQ ID NO: 535325 - DNA, 161 bp, Homo sapiens
actataccattatcctcatatgatagtgcacgggccccgcgctggatacggcgacggtttctcagttttgcctttgtcctagctctcattcgctgagaggcataaacctttttgagtatccttccaggctctaagtttcttaaggatgcagaacaggttcc

SEQ ID NO: 535326 - DNA, 739 bp, Homo sapiens
  misc_feature (547)..(547): n is a, c, g, or t
  misc_feature (590)..(590): n is a, c, g, or t
caaaattccaatgtcatttttcacagaagtagaaaaaaaatcctcaagttcatatggaaccacaaacacaccaaaaaaaagaaaaaatagccaaaacaatcatgagcaaaaagaacaaagctgttcaggcagtgtgatgcctccagctttgcagtatttcaaactgtactgcaaaagcatagtaattaaaatgtcatggtcctggcataaaaataggcacattgatgaatggaacagaataaattatgattaatttattgacttgattatgattaaccaattatggttaattgatttttaataaaggtgctaagaatacacaatgggaaaaagtctcttcaataaatggtgttgggagaactggatatccatatgcagaagaatgaaatttgacccttatctcacaccatatatacaaaaaccaactcaaacatattaagtaaacttaagaccagaaacttgtaaactactagaagaaaacataaggggacaactacatgacattggtttgggcaatgagtttttggattggaccctcaaagtgcangccaacaaaaataaaacagacaaatggattaccatagacgcanaagccttgaccagaaaggaacaaaagtggaaagacagctagaaccggagaaattttgcaagctacatcgaaaagcgtatttccaaaatggagaaatgcaaacgttggtcaaacggccttaaaaaatgccacggaccggattacttttta

SEQ ID NO: 535327 - DNA, 107 bp, Homo sapiens
cgctggtatcaccttgcaatactcacagagccagttcacatcccactctgagctcccacgagaaacactgcttctccagtgcccggggtgtttgggctgataacact

SEQ ID NO: 535328 - DNA, 240 bp, Homo sapiens
agtagtcttaggtacaatatgaatatgtctatttctcaaggattgcaatgaccagtaaatgagtgcatgagagggtaaaacacagggtactccgctcctcctaggcatggagcagttgttctagaagcccaaatgtgctggaaggttggccacctgagagccacaatcttcttttatttaaccactgaaagcctgagaggaattctgaaactcatacccaaataacctctccggaatacg

SEQ ID NO: 535329 - DNA, 313 bp, Homo sapiens
ggtgatgacaactagggtagttttgaggtgtaagccatttaccaagatagttgtaggtaaagaagggcagatttattagagaaagtgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 535330 - DNA, 811 bp, Homo sapiens
tgtcatcttagggtatggtcaggcgacaggggtgaccagactgtcctggtttcccaggacttggaactttcaatgctataactgggacagtacccagcaagtggggatggttggtcccctaccaggagagggtctggggtctcttgcttcccgagaacgcctgtggcttgaaggaaccttgactgcattggtcctcaggtatctagctcccaccttctctctcatcgtgtggagcaagccagatctcagtgccccagaccccacgctgatctgcatcttggtttggcgatctccagagacgcctgaggccccagagcttgaggcaaagccaggccgtccatgagtcctgtgtgccgtggacgagtggtcacttatactactcctaaggctacgatgtcgagagctcagaccactgctcagagcagaaatccctgcgtcagaatgctccgcagttccctcgtccctgctcgcaggtctcttgtctcttgggaaggaactgataggtcgggccatggtttgggcctagtcactgagtcagctctagtatctcgaagagactctgttcattctgctcgtatccctaatggcctggttggtcaaactctgggcaacagggtttatcaggatgaggaggtcaagacaggatgtgcagagctaccgagttcatctggtgggtgtccgggggcacagtgggggctgatgtctgtgcaggctgtgctggcccgcactgccttgttccctggagtggggtactccttgttgaaagaagaggatccttctctgatagtgagaatacacatgtatgaccaga

SEQ ID NO: 535331 - DNA, 184 bp, Homo sapiens
gaagatttgtagtacacatagcatatgttataaaatgtattttacatacatcgtgcaaagatacacttatattaatgctataaaatcacttgacatgattgagcaatcgtaggctagttctgagcatgcctttaaattcaggacaaacagggttacatagtatgttggattttagggggaacag

SEQ ID NO: 535332 - DNA, 1052 bp, Homo sapiens
ttcagaaagagccaccagctggaatgctgcatgttaggtggcctttctctgcaggaggtgacctccttggctatggaggaatcccaagaagcaaaatcattgcagccagacccctggggatttgcacagacagaacatctgacccaaagtgtgctacacagctggggaggaagggacaccacagatacctaaagggaccagctccccctcctctcctcagctccagatcgagggccaccccactgtccactcccgtattgtcgacctccgttccggtcccgatgttccccctcggcagccaaggtccaagtccctggggcctgcgtggagtcccttgtgctgtcccaaggatgaagccagagagcccagcctcctgagacctcagacctggtacgcagcccacatgtaactcgcgattctcttcccagcacggcctggccctgactcgtgcagcgggagtccctcgacggggaatgggacaccggcttggtcgcttcctccctgtccctatcccacgtgtcacatccttggctgtcagtcccatgcctgcccatgccacgcactctgcgactctggcctcacgagcgcggtgcccttgacacgaagcacgacgggacgtggcagtgcccggcccctgcccatcgcgctgccctccctcaaccaggacaccctgcccgcctcgcctccccgcgacctgccacggggccacgctctacacagagcacccaccgctgtaccactaggcacggtgctcagcaagcagcccgatgcgcaggacagcacgatcgcccagcggcgaccgacggaccacgcgccgcggccacactcgcccgacccgcccgaccccgcgccgccacacgcctatgccccttcgcccgctgcgccacgggtcaactctcgccttgcccgctgtcgtccgctggctggcgcgggctgcccgtgcccccgcctgcgcctcgcgcccgtgtggccccgtgccccctccggcccgtggcaccgccgtgggccgcacgcctcgcgcggcccacccccgccgtatactttcgctgtta

SEQ ID NO: 535333 - DNA, 413 bp, Homo sapiens
  misc_feature (302)..(302): n is a, c, g, or t
tggggcaagcaaggtcgcgactacatcaacctgtggacagctacgacgaccccaacagttaccgctcggcattccgcgacggccgtatcgacctgttcagcgagagcgagcccaccaccttgctcaaccagctccaggacgacatcctcgaactgcgcccgctcaacgaaacccgcgaactctggccaagcgtcgacctgaagcgcgacacttccatccgcttccacatagcccacagcgcccaacgcgaagtagaaattctccacgaccagctactccaggttcagcgccgaccctttgcntaccacgggacgtcatcgtcatggtccccgacgtcgacagtacgcgccgcatattcgcggtattcggccaacttgatagaagcgacctacgcttcattgcgttcacactga

SEQ ID NO: 535334 - DNA, 600 bp, Homo sapiens
tctagctcggtaccccagagtccaaacagggccatcttttatcaggctttctgtgtcgaggacgctccccacatagagtaaaacctaaagggaagggatgtgaagtgacctcaccctcagcttctaactcatgggggcaaggcttgtgggatcttaaacacctctgcctcttctgagcctgttttttcatctgtaaaacaaggatgggaggttgtggtaaaaattccacaacaacactgtacacccatgaaatacctgggccacggatgactcggcagaccccaatttccctctgcctcctgcctaaagctgttagcaagcatccataatgcgggtcacacaaaagctccccccggaggttacagaaatgaaagcggcagccccagtccttgggtagcctgtttccccttgaaggaaacagactcaatatcagcaacacacagtgaatgacgccagggtggcgaacgggcctttcctggagcaaatgcgggaggcttcatggagatgacctgtaatgaacaccactcatctcaagctgggagcagcacatgcccccggcagggagtcagtgatgaggtatggggttcttgacatcttcct

SEQ ID NO: 535335 - DNA, 410 bp, Homo sapiens
  misc_feature (56)..(56): n is a, c, g, or t
  misc_feature (96)..(96): n is a, c, g, or t
  misc_feature (173)..(173): n is a, c, g, or t
cccccgggtccccccccgggtcccgggagggggggggggggctttttttcccggtngggatgggcccccccaaagggtttgttccccccggggccnaaaagttccttttccccctaagagggggccccttggatccagggctaaattcaccccgggtattccctctccagggntagagccgggatttggggcgggtttttttggggccccccccttttcccgggggttcccctaaaaaattggggcccggaaggggccgggataaaggaggccccaggtttttggaggggggggggggggggggggttttaaattgtttaaaaaaaaaaaatttttttttagggggcgggttttggtgggttgttggcccgggtcccgggttttttaggtttatataaacccgaattcca

SEQ ID NO: 535336 - DNA, 213 bp, Homo sapiens
cactattgcctcgtctggtttcgggggtctatagctttggctactccttgtcaaagttatttctcagttaattcattatgcagaaggtatagggagttagtcctttgcctatattatgcttggttgtaatttttcatctttcccttgcggtactatttcttttgcgccaggtttcaatttctatcgcctatactttatttgggtcaatcgtct

SEQ ID NO: 535337 - DNA, 513 bp, Homo sapiens
gcacgagctcctttcctttccagcaagagtcctccagaatcctcatactcacagtccaagcttactctcttgaagagttctccaaaagctcagttgaaactctcttgaggctcaattcccccttgttcccgcttgccttgacctttatgcattccaagttgtctcctcttcacccattcttgaccatctgttgctttgcccacgtacagacccctgggaagatgaagaaaccagatctgaaatggcaagtgtattaaagcctcccaaaccggcaagagggtcagaagggggcaggtgtctcttacagaaggcatgaacaggcactcaacatacgtttctttatttaaccctcaagaactctggtaggtaaatgtactctcaaatttccaaacaaatgaggaaactgagacctggagaatctaagtaactgcccaagatcacataggcttggagtggctccaaaacctttgctttttttttcatacggcatttaacatataaaatagaggtcta

SEQ ID NO: 535338 - DNA, 163 bp, Homo sapiens
aagcagtcggttggagcgagcatcccccaaagttcacatggtggccggggcttttgatagcacatcgtggttttttacatagtcatcccaaatataagatgcgtagtaacaggaaatcccttgcaatccaaaaagcaaccccatttatttctaaggagatggg

SEQ ID NO: 535339 - DNA, 1260 bp, Homo sapiens
caatcccgtcattctactctaccatctttgcaggtacactcatcacatgcggctaagctcgtactgatcttgtagcctgagtaggcctaaaaataaatatgctagcttgtaggttgcgagcgctatacgcttagaaagaataaactcctcgtcccacagaagaagctgcgctctccagtattggccgtacgacgacagagcatatccgagatccatatgaatccttctaataggctactctctctgtcatgcacagtagtactctccgagactaattgaaccatagagccaagtagcttaccaagtcaatgagctcgaatcgaatctaaatcaagtgctagtgacatcgggctatgagcgaaataagaagcgtacgcgaaatagcgcccgcttgttcacttgcttgaggtcaccagaggattagcgccagagggtaaccccttcgtgatgcatccggacctgcattcgttcgtcagcatgagcaatagacatagcccccgagtcctcaatgtcagtataacctagactcgtctccctcacgtaaacgtaggccttctcctcagtctcttcaatctctatcccatcactagtccaggcgaagttgaggtcgtgactttagaaccgaagaggcgcaagctacggcgacataactctctaagctagtactccgtcgaatgtgacccaccataaggatgaactaatcagcgagttcgtactcgtacaacacgctaacgataaaccactttcttaacttgtacactactttcatattcactcctcaacataaataacccgttagttccctacttacttcaatctttaaactccatgcaaccgatcgatccctgactactatctcgcaggctgataatcaagctaaacatgacttagacagccgtttaattcccatttccaacccttccttcttcgcctaaagaagtggcctggccccccgataaaccagggttttatgccccagaattgggggccaattatccgaagaattccacaaaaaacacataggcctctatcattccccaacaaattgaattaccagcgcaatcaaccgttcctttaacgctctatatttttaccttagacccttaatctaagttccagccttaatcaaactgaatcccccatattttaaccacggttaaaagtcaaacggaccgttggaaactataaaaacacacccaatcgtcccacatagtgtgcttaaacgctattctactatttcccctgtttgtaataactata

SEQ ID NO: 535340 - DNA, 120 bp, Homo sapiens
ctcaggatggcagcagagcagacgccgggctgcgcgctgggagctgcgtgtctccggccatggcccccgctccgccccccgcgcgcctccttctcgccctccgaggtccagcggcgcctg

SEQ ID NO: 535341 - DNA, 180 bp, Homo sapiens
atagccggctttttgggtgctttccctgctgagtatgaggcgagagtgctggagtactgtaaaagacgtgaacagcaggagtcgtcagagctctggcagccttcctcaaaaagtccgggaagctgaaagtccccgacatgtgtggataccgtcaagcgtggccaagcacaaatgagcttg

SEQ ID NO: 535342 - DNA, 220 bp, Homo sapiens
actaaagaagtaggcggaaatgagcagatcgctcctccctggtatgagcagaccgaaatttcgcttaagcggatctgccacacagcttgccccatagatgaatttcatgagctgatcaggacactgagcaaaggtaaaaataaaatctaactgtgcattggacacgcagagaaggaaatggctaattcctgataagcttttgatttttgtattgtttgca

SEQ ID NO: 535343 - DNA, 193 bp, Homo sapiens
cccttcgtgtggctcatggggtggctcttcgtgtggcgcgtggtgggctcagcgtgtgcctaccctacgccggcagccgcggataaccggttgaaccccattcgcgatggccatcggggattgcaattatcccccatgagcccaccacgcgccacacgaagagccaccccatgagccacacgaagggccggac

SEQ ID NO: 535344 - DNA, 264 bp, Homo sapiens
cgtaaaaaattttgtaaaaatgctgaagagtttccaaaaaaatatggggaaaagcgccctgtggactaaaatctcccccgattggttccagcaaatgttgagcaaaaaccccgtgcagtgcattcagaccccccccaaagcaggactttgtggaaattgacacgtgcccccccctggcgttcgcttgtggcagttactacctttttccagtttttttaatcaaaagtggtttaggtaacctgtaaaaaaaggattaaaaattta

SEQ ID NO: 535345 - DNA, 466 bp, Homo sapiens
  misc_feature (125)..(125): n is a, c, g, or t
caagcattgtccatcttgccaaagactgctgtttgtgattccagttttcagtggcttttcagcatcccatcaggcagaaaaccacatttgtcttcactactcccctcaggctggaccgttaggtngttgtttacagtcccttctccatacgggttggatggcctaaagcagccagttcttgacaacattgtgctgacacaagagtgaccatgaaaatctcttgtgctatctgcactgcatcttgtagcaaaatagtcaaggggcttgtggagctcaaagaggtatagattcttcatttacagaaaagcaagtatttctaaaattttctctgttgataagtgactaccagttttaggcccctaagaagatactagaaaaaaaagatcaacacactttattatccatcatggcaaatgtgatgcttgaacaaaggggtggaaggagtaaccacttttcttaaaaattt

SEQ ID NO: 535346 - DNA, 158 bp, Homo sapiens
ctgtgtgttgctggtgtatctgtgttgctgactgtgatctgtgtgtgctgggtgtatctgtgtatgctgggtgtgatctgtgtgtgctgactgtgatctgtgcgtgctgggtgtgagctgtgtgtggtgggtgtgatctgtgggtgtgctgggtgtga

SEQ ID NO: 535347 - DNA, 1667 bp, Homo sapiens
ttgtacattggaagtctagaatgtgtaacaatatttaatgtatactagagttcctcatgctcgcagggctttaagaaatctgacccacaaaggtcatgtgcactttatctgtactgtataaacttcattgctacataaaatgagagacccaacaccaaaacaaaggccgagccgcatcaaacaagctctcccctacgcgcgcccaaaatccttccggccgacacacaacgtatatctcataagcacccacaccgtgggcaccccacataggtcgcacgcaccgctatcaactcacgacgctcagcgcctactcgagcctcacgacaatgacagacaagcgtagggagaaatcacgggaacacaaacacgagactcaccgagcgcgagaaaccgatcgccacccacaagtggaccgcttatatccacactcctcgcgcgagagatacacctcaatactcgtgggcaaacaacctccgacctacttcaccgcgatactagcttcacaccgtcttctcaaacgaacatgctaacatctcacttcaaccaactctacactaaatgagcgatactaccgctgcttatcaaaacactaataaccaacaaaataaaaacaccacaactcacactaacatttaaataaaatattctttctcgcactttcatcctcgaacagccttaattcactctacccagagcaacaactatatactcatactacactaaattaaaaacacaccgcgactactaacaaacacccccatcccatcgctcctacccacatacacccacctcaacccacacctcatctcacaacataaaatcacatattatcacattcgactactcactcacacattcattcataacttctctacataacacacatactaccacactctaacatatccaaaaacacattccatttcatcacacaacttacactacacacttgcaacaaacacataaattaatacacacatctacatctcataatactacaaactacgaccttcactacaactccatacaaaatcaaacacacctaataacaacaccacacacacacacacacaatacacgagataagcacaagcagtataagagaccacaaaaacacaaccaaccatctacaacctacttaaaccacacaaacgataacaaccacgacgacaaccaacgagaatacgaacagtacaaccatccgtgaagacagaagcgacaggacacgcgccgcacacgccgccgatacgaagcgtcgccgaggaccagacgtgcgcagacgcaataaccacagacgcgcacgaaacaactagcacaaagacaagtacgcctacgtccgacctggctgctatctgacgtaagacagcaggaaaacacgacatgacctagacacgacgtactctagagggcgtagtcggcgtgaggctcctgaatcctgaggtgatagctaacgacggccacgccctacgactgctagtgactcctgagcggctggcgcgggcggccctgccgtccgtgggtcggactgcagtgggagcacgcgcagcgtcgtgcgttgcagtactcggatggcgtgaaggcggacttttcgtctgacgtaaggttggtgaggcgtctgtctgtggtgtgggcgtacttggggtagactgtggactgctgatgctaat

SEQ ID NO: 535348 - DNA, 120 bp, Homo sapiens
gattcccccgggccccccagggggccccccttttttggggccccccaccggaaccccccccccggttttgaattttccccggtttccccccaaaaaaggttggggccccccctgggggga

SEQ ID NO: 535349 - DNA, 706 bp, Homo sapiens
gacctctatgaggtattctactgtgcaataagctgatctcgatttcttacagatgcttgaagacatccaatgatttgtccctccactgcgtgtataattagatgtctacttccaatggaagaaaaactgttcgtgttgtaaaaaatataattagctcttaattcttggcgcgaggttactaatagcagtaggcatagaattttatgaggttacctacaaactacttaatgtactatacacatgtaagccattgtagctttacccatgacaaatgtacatgtttatcatcctgcttcatcgtcagatatcttcctctatttggcaaatgtgccttatgttaaacactatgtacttttacttattgcattgtccagacttctttattcagatggagatgtttctctactgtcttcgtagactaaatagagtatcatccaaataatggggcctagtgacttgtactgacctagaaatgaactaagctggtagttgcgtacttctccaaagagtggaagtcaagtcccagatctgttcctcctcgatacatcaaaaatgagtctcagttcacgttttgaacccagttgaaaaactttgctcttttcatgacaacactcccggatgacctggtttccccagtgttggttctccatatgctgtcaagcctaagactggtgtacaagctacccaccaaatggtctttctagga

SEQ ID NO: 535350 - DNA, 223 bp, Homo sapiens
tgcggaccgggttatgtttacggtctgaataggaaacagcctcagatgattggagatagggctcttcacaaattaccaccccctgcagaagcagaagcaggtttgtttagaaccttggagaaataagcacctctctgtagaacaagggacaggcttgtctactgttcagtatttaaaaatgtgagttctgtatgatataatccaccgtaagacataaccgcgg

SEQ ID NO: 535351 - DNA, 85 bp, Homo sapiens
  misc_feature (13)..(14): n is a, c, g, or t
  misc_feature (44)..(48): n is a, c, g, or t
aaattctgaatgnntggccttttttagatgtttttgattttgtnnnnnataattttaaattatggagcttgacctagatttgccg

SEQ ID NO: 535352 - DNA, 305 bp, Homo sapiens
  misc_feature (17)..(17): n is a, c, g, or t
  misc_feature (21)..(21): n is a, c, g, or t
  misc_feature (55)..(55): n is a, c, g, or t
  misc_feature (87)..(87): n is a, c, g, or t
  misc_feature (106)..(106): n is a, c, g, or t
  misc_feature (122)..(122): n is a, c, g, or t
  misc_feature (133)..(133): n is a, c, g, or t
  misc_feature (147)..(147): n is a, c, g, or t
  misc_feature (225)..(225): n is a, c, g, or t
gagagagagagagaganaganagagagagagagagagagagagagagagagagtncggatcaacaggatgttgtgctgtgctggggntgacagggtccaaacaggnatgcgatgtgcctttngagagccccanggcactgtgggcanggctcacattggccaagttatcatgtacatccgcaccaagctgcagcacacgcgcatgtgattgacgccctgcgcagngacaagctcaagtttcctggcgacagagatcacatctcaaagagtggggcttcaccaagttcaatgctgatgaatttgag

SEQ ID NO: 535353 - DNA, 102 bp, Homo sapiens
ttcagcagcaacgtcaaatgtgatgtgtgtgccgtgccctagagacttcaattcccccaactttaatatacactggcgcccagcccctcttttcttgttcta

SEQ ID NO: 535354 - DNA, 876 bp, Homo sapiens
  misc_feature (147)..(147): n is a, c, g, or t
  misc_feature (164)..(164): n is a, c, g, or t
  misc_feature (171)..(171): n is a, c, g, or t
  misc_feature (206)..(206): n is a, c, g, or t
  misc_feature (238)..(238): n is a, c, g, or t
  misc_feature (251)..(251): n is a, c, g, or t
  misc_feature (254)..(254): n is a, c, g, or t
  misc_feature (256)..(256): n is a, c, g, or t
  misc_feature (265)..(266): n is a, c, g, or t
  misc_feature (273)..(274): n is a, c, g, or t
  misc_feature (278)..(279): n is a, c, g, or t
  misc_feature (283)..(283): n is a, c, g, or t
  misc_feature (285)..(285): n is a, c, g, or t
  misc_feature (310)..(310): n is a, c, g, or t
  misc_feature (317)..(317): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (346)..(346): n is a, c, g, or t
  misc_feature (353)..(353): n is a, c, g, or t
  misc_feature (358)..(359): n is a, c, g, or t
  misc_feature (364)..(366): n is a, c, g, or t
  misc_feature (373)..(374): n is a, c, g, or t
  misc_feature (389)..(389): n is a, c, g, or t
  misc_feature (398)..(399): n is a, c, g, or t
  misc_feature (407)..(407): n is a, c, g, or t
  misc_feature (409)..(409): n is a, c, g, or t
  misc_feature (411)..(411): n is a, c, g, or t
  misc_feature (415)..(415): n is a, c, g, or t
  misc_feature (420)..(420): n is a, c, g, or t
  misc_feature (422)..(422): n is a, c, g, or t
  misc_feature (424)..(424): n is a, c, g, or t
  misc_feature (452)..(452): n is a, c, g, or t
  misc_feature (455)..(455): n is a, c, g, or t
cgaagtgtcaatgatgggggacaaaacgccaggcggatctcagaaggccagttcaaagacgagatcatcagatgttcattcatctggatcttcagatgcacatatggatgcatctggaccctcagatagtgatatgccaagtcgganacgacctaagagcccangaaaacntaattataggaatgaaagtgcccgtgaaagccttngtgattctcctcatcagaatctctcaagaccncttctggaaaacnganancttaaagcnnttcagtnnttgnnaccnantgagtacagctacagcgaactttangtaaaanaggaacaggaangnanttaaagaacacanggaggantgcannaggcnnnctgctgnngatttatgaggagtntcttgctgnnttttgaangnangtgntggtnananacgtgaaaccattgtgcgagggggtgtngtnaatgcagctacacagaagaacatgaaacagatgacaaaaagaggtaaaatctcataagccatcttcacagatttgcagctcaccaaaatcctccaaatcagtcttccaatgcaagaccaccatctcttctgtgatagcaacacacaaaaactccacttcacacacgggagaagaccagaacaacgccaccaccagccaattggggaaactctctcaacagacagacattacaagcacattccacgaggcccgtgcatgagacgacctaacacacaagggcgatcaacctccacctgaacctcctcagcccatctgatggtcaccgcgtgcatgcacgccttccagaaacaatcatactgctgaagatcgcccggctcccattccgcaatcactaccgtctcctgaccttacccagtacccg

SEQ ID NO: 535355 - DNA, 294 bp, Homo sapiens
  misc_feature (1)..(1): n is a, c, g, or t
  misc_feature (9)..(9): n is a, c, g, or t
ntctctagnactgggagcaactgctttaatgaacttatttttcctttcagtaagaaagtctgcatagttctgaatagctcattcttttggcttaacatatatcttaaagtagactttcaaaaatgttggtgacttacaatatgaattctccgtatttatataacaacattctcatactggcgaatttccaaaagtatcattgcttggctaatcagttttatatgtgtcttaaattttcattgtcagatatataatttgcccgtaatttgacagttaattgtggctaatttctta

SEQ ID NO: 535356 - DNA, 130 bp, Homo sapiens
  misc_feature (14)..(14): n is a, c, g, or t
tagccgatgcttanctggttgactgcatcttagaagtagtagcttgaaaaagaaaatggtattaagaagattataaggaagagaaaatatacttactattaactaagtggaagtagacgatcataaagat

SEQ ID NO: 535357 - DNA, 633 bp, Homo sapiens
tgcagtggctcacgcctgtattcccagcactttgggaggccgaggtgggcggatcacaaagtcaggagattgagaccatcctggctaacacggtgaaaccccgtctctactaaaaatacaataaattagccgggcgtggtagcaggtgcctgtagtcccagctactcaggaggctgaggtgagagggtcgcttgaacctgagaggtggaggttgcagtgagccgattgtgccattgcattccagcctgggcaacagaatgagactttgtctcaaaaaaaaaaaaaaaagaaaagaaaagaaagaaagaaaccttatgagggagacctggaaggagggggttgctagcagacctgggcatctaatgagagtgggtctagagactgtttccagccagtatcacaggtttctctggcttcagcagctccaagccttccagaagcttcagcagggactgactgggataaataacgtagtgccttctttttttttttctttttttttttcttttgagacagcatctcactctgttgccccggctagagtatggtgccgtgaacctcgctcactgcaaccttcgcccttcttggttcctacttttcttccctcactcttcttacacctctcctcttcct

SEQ ID NO: 535358 - DNA, 1349 bp, Homo sapiens
agcgggtggagcccggcgccggcggtggtgcccgggccggggggttgcggcgctcaggagaggccccggttccgccccgggcctgcccaggggagagcggagcggtccgcagccgggtcggggtcaggggcccctcccgtggaggagcgtaggagcggacaggcaggcagggcgggcgggacagaaatgtgatggaaaggaaattggcatagcctgtggaaaccaacgaaaagtgcagggaattcatggaaggccaaggttttaacttgcgagtagggtggtaaggttaaggtggaacccactttaataggtgagtctttcccaaagacaagaaggctttgttgccaggcggtcgtgaatgtccttggaggttgcataaagggaaggtgaagcagacttccccggagaaaacataggcggaattggaccatggggaaaattcggacaacaggaaacaaggttgaagccagtaattggaaaacttagaccgcaagtggacagcaggccacctccattaagggggcaccatgtaacaacattaaggggcatttacccttagggacgataaggcctgggggggaaaagccgccggccacacggaaacccaagggccacgtgggcaagaaaacgctgggttccccacccacagagttgggcagcggaattccgatcagccggcaaataggaaatttgcccgtgttaattccacaaagtccgaccctttaacacacaggctggaaaccggaacggttaagagagagagaggtgccccactacatatatgtgggcgaaacgaacagagttggggccaaggagatgaataggaaaagagggagaaggggaccaacggggcaaggagaagcaaccaggaccagaaggccgttcagagtggacagaagagccgcgcatcagaagttggttcaaagaggtgagcattggcatataggacgaaaagagaccctgtacgggagacttcgggcacacccgaggaagcaacgcattttgggcgaggcaaagacgggagtgaaaggactgggggcccatcacgtgggattacccacagctatataggtgggtagcacgatgacgtgcacaaggacaaagcactgagtaggtggcccgccagtccaattcttaccggggcagagacattagggggaagaaccagcaagggcacgcaatattacccctagagaaagggattccccaaagaggagagagcatttgtgcccaaatagcaataggccgacaggaaacaggcacccagacgtcacggaagcgcatcgacaaaaagataaagccaacaaagttaatagtgggcgcgaatagaaacaaagagagcaacaagt

SEQ ID NO: 535359 - DNA, 1006 bp, Homo sapiens
gcggtcagactgttccggcgtatgttggcttgccctgcggccggcctccagccgagccttctgccggccctgccgcgatggaggtgccccagccggagcccgcgccaggctcggactctcaagtccagcaggcgtgtgcggtgtgcgcccaagaagtctcgaggccaacttcccggtgcctccatgcatgggatctcatggcctccatggtagatccccgtgtgcagaggctggcctgcattcctcgccgagtcaccaccctcaccccaaaccatgcacgcacctcgccaggggctcaagaagcagaaagcaccaaaggacgtcaggtagtgggacaccttgattctatcacgacaggcccgcacaggacgggctgaagaggcacagcttattcccctgatccttcggacggagggcaattccgagaaattccatcccgcatgatcggtccgtgacatttccataccagaattctttcgtgatagcaagggttcttctgacattaggaatttccccccagtcgccctattgagaaaccacccaacaattgtgcggagacggcgaggacgggtttagaaaaccaaggggacacattcccaaggcagagccacagccgggaatccattccggacagacgaagtccacgaatttggccccattcaaggaccggcttcacaagatctaatagcccgggtgcagggcgcttgcttgggaccacaagcccccgatgcatataggagaaacacaattccaaccaacaagttccacaagtgcggcccccggaagagacggggacaggacaggaaagcacgaggagcagggccacgagggacagagtgcccaagacgagcttctggagggaaacgcaacaacggacagcacaatgagtgcgaatataggaacctatcacagaactgtccattggaacagaccaacacaattacacaagcattccacaaaccaaatggactctgggcaggagttgaggcccagcgcgcatcgaaca

SEQ ID NO: 535360 - DNA, 266 bp, Homo sapiens
ccagcgctggacaacatatcagaaccctgtctctacaaaaaatggagtgtggtggtatacaccttgtagtcccagccactcgggaggctgaggtgggagaattgcttgaacctgagaggccaaggttgccatgagctgagatcaagccactgcactccagctggggcaacagatgggggactctgtctcacaacaaaacaacagggaaggggaggccgggacagggggaccacaccttgtacccccggcacttgggcgacggcaaa

SEQ ID NO: 535361 - DNA, 1063 bp, Homo sapiens
tgcccataactttctcacaaagtacttcttttattagcacattcagagacattttatatatatgtcttgtgtgcgtgtccttcaaacttccaatcttcactttgtctcttggcagattgttgacacgcagcttgtctaggaaggggcatggtgactagcattctaacaattttatttgggaccatgggaatgatagttgggaaagaaaactatttgcacacgagcagattttctatgatactttttgctgtctagttttactgtaatactttattgaagcatttatgagcaaattatttattggttgtaacgcctatgaagtgattctttgagaagtttaatagagacttgaggcaaaagacagtacaaaatacactggcacttgaatgttgaatgtcaccgtatgcgtgaaattatatattgcggggtagtgtgagctttaatgtataagtcatattagactcttgaagtcaaatgaagcagagcccgggcgttggcagtgtagccataactttctgatgttcagtacataacaaaattggcgacttgaacattaaatcatgccaaggtttggatacacttgtcttacgatattaatgaaacacttcgagacagactgatgtgaaggtgtccaggatttctcacgaatgtgcggcaggtggtggaattcaggtacacatacgagccgcacaaaaccaggacctgcagaatacactctctgggcactttggccaattcccaccaaacattgtggccaaccatccgcacgttaaggaccaaagaccagtgaactgtgatacaccttgcccacgcaaaatcagacacctttgtgagagcccacggttttatatcaaccaaacaggcaaaatatttacgacagatcaaaaagaggggtcggaccaacacaatctgcgatgggagatatcacaaaatttgtcctagaatttgaaacgaatcgtgacaccaccaagctacgaaggcacatatcgacatagtgaccataatggtaacaaggaacaagacgagtaaccacgaagtctgatgagacagcacataatacgga

SEQ ID NO: 535362 - DNA, 318 bp, Homo sapiens
gctttttgtcacctaggtagtatatctatccacctgcctatcccagtgttttcctatcctgagtgtgctcgaacgaaccaagagaaaggatatcgctcaggtcctattgtcagaccctcctaaaaaacagaccacatattctagaatggttactgttcagagtctatcgttactgttgcaggaagcagatcttcatttcggaaaaggcagtaataagaaccaattcgttgacctggaattttgagcaccagagatcgcacattacccagtccttcaaagactgcagctcttgaaagatcgctgagcactgaaaactgc

SEQ ID NO: 535363 - DNA, 192 bp, Homo sapiens
tgctgctccctcttcagctgctcctcatactcctggatgttctgctgcatcttcttcttctccgcctgcaggtgctggcagtgctcctacttctacctcaacctggccctctaggtcattggcagatctctttctaattcctggcttctatggcgggtcaggcgggccccggagctccttcaagcctcgggc

SEQ ID NO: 535364 - DNA, 111 bp, Homo sapiens
tggtcgatctagagatccccactaaggcctgaattgaaatgggacatcagttattgaattatcttgcactgggaagttacagcagatgccttctaatacatgtgggatgtc

SEQ ID NO: 535365 - DNA, 488 bp, Homo sapiens
  misc_feature (420)..(420): n is a, c, g, or t
atactatgtcgaggctccttatcaatgcatgtgtcccctgaatccccttcttaagtaggagggaaaaaacgtattccatatagagttggtatgtgggaaagttgtgttttttgttttgggggtctctttagtttttttatttaagagatgggttcttgctctgttgcccaggctggataagctttggttaatgcaaacgacatcttatactataagagatacacagagatatactcacagttggggggaaatgtcttactaacattcaggtacttagtctcaaaaatgaagctactgaaaaagcttcattctcatggaggatgggaagagttacatacatgagcaactcaagggtttttttttggtggtggtggtggtaggtaggtaggttggagacggagtctctgtcacccaggctgnagtgtaagggcatgatctcggctcagtgcaacctccacctccaggggttcaagtgattcttctgcctc

SEQ ID NO: 535366 - DNA, 102 bp, Homo sapiens
ctactacccacggaacacacgctactacccacggacacacacgctactacccacggaacaccacgctactacccacggaacaccagctactacccacggaca

SEQ ID NO: 535367 - DNA, 1043 bp, Homo sapiens
tgcccttggaccataaatttttatgggcaggtcaggaaaagagccgggggtaagggtcccttccttcccatccctctacccagaaagacacccttccaaaggacagcaaaagccccagaagcctgtgctgtgccttcaaaggaccttggaggcagacaaaatggtggtagttgatcttccgtgttccctcgagcaggctgcggtagggtggcaatctccgtgctccagccggaattgtgatgtccagtgagccgtgtggatactccgtgattctgccgttcacttttcagcttcgcacattcgcccaggcgtggggcttcaattaccgtgtgattcagggccgtggattttgcgccagcgtgggcctccaaaaggcgcgccttcgcgtttctgccagtgtggtgtcttttccagagggcagcttctcagtgcctcaggcgtggtgacgtgcagctctcaactctcaagaacccgtgaaggggtgcgccgcgaggttcagataaccttcggacctgctcatctggagctgcatccggtggtggccagggacctcccggttcaatccttcagatccggcgtggtgaaccaggcttaagaatcctaccggttctgctcggcaatgacctcatatggggctttcgatgtcactcaggattctgcggaaaattggtgcccggaagcagaaatccaccttcacaatgtgtaccggtgcccacatttgggcccctaagggacagtgatatccaccacaggggactcctaggggaggacagtttcataaagcgcttaaatggaaatccagaggggatcatctggcaagggtacatgatctacgaccccgtggagagggagtatatatgggcaccaacgacgatgaggaagcagtttggtatctacaaagtggcgagagatgcgtgcgacaggatgattcataggaaccgagatgtcattgggcaaatatactaccgggatggtataggattaacgaggagcgcgaatcatgagagaataattaggagaacattagaagagtgttattctcg

SEQ ID NO: 535368 - DNA, 363 bp, Homo sapiens
tagaaacccccccggagacaactttaaatcaccaatgctcacccaattaccattatcggacattgagcctgacaactgttgggtttcgggccgtctaactaccatatgaagctagaaaatgcacaaacgatattccttatctgtaattaaaatacttaaaattggcaattgtcagatcttgataaaacgggttgcctaatttctcctcatcatgaacggaaaaaaaatcagaatttctatctttgatatctaagtgtttggaggattttaaaactgaattttatctgctataccagttatttgagaaagtttgattccaatgtaaatcatttaaaagggacaaaggtataatttccagggatt

SEQ ID NO: 535369 - DNA, 446 bp, Homo sapiens
  misc_feature (48)..(49): n is a, c, g, or t
  misc_feature (52)..(52): n is a, c, g, or t
  misc_feature (64)..(64): n is a, c, g, or t
  misc_feature (66)..(66): n is a, c, g, or t
  misc_feature (68)..(68): n is a, c, g, or t
  misc_feature (73)..(73): n is a, c, g, or t
gctgcacctccacgagagctgcgtgctgtccctgaagtttgcctcctnnggncggtggtttgtnancnccggnaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcccaaaaaaaa

SEQ ID NO: 535370 - DNA, 346 bp, Homo sapiens
taccagactactgagataagaataatgctgttattaggcataattggtacttcatagccgatgacgcatgtgagcgaatagaactgaagtgttagaaaattggtctatgcctgcaagttaaaagcatattttccatcaatcacggtctaaaggatattcttttagaattataattctcttgcacaaataaaaatttactgacagtggagatcgtggggaaagagtgaggtattaagcactgttacgttggagaaagagaaataaatcaatgagatggcagtaaagcagtttatgcagagatttaaaaatatatgtaggggaagtcctagccagggcaatcaagctt

SEQ ID NO: 535371 - DNA, 103 bp, Homo sapiens
aagccatatggtcccatcttgtttctaggttccattacaccacgaccttacttgctgggttaaattaaaagaaaatttggtttaaagcaagaagggattgcaa

SEQ ID NO: 535372 - DNA, 394 bp, Homo sapiens
gataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccatctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaaa

SEQ ID NO: 535373 - DNA, 897 bp, Homo sapiens
cggacggcagcgcgtgccccgagctctccggctcccccgcgtgcgtgagccgaggcagctcggagcccgagtcgcgagggctcagtcgagcgagtcgccgaggagcgagccccgcagttagctagagccatggtcgggctggaaggccatacatcgacaacgctcatggctggacgggacgcatgtcaggacgcggggcattcagttgggctacagaggactctgcccgtccggtctggggcacgctccgatctcgctcggagagaagcgttcgttcataccatcatcgccagctgtaggtgggtgtcctggtttggcaaagaccggtctcgtattttttactgtgtaatggggctagacactgtgtgtcggccatagaagtgatgctgaggtgatgtccgaggacatcgactgtgcatgctcgcgatgtgagcgaactttaagcattgcggcatccaattccgttactcataggaggacacctgagttggggacccacgcacctttcaatagtcatctgctcactcaagaactgacatacgcacgacgtagtcctgactgtattgggctaagacatggtgtccaccggatgggttatggtcaaccaagcagatgttatgatacttgggccgtactcctagccttctgggcgttacccagtaactgagccgtcgtccttgctcctcggtcgcccgttgtaccagtctaccctactagctattgctacagctcttttccttgtccgcaataatacctctgcgaatacctattgtggagtaagaactgggtcccattgacccgcgagtacccactgttattgctggcccgaaaggccaacagtgggcttgggggcctagggacctgtagtggtcagacaccttcactttacacatttgc

SEQ ID NO: 535374 - DNA, 112 bp, Homo sapiens
tcgcaaggatgagaaattgctctctactgttgttaggggatcactaattcctcctcttacctctttctcctcctcagtgatctccggtatacggtaagcatctttttgctac

SEQ ID NO: 535375 - DNA, 177 bp, Homo sapiens
gcggccgcgtcgaccagacacttactgtgtctgtttcacaaagcatgtcactacagcgccgtcactctgatgtcaccaactgcatatgctctaatgctgctcacagtcatgtcttcccatttacagcgaactcaatcccatggagaatgccacaacaaagaaacttgttccgtagac

SEQ ID NO: 535376 - DNA, 609 bp, Homo sapiens
  misc_feature (1)..(1): n is a, c, g, or t
  misc_feature (103)..(103): n is a, c, g, or t
  misc_feature (288)..(288): n is a, c, g, or t
  misc_feature (295)..(295): n is a, c, g, or t
  misc_feature (306)..(306): n is a, c, g, or t
  misc_feature (311)..(311): n is a, c, g, or t
  misc_feature (316)..(316): n is a, c, g, or t
  misc_feature (326)..(326): n is a, c, g, or t
  misc_feature (336)..(336): n is a, c, g, or t
  misc_feature (364)..(364): n is a, c, g, or t
  misc_feature (371)..(371): n is a, c, g, or t
  misc_feature (379)..(379): n is a, c, g, or t
  misc_feature (390)..(390): n is a, c, g, or t
  misc_feature (407)..(407): n is a, c, g, or t
  misc_feature (427)..(427): n is a, c, g, or t
  misc_feature (475)..(475): n is a, c, g, or t
  misc_feature (486)..(486): n is a, c, g, or t
  misc_feature (488)..(489): n is a, c, g, or t
  misc_feature (497)..(497): n is a, c, g, or t
  misc_feature (609)..(609): n is a, c, g, or t
ntggggggggggcgtgaggggtctaggtggggatgacagataccagatatgcaccgtgcatttaaacccctccccaactgccttcccaacccaacaccagagnggcacccccccacccccatctcctgccactgccctcaggctggtggctttacagaggccaggggaccagggtgagggatgctacagtttgccccatagacaaggacaagaacccttagatgagtttggctgcgaggcagggcgatgggaaggaaggtagcccctccgcggagacatgcagggggnggcccangggaccttggnagggngtgangaggtggggntgagcctggngaaaccctaccagttagaaatctaaggnaagggtnccagggtnccctccaagcntgcccacccccacacanatacacacagaaacacgggnaaaagacttacaaccctgagcacaccccaatggggttcacacgccggngtgcctcaggngnntctggggngcttgggagggggctttcctcttaggccaagactcgcgctgaaagagatgctgccttgtagtgaccaggccagccctctccaggctggggagagggacagccaaagccaggn

SEQ ID NO: 535377 - DNA, 565 bp, Homo sapiens
  misc_feature (63)..(63): n is a, c, g, or t
  misc_feature (98)..(98): n is a, c, g, or t
  misc_feature (137)..(137): n is a, c, g, or t
ggtccgataattctctcagcttgaattactccgctgattgtgacagataaatcgaaactgcantcatcattgtagaaaactgtttatccatcatctanctactattcttgcgttatcataagaaaaagaggttgtgnctgtagcccatgctgtttatcaagcaatgctcagcttgaagaatattcctgttttggagactgcctataagttaatattgggagaaatgacttgtgcccttaacaacctcctgcacagtttgcaacttcctgaggcctggtttgaaataaaacatgaggcttttaagaatcatgtgttcaatgtaggcaatgcaaaatttgtagttaaatttggcctcagtgccctggctacaactggaaatgccaaaaacttgagtttttaattgtaaagactttgttttatccccagttaagccttttttcattacatatttaagtatttccctgtcatgtcaacatgtttgcagaatccctgtatgtaaccaacagccatatttaagacatgcctggattaataaaattggtaggaatgttttcttgcccttata

SEQ ID NO: 535378 - DNA, 679 bp, Homo sapiens
gaggggaagaacctggtccttagtaacaattgtttcccctaaaaccattttctttaatgccgccttgattataaagcataagctagccccccctatggtggcgctaacattttaccatgcgtgccctttttcagggggatataacccgccggtttattgatttcaaacctactaaaagcataggtgtgttgagatttctgtgttctccactcttccgctgttatcctagtaaaagcctcaggggctgggaacaatttctttccaaagcaaaagagaaagccatgccttgggaccgagaactaagcatcacaaggaagttgcgcccaacatacagaacatgaatcctctgagctgtcctcaaaagaaagccccaaccaccataaagcacagtgttttcccttgttggtgaaaaatgtcaaggagtaaaaaacaataatgatcccatcatgataataggaatgaacgtgtctgcaactaatgggagccacatagtgcgctttcactctttcagacggcttgcattctgtggatgccagctttggaatcagagccgcctctgaaatacctgtgcttccatagttagcttttgaacagttaccttctttctggccatctttacttctgccccacatatgctttttggctttgtgcagtctttaacatgttagtgaacagccca

SEQ ID NO: 535379 - DNA, 985 bp, Homo sapiens
  misc_feature (35)..(35): n is a, c, g, or t
  misc_feature (203)..(203): n is a, c, g, or t
  misc_feature (300)..(302): n is a, c, g, or t
  misc_feature (307)..(307): n is a, c, g, or t
  misc_feature (384)..(384): n is a, c, g, or t
  misc_feature (389)..(390): n is a, c, g, or t
  misc_feature (399)..(402): n is a, c, g, or t
  misc_feature (404)..(404): n is a, c, g, or t
  misc_feature (406)..(406): n is a, c, g, or t
  misc_feature (430)..(430): n is a, c, g, or t
  misc_feature (433)..(433): n is a, c, g, or t
  misc_feature (437)..(437): n is a, c, g, or t
  misc_feature (442)..(445): n is a, c, g, or t
  misc_feature (447)..(447): n is a, c, g, or t
  misc_feature (456)..(456): n is a, c, g, or t
  misc_feature (459)..(459): n is a, c, g, or t
  misc_feature (466)..(466): n is a, c, g, or t
  misc_feature (481)..(481): n is a, c, g, or t
  misc_feature (483)..(483): n is a, c, g, or t
  misc_feature (487)..(487): n is a, c, g, or t
  misc_feature (489)..(489): n is a, c, g, or t
  misc_feature (577)..(577): n is a, c, g, or t
  misc_feature (589)..(589): n is a, c, g, or t
  misc_feature (888)..(888): n is a, c, g, or t
  misc_feature (890)..(890): n is a, c, g, or t
  misc_feature (894)..(894): n is a, c, g, or t
  misc_feature (903)..(904): n is a, c, g, or t
  misc_feature (911)..(911): n is a, c, g, or t
  misc_feature (919)..(919): n is a, c, g, or t
  misc_feature (922)..(922): n is a, c, g, or t
  misc_feature (985)..(985): n is a, c, g, or t
gtgggaagcaagccgagatggcggcagcagcgctngggcaacccggctgctcctgctcttgctgatcgcgcggtagcagcgcccagtcgagcccggggcagcggctgccgggccgggactgcgctgcgcgaggggctggggcggaaggtcgagagggcgaggcctgtggcacggtggggctgctgctggagcactcatttganatcgatgacagtgccaactctccggaagcggggctcactgctctggaaccagcaggatggtaccttgtccctcgtcacagcggcagctcagcgaggnnnacccnggccgactccgggatgtggcagccctgaatggcctgtaccgggtccggatcccaaggcgacccggggccctggcatngcctnnaacctcgcnnnncnanctctcctcctttcccccctccccnccncccncgccnnnncncccaccctntcncaccacnctcacccctcgcacntngatntngccggcaacgctggtgggcgtgtcggtggtgacgcaccccgggggctgccggggccatgaggtggaggacgtggacctgaagctgttnaacacctcggtncagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccagccccttgtcctctgccttctgctggcagaggagcagctggactggggcttttgcacagcagccggtgncncctncgcccgcgnnccccatngccccatncancccaagggcttccccctgcccatggagtagagccgagatcttgccactatgcagtctgactcn

SEQ ID NO: 535380 - DNA, 229 bp, Homo sapiens
cagaatgccctgttgggggcttcaggtctctgtgggtgggaatgcaagtgaacttgggagagggcacgggcctgtagatcagggaaagggctgatgatcccctctctgtggatgcaacccgttgggtcccttactgcaatcccccagccctgtaacaaaaagtgcccttaaggatcaccccagcccccacagccttggaataaatttcgcaatttgtttcctaaaaaaa

SEQ ID NO: 535381 - DNA, 378 bp, Homo sapiens
ccccctgggggctccccagtcagctggaaatctttgaaaggaacccttcaaaaaagtgtgtggaatttgggttttcttgcgttggaactaccatgcagagctccaggaccaaaacctcggtcaggagcaggagtggtgtttagtaaaaacaatgggcgcccagttcttcccagcctggccccgtggggagaaacaaaacacgcctcctttcatggccctccaaagtctttttgggcccccttatttggacccttaatgggagttattattattgttattttgaaatggagtttcgctctgtttcccaggcggaggttgcagtgagccgagatcgcccccctgccctccagcctgggggctgagaagactttgtctcca

SEQ ID NO: 535382 - DNA, 668 bp, Homo sapiens
  misc_feature (87)..(87): n is a, c, g, or t
  misc_feature (92)..(92): n is a, c, g, or t
  misc_feature (106)..(106): n is a, c, g, or t
  misc_feature (544)..(544): n is a, c, g, or t
ggcctgcctcgcaaacattgcgcacgggcgtgctccaccccagcccaatctgggatagctaatgttgcaagatttgctgcggcagcngtttnggattttcagcttnccattcctgctctttcgtgccgactgccgtcgctgtattgacgatcggtgtggcggacattgtgtttgtcatgtcttgcaccgagatcgaggtactcccattttcaactctgcgcttaccgtctcgaatttgttcttggccttgcaacatcccgcccggcagttgggagtttgcaaacgtttctcggagcccgctgttatcccaaggatccattcctctggagagattatcgagagtttgctgttgtggtgcaccagtaggtccaacctgatctgcgctaacgcccggaacgttagttgaaggcatgccaatgtctgcatttgcgacattgcccccggggttgttagagacctgcatcgcacgattgccgaccccttgtgcacgctcggcgttgccgtcagtaggcccactgatggaaccactttgcatagccgaaancacaccggcgaaggccgtgttatcaaccgatcttaaggcccatagctgcgctgcttcccgtttaccttccatgccgattgatcgctggacataacgggttcgagttcaggaactttggttgaag

SEQ ID NO: 535383 - DNA, 452 bp, Homo sapiens
  misc_feature (86)..(86): n is a, c, g, or t
  misc_feature (119)..(119): n is a, c, g, or t
cagtggcttgcgcctgtaatcccagcacattgggaggccggggcaggtggatcacctgagtcaggagttcaagaccatccaggccnacatggtgaaaccccccgtctctactaaaaatncaaaaaaaaaaaaaaaattaaccaggtgagtagctgggattgcaggcgcgcgccaccacacccagctaattttgtatttttggtagagacgggatttctccgtgttggtcaggctggtctcgaactcccgaccacagttgatccgcctgcctgggcctctcagggtcctggaattacaggcttgagccactgtacccggcaacattctgtcttaaaaaaaaaaaacacgggccgggctcagtggctcacgcctgtcatcccggcactttgggaggccgaggcaggcgaatcacgagacagatcacctgggcaagagagggagactccatctca

SEQ ID NO: 535384 - DNA, 615 bp, Homo sapiens
gcggtactgaggagatagcaggacgtggagcacatcctccacagcccagattctttcatttttttgagacaggatctcgctctctcacccaggctcgagtgcagtggcatgatctcggcccactacagcttgaactcctgtgctcaagtgatcctcctgcctcagcttcctgaatagctggggctacagacacatgctactgtacctggctaattttggtattttttgtagagatggggtctccctatgttgcccatgctggtctcaaatgcctgagctcaagcaatcctcctgcctcaacctcccaaaatgctggaggagataagcagggacgtggagccatatcctccacagcccagattctatcatttttttgagacaggatctcgctctctcacccaggctcgagtgcagtggcatgatctcggcccactacagctttgaactcctgtgctcaagtgatcctcctgcctcagcttcctgaatagctggggctacagacacatgctactgtacctggctaattttggtcttttcggtagagatggggtctccctatgttgcccatgctggtctcaaatgcctgagctcaagcaatcctcctgcttatctcct

SEQ ID NO: 535385 - DNA, 345 bp, Homo sapiens
  misc_feature (155)..(155): n is a, c, g, or t
  misc_feature (181)..(181): n is a, c, g, or t
accacttttttttttaaagcttttatattttaaaaaacgtatcatgcaccaactgtgaatagctgccgttgcgcagaggacccggggaggggtcccgagaggctccccatgcaacactggaaatgactgttccagagagcgggcagacctggacnagcagcctggcgcctgagactaccancccattccgttcctgccagaaacgaccttcctgtgccggatggccatgggggcccctcgcagccaactcacccatttttggaactgcttaggaccccatgggggctgaggggggccagtgggactctggaatcttctttataataaaagcttacggacaaacct

SEQ ID NO: 535386 - DNA, 376 bp, Homo sapiens
  misc_feature (87)..(87): n is a, c, g, or t
  misc_feature (92)..(92): n is a, c, g, or t
  misc_feature (106)..(106): n is a, c, g, or t
ggcctgcctcgcaaacattgcgcacgggcgtgctccaccccagcccaatctgggatagctaatgttgcaagatttgctgcggcagcngtttnggattttcagcttnccattcctgctctttcgtgccgactgccgtcgctgtattgacgatcggtgtggattgtcagggcgcgttgcgtttggatgtcggtggcgttgagaaaatatacagcggtggtgagctaagcctgaggttgcgtgatgattcttgagctcgactgtggaaatagctttatcaagtggcgtgttcttgagtcgagtgatgcaagtgtccgcgccgaaggcatcgcaggttcggatattgcgctgatcgacagtttggtggctttgcctggtc

SEQ ID NO: 535387 - DNA, 909 bp, Homo sapiens
ggaggttcaggctacggtgagcctgaagccacacagtgagccatggaatgtgtgcagagcctcagcgagccccactgaagaggaggatgtatggaatgaggatgcactctggcagagcctcgtgccctgcactctgctccaatcctgaatggggctcgatgtgacctgtggcatgtaggtggcacatggccatgctgtgtggcagcctgcagctgagggtgatggtgtgaggcacgccagtgctgatgactgggagcctcaagcacttcagtgatgcctggccctaagtcctggcagtgtgcccccgccagcccctgaggtccaaattcggacaccaagggtcaaacatgtccatgagaaagtgattatctgcctggaccctgtcacgagcgaatatgtcactgccagaagctggagctcgctccacacaggactccaaaactcaacgccctcaatgtcatcccagaagatgattgcacgatggtacagtcgcgtgacaaaaacacacgactcgacacacagccacgagtatgcacttggtgttgcgtcaaccggatgataacggcctggcttgctctggcctgacctcctgaccccgacgagctcatggacgcctgccatctaatgatctggagacggactacctgttccagcctatacatctggcacgggactaatcaagctcatccagctagaacccttgtacctaccggcccacagagaactgtcgccatactcattaccccgggcaatacatgtgcgcccgtaagcatcacttcgctatacagccaagtacacacttagacattgaccagaattaaccatttgatcggaccccctcataaacctctcaccatgttggaccaaataatctatatatgactacagtaaaattcgcacattgactag

SEQ ID NO: 535388 - DNA, 174 bp, Homo sapiens
cgctgatccagcagctaggaccacaggcacacgccgggccacattcagctaatttttttgtatttttagcagagaaggggtttcaccgtgttagccaggatggtctcgatctcctgacctcgtgatccgcccgcctcggcctcccaaagtgctggatcagcggatcgagtgggt

SEQ ID NO: 535389 - DNA, 854 bp, Homo sapiens
ctgggtctccccctctggcgaacgagcatggtattcagagccggaatttcctgtcgaagcaccccgtggtaacacatagggtctgcgcaactgccacttcggtgctactcacacccgggtagcagaaaacaccacatatttctaaaagaggtcttcttcattggcttgtcgaaacattccccccactaggcgtgccacattgttctattgcgcacaaagggcggcgtgggaatcattcaagaccagacaaactcttgttgtatacctagaggggataacaattcccacaccccccccacttaggtatgccttcctccccatcccgggttgtggcctggagctcgccacaaagagaacccttttctaacacagggggcatgcttgccgtttcgcccgcgcaaagcataccaactacaaatgaattggcccccacaatcgcgtgcgtggtcgtatagataaacacattgccgtacctcgttccaactaaacacgtacgatatacaagaaagatacaccccttcttttttttctatacaacaaaggagtatctctcgcgcgcgaacaagattttgttttttctggaaaatacgtgtggcctgcgggaggttacaagaaacatatgtgcgcaacactgcggatcgcttattgatatacactcggaatgacgcacacccctcttaccaggggccactgctcttctcttctgatgcaaggaatcctgcgcgtgcctcacggcagacagataacgagcagcccgggtgatcattatacacggtgctgttcagcaccgcaaccatacggtcaccccgctttcgtgctgcacaatgcaaacacaaggttaaacgccacaaaac

SEQ ID NO: 535390 - DNA, 197 bp, Homo sapiens
ggttgttgctgaggtgtctagaggatcccgtacatgcccggggagactggtcttcactctcaatgcagcgcacatagatctcggcagcgtcgccacagacacggcatccctgcacactctgccaggttcagtgcactcagcgccagggttggtggcatgtgaggtgccctgcctgtgtgcttccccaatggtgtgca

SEQ ID NO: 535391 - DNA, 292 bp, Homo sapiens
ccctcccaccatcttgtgaagcacaagacatccacgggtgctctccagtttggctgcggagactatagcaagccctaaagacccctgctgcctggacttctcctgggttgtgcttttttgggggcaacataccttggacaaagctgagctgacacctaatgtttattagcctcctacctaagacacacactttgctaaattcttgacctgtggaagatgatattgacagttataaaatctcacagccatttttcccattttaatgatggggaaactgtgtcatagaggatac

SEQ ID NO: 535392 - DNA, 710 bp, Homo sapiens
  misc_feature (413)..(413): n is a, c, g, or t
  misc_feature (484)..(484): n is a, c, g, or t
  misc_feature (630)..(630): n is a, c, g, or t
  misc_feature (641)..(641): n is a, c, g, or t
  misc_feature (710)..(710): n is a, c, g, or t
gtgaattttatcctgtcattatgatgttagctggttatttggctcgttagttgatgcagtttcttcctaaccttgatggtctttataatttggcatgttttgcagtggctggtaccagttgttcctttccatgtttagtgcttccttcaggagctcttgtaaggcaggcctggtggtgacaaaatctctcagcatttgtttgtctgtaaagtattttatttctccttcacttatgaagcttagtttggctggatatgaaattctgggttgaaaattcttttctttaagaatgttgaatattggcccctactctcttctcacttgtacagtttctgctgagagatccactgttagtctgatgggcttccctttgtgggtaacccaacctttctctctggctgctctttacattntttccttcatttcaactttggtgaatctggcaattatgtgtcttggagttgctcttctcaaggagtatctntgtggtgttctctggatttcctgaaattgaaatgtggcctgcctcgctaaggtgaggaagttctcctggataataccgtgaagacgggtttccatcctattccattatccctgtcattttcaggtacatcacacttattccaaaangaccacatagnttgaagtaaagccctcctagcaatttgagcagaattattaccctgctctcagaccacagtgcacccctn

SEQ ID NO: 535393 - DNA, 357 bp, Homo sapiens
cgcgagtgcgcttgcgccggtggtgggagctgtgagacccctgtgctcggacgggacagggtcgcgggacacgcacgatgagccccgcgaccactggcacattcttgctgacagtgtacaggattttcttcaaggtgcacttcgatcggaatgtgtacccattagcaggtgtcctctttggtcatggtttggaaagagaatattttaagggggaatttccaccttaccccctggcgagattagtgatgagcccataacatttaataccaatttaatgggttacccagacacgagctggatggcttcgatatattcggacaccatatagtgatggagtcctatatgggtcccccgctg

SEQ ID NO: 535394 - DNA, 180 bp, Homo sapiens
atgactcatagaggatcccgccataagggtagggggtgataaatactattctcatattctagtattacaacacttaccaattccaccatcaggagaaaaacctatttatatgatacttaaaacattaaatctctgattgtccaccctatagggaaaaagggcaactccactatacccatt

SEQ ID NO: 535395 - DNA, 105 bp, Homo sapiens
tagctcggtaccatcaatttggtgcagccgggccgccgatacgccgacgggagcgcaggtaccgagaggagcggctgagacactcgcggaacccgtcttccagag

SEQ ID NO: 535396 - DNA, 153 bp, Homo sapiens
ctgaacacattaatttgcctgtctgtatacaaggatccaagacaatggaatcaagatgggcattttcacgtctccctttgatctcttatgatgatcacatggtgtaacccaatgtgaactgtaatgtagagataaagtatttatcgacgttga

SEQ ID NO: 535397 - DNA, 279 bp, Homo sapiens
tcaggctgtacctctgttgtctaaaattaaggcggttctttctccccttacagaggctgctgaagaggagtctgatgatgaaatagcagataaggattctgaagtgggtgatttgttccctgtatatacatcggcctttatatcctcatactctgtaagaatgagaccttcatgaatgctttccttgttggtatatcgactaggatacttgggatgaagatgaggaggcgagtgcaagtgaaaaagatgaggacgttgaaaaagggaaatggaggatgc

SEQ ID NO: 535398 - DNA, 128 bp, Homo sapiens
tagagggctgatgtatctcggtgatggcagggaatgccatatccttcagggtagatttaatgattaattgagtcagggaaagggaaaagaacaaaccctctcccatcgatgacgactcagagctatga

SEQ ID NO: 535399 - DNA, 448 bp, Homo sapiens
  misc_feature (182)..(182): n is a, c, g, or t
  misc_feature (425)..(425): n is a, c, g, or t
agcgtgtgtgtgtgtgtgtgtgtgagagagagagagagagatagagacagggaaagagtgagtttaccaaaaaaataagataggaaggttgtcgtaacatcttccatttctcaacttctgaagtccccattttcatccctggagagaggttgttctagagatagggatatctaaaggaacangagaaaatcagagtaatggaattagctaaaagggaaagtggtgacctgaagaccaaacactaaagaagggggccgagtgaagtggcaagagaagagtgcagacgcaaaagaactatgcagggtagactggggtcctatgttagtgaagggcccacagggctgcgagggtaaacccgatgcaaggtgtcgaagtttaagtagagtgaaaatataagatgggcagacctaccacagcagaaccanacacgttggcatgtttcgtgatg

SEQ ID NO: 535400 - DNA, 705 bp, Homo sapiens
  misc_feature (576)..(576): n is a, c, g, or t
  misc_feature (584)..(584): n is a, c, g, or t
  misc_feature (667)..(667): n is a, c, g, or t
  misc_feature (696)..(696): n is a, c, g, or t
ctcactctgtcgctaggctggggtgcagtggtgccaccttagctcactgcaacctccacctccggggttcaggtgattctccttcctcagcctccctagtagctgggactacaagcacgcaccaccacgcgcagataatttttgtatttttagtagagacggggtttcaccatgttggccaggatggtctcaatcacctgacctcgtgatccacccgcctcggcctcccatagtgctgggattacaggcgtgagccaccacacctggccgacttagttctaaaggttccaagcagtgctatgaatgaactaagtagcatcctggcccctctcccaaacttctcacctacaatttatcacaaaagataaaacaactaaaactgaaaatggagaaaattattgcttcagttttttaatctaagctctgattcaaattttgcttctcagcctcaccagtcccacgtggctctcaggaaaaaaaaaacaaacaaaaaactgtatacacatcgcagaagcaagaaaacagaacacgttttctgccttctagttcactccccagaagccagagtaagatgantcccgcantccaacacaaaccttttaataaccatgttaacataaatttcaataaaaaagaactccaactttgctaattttgttacaaaaancctaattttttatctgaaatgctgctttncctaatttg

SEQ ID NO: 535401 - DNA, 226 bp, Homo sapiens
tcatgacaactaagcaaaaagtgcatttatatttcatacaaaatactgtgtttattaagatcctctgaaagggcatgattgtataaatcaagaagcatctgtaatattttgcttaaaaattctttattctttggctgcagtagtctagcagctatccacttagcagatttaaaaaatgtattgttgcagaatcctccacagttcttggtatttcagttatgactac

SEQ ID NO: 535402 - DNA, 727 bp, Homo sapiens
aagtagtgttatatacatgcccccgtagagattgagtaagtccgcttgatcacaggatatttctcggaaatagatcaatctcagacacaattggcccctggtaacacacatctatacagagacagaatttcgacatcagctgattcactaagtttccaacttcagtaaactgtgagctatggaatttttctcctggaattttccccttgatcacagggtccaattattctgttctagctagttgctattgttgagatatgtcgggttgatgttttgtttttttgttttttttttaaggttcaaatataagggcagaaaaattggaccagaaacgaagtaagataggattgggaaagaagttgactaagtgtgcttagttttaataagtaattccttctcttttttacagagaaggcgcttacagtaaattgttgtgcttagaattgctggatgcatttttaccacttccacacaaacctaacaaattttgtgacccctttcaacttacctgataagtagagaaagtggattcagtataatggataaggagggaaggtggaccagaatgaaaactgtaaatatttttttaacctgatatcacttaaatccgaggcagatatagatatagacattcaatggaattatattctatgcactttacaataccaccgtcatttaaccgcgtccagtatagatccaactttaacccgggctagcttcccaactt

SEQ ID NO: 535403 - DNA, 948 bp, Homo sapiens
gaatgagaccaaagtcatcaagcagtgctatcaagatcacgacctgtagtcagaatggctcagcaccaaccttcccactatgtgccatgcagctcttttcacacatgcatgctgtcgatcagcactgccacctgggatgcggcgcagctccatccaaagcaccattcagcatcagtcccagaaatcgatctgtgaccccgcttgtcttgattacgaatgtgtggagcatgcataaagcctaataatatacaactgggacattaaagcctgacgactagggttgtggttgctgcccacgccggctggatagtcgttcctttttctggaatgtggccccaggggctgaaagcgcagtggcttcctttgtcagccagtgtggctgctgctgaagctttgcaaaaggcacctgatgtgaccacacctgccccgcgaatgtcaatgtttgtcttctttcaaggggaaactttgactacagttggctagctcgaggatggtctacgatatggcagaagggcaagtttcccgtgcagtgtagagaatgtgacgtcagtttgtggagctgggtacaggtggcttaaggaaccttcattagagctttggatgcacacagatcctgttgctcagaaagaatgagtctgtacggaacccaggtggaggatctcctggcacattggaagacagacgtggtgctggtgtcctgatgttatcctcaggaggcaaatcaggtccaggctctcccaccaatttcctggagggattgttcagctcgaaactcctggggtgtttggtgaccctctggtgcttcttaaaattttcagatatagaaggcggggaattagtgggcaccagggtgaccgaaagactagatgataacatcaagctgaaattgcaggtaggggctcggaagagacacagaagaggacacagacgcggcgtaaaatgaacgag

SEQ ID NO: 535404 - DNA, 151 bp, Homo sapiens
gtcgggagccacatggtaggtgacctcttgactcctctcagggcagccaggtacaaggactcctctgctgagtgcatgttctggcaggcattcggctcacacagcctagtttccaatataaacacgcgctgcgacctgtccaacggtgccc

SEQ ID NO: 535405 - DNA, 374 bp, Homo sapiens
tgtgggtagcaagaatagcaataatatgtggaacaacaatcatagttttttttgtttgtttgttttgagaaacagtctcgctctgtcgcccaagctggagtgcagtgagtggcactgatctccgctcactgcaacctccgcctccgaggttcaagccattctcctgcctcagcttcccaggcagctgggactacaggcgcacaccactaagctcggctaatttttttgtatttttagtagaaatggggtttcaccatcttggccaggctggtcttgaactcctgaccttgtgatctgcctgcctcagcctcttgaagtgctggaattccaggctgtttacagtttttaaagtaaactttacatacggtgaaatg

SEQ ID NO: 535406 - DNA, 308 bp, Homo sapiens
tatctgatcactacctgataaccctcgaactatgcgtcagcacattgaatcgatagtctaggtgttcacacatactagtacgcctcgaccaggcggaggatccataataatccaccagtcagctggcaatcatgtcgtagaacgctagcctaagagccctaacaggggccctctcagccctcctaatgacctccggactagccatgtgatttcacttccactccataacgctcctcatactaggcctactaaccaacacactaaccatataccaatgatggcgcgatgctactcgaaagccccaagcg

SEQ ID NO: 535407 - DNA, 950 bp, Homo sapiens
  misc_feature (950)..(950): n is a, c, g, or t
ggttcggcggggcgcgcgccggcggctgcagagtctggcagtgctgacgagagcagtctgtctacctggtcgcgagcgatggcgcccgatgcgggcgccccgggcatagcggtggtgctggaggctgccgagggcccctggcgcgctcggccctcaccttctccccatgcccttgcgtagtagcccagccctggctcaggaccagacaagtgggggttccttggaagcttggtgcgtcgtagtcggtgctggctctccgtaagcaccgggatggctggtgcacgtccgacggtcttctgtggcaattccacgtcgaggaggcagtaaggatccctccatccattgtggactgctggggacagacccaggatctccaggtggacggttgcagtatgattgtctatcatgtatttcacttgcctgatgaatgagctcaactgaggagatgttgctgaatgcaatcttgcaggagggattggtcacgtgtagccccaaagtgaaacggccacgtgctcttcacagtgtgggtaactccttgaaccatgtctaaagtgattatagaatcaacgttgttttccctttgctcccatcgcgcatcctcgtgcgaccaatgggtggtccattatacaacttgttccatttgtttatagcggtgaacccccgaaactgtcttaagagaattacgagataccttagagtgaggccctaacacttcctcgtagcggtccatcaagcaagtaacaggcgtttgcaatagcttattccgaaggggcgaagtgaacaaagggtgttacgctatggagagcggttgcccccatagtggaacaagcaacgttggtctcttttccaacatgtttggtaactctaaaataggtccttatattggccgcgctaagcttttgggaataccttaacacagttatgggtttgtacttttaagaagaccacan

SEQ ID NO: 535408 - DNA, 592 bp, Homo sapiens
  misc_feature (559)..(559): n is a, c, g, or t
  misc_feature (576)..(576): n is a, c, g, or t
ttcaaggagcttatttcgtccatgcgagataatgcctgaccataacacaatcattaagcaacttattatccaaatgggccgttcactcattaatgccgcattcacgatgattaccagggccaaccctgtcaacgtcatcataatgataaaacggtgagaaccaggatcaacattaaataataaaccggccagcatactgattaaaaacatcgcgcccgcagtgctgaacacgatgataatggcatatacaggaactaaacttgcaacgacaatcgccaccaaagagagtaaaaacagatatattacgcccgcgatggcggcatttatcttgttgatatccttacttaagccatacatacaaagtaataataaccctatggcgacatacattggtggtgaatcatatttggttgccgtaatttcgatatacttagctccccaggctagtcctgcggttgccaccaaacctaaagcggtaatgagccatataccgtttaatatcctggcctcgtgctgaaaatctaatttattgctggtttgcgagtatgattccattctnttagttatccttagaanaaatattaatattcac

SEQ ID NO: 535409 - DNA, 340 bp, Homo sapiens
  misc_feature (35)..(36): n is a, c, g, or t
  misc_feature (45)..(45): n is a, c, g, or t
  misc_feature (58)..(58): n is a, c, g, or t
  misc_feature (80)..(80): n is a, c, g, or t
  misc_feature (93)..(93): n is a, c, g, or t
  misc_feature (95)..(95): n is a, c, g, or t
  misc_feature (123)..(123): n is a, c, g, or t
  misc_feature (160)..(160): n is a, c, g, or t
  misc_feature (225)..(225): n is a, c, g, or t
  misc_feature (239)..(239): n is a, c, g, or t
  misc_feature (241)..(241): n is a, c, g, or t
  misc_feature (251)..(251): n is a, c, g, or t
  misc_feature (290)..(290): n is a, c, g, or t
  misc_feature (313)..(313): n is a, c, g, or t
gaaattgtggaggatttaattaacattccctttcnncgggcaaanaatggaggtgganaagtaaatgtggtcaagtgttntttaggtcaaccncncatagcatactttgaagaataggcttancagaatcatgaaaactatagctttttaacccggattnctgtaaatgtttgccaaaaatgaatatgcttttccttaaaaaatgaaaactttaatttttccccnccctttatgtttananacaaaacttntttccatgtttttgaattttttttgtttcaaatggggcngcatgttttcaactccaataagngccctgtaataaaaagttttgtttata

SEQ ID NO: 535410 - DNA, 428 bp, Homo sapiens
ctggaggctattatcttaagtgacaactcagaaaaacatagtacaataaagatttttaaagaaccctcagaaacaaaaaaaataccacatgtttccacttacaagtgggcgttacccagggtgtatacagggtcatggagtgtggaataatagacactggaggcttggaaaggtgggagggggcgagggatgagcaattacctttagggtacaatgtacagtattttggtgatggttacactaaaagcccagatttccccactacacaatatatccatgtaacaaaactgcacctgtgaccaggtgtggtggctcacacctgcaaccccagcgccaaggtgggcagatcacctgaggtcaggagttcgagaccagcctggccaacatggcaaaaccccgtctctactaaaaatacaaaaattagccag

SEQ ID NO: 535411 - DNA, 666 bp, Homo sapiens
  misc_feature (366)..(366): n is a, c, g, or t
tttgggctgaccccccgccaaaactgttgcgaatacagcgagaattttccaacgaagaaggattgctcggtggattcaataaagagagtcttgtcgcttaggtaatcgccctgaagagcccccagcagggaccctcaccaacaaaaaagggtggatccgagtggatttactcccgtagattctcccacaaaagagtgttcaggagtgttgtgaaccccgcgcccagggtgtccccacacgctgcactctatgttgggcacacacacttgtggtacccaccactccgtgtgagtaggtaaacaagtatatgtacgcgcaatacaaggtggacatggatgtatacacacacgctgtgaaaattggtangtacccaacacactgacacggcgggacgacatacaatgtttgtgctaagaatacattcttagggagaggcactcagcccctccctttcttgagggaaatattgttgtaaagggaggttcctgtgctgattattttatacactactccctccgtacattctctaccacttatataccaagtctcttttagatacacacaccctgaagttatattaacacgcagagttattaccccccatactcccattactcaccccagaaaaaaaaaatattatgcaacaccccccaatagaacaaaaaa

SEQ ID NO: 535412 - DNA, 160 bp, Homo sapiens
ctgggcagatgagctaaaagatatgattcgccactctgaagattttcgcccctggtctttgtactacatgcctccagaaaccatgagctggaagcctgtagctggcctgacattggctggagatgcagcccacgtcgcaactccaaacggcgaaggtgta

SEQ ID NO: 535413 - DNA, 345 bp, Homo sapiens
  misc_feature (69)..(69): n is a, c, g, or t
cttcaccttctcccacttgaatgtcctaatataaatgtcaaaccttacatttccaaccctggtgtgggntgttacgcctgtaatcccagcactttgggaagctgaggcaggagaattgcttgagccctggcatttgagaccagcctgggcaacatggcaaaaccatatctctaaaaaaaaaaaaaaaattattcaggtgtggtggcgcactcctgtagtcccaggtatttgggaggctgaggtggaaggaattacctgagcctgggaggcagagtttgcagtgagcagtgttcacaccactacactccagcctgggcaatagagtgaaaccctgtctcaagcaaa

SEQ ID NO: 535414 - DNA, 689 bp, Homo sapiens
gtgttgaacgaagcaactttttatttaaaaaagctctgccctgccactgtatgaaagtctctttatgatcgtttgtttttttgtccattttgttcttttacactccagaaattttaagtttaaaaatatgcgcgaggaatgtatattggcctcctgcttcctcatcacgggttgctataaccctcggtgacctcggtatataaaaatgtattaaaaactcggggtttgttaccccccttgcctgtaactcttgtatatagaaatttttataaaattgtatatggcttcaccgaaataaattttattttttataaaagacaaattataaaggttttataaactcaccactccactattacaccccttcccccctgagaatgtataggatccctcttgtcatccggagatccaaaccccccgttcccttgtgaagtgtgctatatttagaacacgtcttaaaatgtacacgtgtattttatagaattgagagtttacacttcttattttccagagaatttatggagcgttgtagaaatgtaccaaagcatttcccaactgccttaacgcttgtatttttatagacaagttttttaaaaatcctaagtttttaaataactatggatttgtgtattttttttggttatttgttttattaaacatgtacatccgtaaagagttttaaaccatga

SEQ ID NO: 535415 - DNA, 957 bp, Homo sapiens
  misc_feature (53)..(53): n is a, c, g, or t
  misc_feature (152)..(152): n is a, c, g, or t
gagaagaggaagaagcggacacacccaccgcaaaaaaaaagcccaacacctcnagagtgcacagactctcttcttgaaccaccgcaacaggttttggagatcatattcattggaggacactggaagatgggaagaaagaagcagctgccagnggactgcccctgatggcgatcatccataaatcctgcccgtggagctagccaagccctaaagcccacatatccacaacctacaggaaattgcacaaccctcccataacccaacgaacgtcaaccgttttttttaaaccacgaaccccgaacaacacccacaaagggtcagccagggagcccttcccccccgcctccccttcacctgcccacccagcgtccccccgccccccccccccgcgcaaccacaaaccacaaaccgcacacccccaagccccccagcacttccgcgcacccgccatcctagacagagtaacaggcgacaacaaggcgcgaccggaccggcgcacgcaccgatgcgattcccacgcatcagtctccccagcccgccacccaccaacccaccgcgcccccccccccaacgtagtaacacggtacagtataagccacgccaataacataaccacacctccagcgcctcacgcgcggccggcgcacccaccgccccacccgactccccccgcgcccaccgccgtccagcgacacacccgaactgttccaagtgcaaccgcaacgaccaacacactgcaccgcaccacgctacacctctccaacataatcatccgttacaaccctaccacggccaccggacaggatcacgccccgcatacctatctcacaacctgaccgcgacacgcccccccgccactccacccgcccccgccccgaccacaccccacccatccaaccatctacagcccacatacgccccaccatcctctcggagcccacgcacacgaaacacacg

SEQ ID NO: 535416 - DNA, 503 bp, Homo sapiens
tataatggactcatgcccaaagctgtctctgagtttacagtgaggccgagaacagagtaagtggagtggctttaatcaatgagatgaaattataacagctataactgaagtctccaggcaggaggctataacaactcagtcagtgctatatcgtgcctccattttacttccaggacctgactggcatcaccgttcttgatgctttctacaaatataaaaatctctgcaactgtttagatacacattggaagaaaaaaaaacagcgccaaagctgaccataaaaccaacagggggttgggggagcgcagagccaaaaaggccaagtatacatacacatagttcaggaaagtccaggattattgcagaaattaaaatgaccaaggacaagggcagcgccaataaaagccctaaagctagcaaatgcctaactggttaattcagagtcctccccacaatgttcatagggcaggaacatcatgtactttgaaaagcttcaaaagtaa

SEQ ID NO: 535417 - DNA, 257 bp, Homo sapiens
ctggtacgtgacagctgcggcaggtctaggtgagagacgttctggaccagccagctggggtggtaggtcgggaggtagatgtcacatgtcagtgtcacttggcctgaatggtttctcggatccagttcgtgtatctgcagacgttgtgtgtagactccgtggcttctcctattgatccacagggcgatgttaccccactgacacaacggcctcggaggatggtctccacattaccatgcgtgaccccacagaactca

SEQ ID NO: 535418 - DNA, 217 bp, Homo sapiens
aacagtagaaccgcctctagaactctcattactattaccaacgaggaaatctgtactcaaggaaataccttctcagtgatccatctgcgagtggcactactcctcagtgtattatacaggccccctcccttccctacacatcaagctcgaggatttgccccacccaggactggcaaattacctttactaaacctgccctgagtcagataactaaaat

SEQ ID NO: 535419 - DNA, 308 bp, Homo sapiens
tagtgatcataaagcttggaacaaggaggtcttctcgaggccgagacagtgttctgggctggcacagttgacttcacatggggcaatggcaccagcacgggcagtagctggcaccttattggccagcaacatgtccctgtatctcagaagaggatcctccttgtgtgaacacaatagccctacattcccccgtgatatgtaggcagcagatttctccacgagctggagttgttttccacggtgccctcgagatggccttgcgcagtcatgtgtgttctatgcgtaatcacctaccaggtaattctccg

SEQ ID NO: 535420 - DNA, 169 bp, Homo sapiens
ttttcagaatataatagtgatgagttatcaaaagttgttggaaaatatttggaagaatatgaatatggaagtggtggtttgatattttaattgcagattgtgaattcgtcccctcccccgcccccacctccgcctgccgaggcgcggaataaaggatgagttcgctcca

SEQ ID NO: 535421 - DNA, 875 bp, Homo sapiens
  misc_feature (594)..(594): n is a, c, g, or t
tattggggggggttatattttttttttttttttttgggaaaaggatttgtggccgccacccgggggggagaggggggtccccggacccccccccccccagggtctgacagaagttcgtctggccgccccctccccctaatacgtgtagagtggccgggtcgtcccccacagttccccaatataatattttgtgattatttggggaaccaacaacgtggttcacacacattggtggcgaccaggagtggcctacaacctccgtagagacctgtgtggacaaccgcgccgtgctgctgggcctcccacaatgttgtgggagttacacggtgtgatgcacacaacgccccgcatggaatcacttataggtgggggttctaaaaacaacatcttttaatatggcctcgcggggcccctgcagttataaaagaacagtggtttaacaagcgggtcgccgcaggaatcttctaatgatcattccacaaaagaccctctggtgggcgcgactacaatagtgagctgttcccctcccacgcgagtagatcacacacgccggagcaacttagtggtcagccgagtagtggactaactagcggnggagaattttggtggcgccccccaactgggcggggggggtgggggaacaccttctctccccagaagaatttaaaagagagaggggggaacaaacaacgtggcccccagtcgcgtcctcatgggagaagctagtgatcggcggaacatttttttcccccgcgggagaaagacgagctttttccccgaaacgggggcccactcactagaggagaaggggcggcaccaccaccacggggggcgaacccacggggggcaccaaccaacccttgagcgagcttggg

SEQ ID NO: 535422 - DNA, 364 bp, Homo sapiens
  misc_feature (257)..(258): n is a, c, g, or t
  misc_feature (264)..(264): n is a, c, g, or t
  misc_feature (267)..(268): n is a, c, g, or t
  misc_feature (271)..(272): n is a, c, g, or t
  misc_feature (274)..(274): n is a, c, g, or t
  misc_feature (277)..(278): n is a, c, g, or t
  misc_feature (353)..(353): n is a, c, g, or t
gtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggttccagcagagggaagaagaggactggaacccttgagtgtccccaaaggtnnagtttnacnntgnncnggnncatgaggctgcccagagaaagcactgcttctgtatgtctcttgtggtattggaacaataaacccgtacaacctgnaaaaaaaaaaa

SEQ ID NO: 535423 - DNA, 211 bp, Homo sapiens
ttccaaagccgtagtacccaaaaaattgaaataagaggcaggcgcagtggctcgtgcctgtgatcccagcactttgggaggcagaggtgggtggatctgagaccagcctggacaacatggcgaaaccccatctctaataaaaacacaaaaattagctgggcgtgatggctcatgcctgtagtcccagctacttgggtactacgctttggca

SEQ ID NO: 535424 - DNA, 107 bp, Homo sapiens
  misc_feature (65)..(65): n is a, c, g, or t
  misc_feature (86)..(86): n is a, c, g, or t
gatctgtaaagaatgactttcaaggatagttcttaggggactgtgaaagtgttgggtcttactcnaggatgcctgcatgggacccnacccggagctggtgtggccat

SEQ ID NO: 535425 - DNA, 770 bp, Homo sapiens
agcggacaggatgtcgatgtttcaagtcactcttacaccattaatgggttgaagaaaatatacagagtatagtttccgagtggtggcctacaataaagcatggtcctggagttgtccacacaaccatacgagcattacgaagcatggtgcggactgatacgcaggtgtgtgctaccgtctagcatctgctgctgcattgggcaaggtgtagaaataccaacggagtgtagatagtatgtcaaatggacggaggcaagaatgcttgagggcacagtaaaatggggccgataagtggactatcacaggatcttcgcgtacccgatacaggtgcctcacccgtagagagtacgatgaactgttcagctgcacgtaacccttgggttaacgacggggaactacgagcgttggtcctcgaaaactgagtttgaagaaggtctagaattcgggcggtgagcatgtaggtaatatgactttctctgaatgttggggttggctctacacacggggtcccaacgtgtgtgaacaaggagtccccggagtacacaggtagtactagtggtggaatagttaggagtcggaaacttatttttgaagattgttcgaacctgtgagaatagtaaaaacctctggaagtttaacgtgtaggcgttggcctcttagatttcgtccctaattgaacgctaatctgcccccggcattcatggttttggacataggtcatttacaagtaaagatgtaagcctgggaaacctacccttcccaagcataaa

SEQ ID NO: 535426 - DNA, 190 bp, Homo sapiens
ctgcttgtcctgctctgcttgtcctgcctggcgcgtgggctgatgggggagagggacccagcccattggcagaggcaggacaagcagaggcaggacaagcagaggcaggacaagcagaggcaggacaagcagatgctgttaactgagaatgggaaaaggagatactgaggtaccagaggcaggacagcag

SEQ ID NO: 535427 - DNA, 586 bp, Homo sapiens
  misc_feature (378)..(378): n is a, c, g, or t
  misc_feature (443)..(443): n is a, c, g, or t
  misc_feature (448)..(449): n is a, c, g, or t
ttcatgcaaactttatttggtgtgaggaactactgaggatcagagtaatccaagcaaatgtgaatcattttacctttgacaaaggtaaatcagactatgaagttttttttatacaggatgatgactatggaaagagtactcttgtttccttatattatggaggcagttttttggtgtggaaattgttacaaactgtagaagccacggggttctgcgatataagtgtctgtttttcataaagcaggcagaactcatctaggtaaattacagttcctagaaataataaacattgtattcagagttgatgcatgtacatataattgagtgctgtggttaggtgcaactttcttctaaagtcactgatcaattcatacacancaccgctacggaccctctcctaaagagaaacttaggtacaatggggcagatccaagcttagtacnccttnnaccataagaatagagcctttaactctccctgttttaaagctgggaaattaattatttcccgacccctcttctccccggattatccccgacaaccacgcacccggcaatactcgggcaaacaccgaagcgtcacacat

SEQ ID NO: 535428 - DNA, 226 bp, Homo sapiens
gctggtatctagaggatcccaattctgcaccacagcagcaggtgcctcacgccacacctgcaccaccacgacaccgcaccagggaggaggctccacgtcctgccaccaagcccacccaggggccagctctgccagcgagcccaggaagcccctccaaagccagcagaggacaagaaaaaggattagtcgagactggtcctcacctgctccgggtccggcgctgcgg

SEQ ID NO: 535429 - DNA, 104 bp, Homo sapiens
atatgagaccagaccttgtgctacatggtgaatgtcctgtctctgctgaaaatacaatagatattagctgggtcgatggtggcaaacgtctgtagtcccagcta

SEQ ID NO: 535430 - DNA, 300 bp, Homo sapiens
  misc_feature (107)..(107): n is a, c, g, or t
  misc_feature (257)..(257): n is a, c, g, or t
ttaagtcaaaggctagaaatgattaaacttagtgaagaagacatgtcaaaagccgagagaggccaaaagctaggcctcttatgcctaacagtcagaaatgcaaaagnaaaattattgaaggaaattaaaagtgaaacaaccttattgctgatatgcagacagttttaatattctggatggaagatcaaaccagccacatttccttaagtcaaagcctaatccagaacaaaatcctaactctcttcaattcttacganggctgagagaggtaaggaagttgcagaaaagttttgaactagc

SEQ ID NO: 535431 - DNA, 916 bp, Homo sapiens
gggcatgtgccaccacacctggctaattttgtattagtagagacagggtttcactatgttggccagactggttttgagctcctggcttcaagtgacccacctgcctcagcctcccaaagtgctgggattataggtgtgagtcaccatgctcagcctatttatttatttttgagccaagatcatgccatggtactccagcctgggcagcgagagtgaaactctgtctcaaaaagaaaagaaacagaaaagaaaaggccgtgcaccaccgcacaccggctaactttgtatttttagtggagatggggcttcaccatgttggccaggctggtctcaaactcctggcttgatgagatccgcgtgccttggcctcccacagtgctgggattacgggtgtgagccaccgtgcccagcctaagtactttgaatgtcaatagtactggttctctttctaaatatactttttaaaaattatcaaaagagccaggagtggtggctccagctctttgggaggcagaggcaggattattgcttgagcccaggagttgaaaccagcctgggcaacatagcaagacagatctctattaaaaaactttcaaaataatgccttaaaacttccacagtccaacggggttctagtggacagtgatcattccagcatgagctctatgtcttaccctctgtgaagggaactatgggtacgagttctaaatacctttccaagttcacctcctgtttagacacccaatggtctgggattaaagcgcgggttcctttcatgaaccaccctgactttcctgttcacattggggttcacgctttgagacctccagttaacaaacctcaggccattaaaaatgtcaccccaaaaaaaattacggaaccatcgttataaagccaccatgccctcgtgcagact

SEQ ID NO: 535432 - DNA, 178 bp, Homo sapiens
  misc_feature (92)..(92): n is a, c, g, or t
  misc_feature (153)..(153): n is a, c, g, or t
tcatgagaggtgttcacagacgttagcagggcatcgcatggaccgcagtagggcagattcggaccactaggcctgaaatgacatttcactanaagtctccaaaacatttctaagactactaaggggcctttatgtaatttctttaaatgtgtnattcgtaagaattcaaatttgtata

SEQ ID NO: 535433 - DNA, 1724 bp, Homo sapiens
  misc_feature (163)..(163): n is a, c, g, or t
  misc_feature (601)..(601): n is a, c, g, or t
  misc_feature (868)..(868): n is a, c, g, or t
  misc_feature (1084)..(1084): n is a, c, g, or t
tagtacaaacttagggctctttattcaggcagtaaagtagggaacagcaaagggggagggtctacaccattcaccaggggcaacagaaaagccctcaaaaacattaaagttcccttcgaactttagtgttgccgggtagaacctcttctccatagccctcganggagaaaaccacattttataacgtggcgtggaggacaaggtccgaggcagccgggcgccaccactgtggggaagagggcaagcgtggcacgcgcgggcctctctgtggttcgagctcctgtggcacagtgtgcttgtggcgtgcgagggctctctccagagccagagctctcctgtgcggtctctatctcagagccccacactctcttctcagagacccccggtgtaagacgccccgcggagaggggctctctctatatcacaggactactgtggcggccacccagtgttggacattctgtgtgcccccaggggtgtagaacctcttgggtgctggagtgtgtggggtgtgtctatcacaggagctcctctctctttctctgagagtataattctccacactctctgtgggggagccccctttatgtgggtcttctcntcccgagaaagagctctttaactaatatatatgagagtgtgtgattaactctctctgggagcgggaaacatctatctcacctccttccgagggggatgtggtgataatctctgggggtggggcggtacaaacaccaaaggtctcccccttattaaaagaatctcccttattcccccaacaccgaaggggagcgcccacaagagctctcttatcatatttctccatctgtgggctgtctccaaaccccctcttgggcggcgccacacntgtgctgcagtggtgtccccaactgtgggcgttgtggtcccccgggggctgctcacaatctcaaaatatctccccagagtgggccgcaaagtgggcgccttcccaagagggtgcccccatagaaagtgtgcgctgtgtcttagcagaacacacaggggggggggtctccctccacaaagaggcctgggtgcccacttcttcctgtggtgctattcngttcgcaaaggcgggaaaaggcttcttctcccaaaaaggggatatagaagccctttcccacttctttgtgggcccccaaccgttgggctctcctggggcaatgtgttgcccccagagggaatttttctaccagggcgaaaagggggggccatcttttcccctcgttttaaatacaatcacccaggccaacgccgggggtcaacaccacaacgaacaccccggctggtgggaccagccctcggaggaggagagaagtcaccgccttgtggaaaatattcctcgtggcggcagttccacacacaccttttcctgctccccgtgtgtgtgggggcccacaaaaagggcgcgcacaacaaactgggggcgggggaaggaccacgccgacgggaggaggggtgagtgtcagctcttgccaacagtcgtggtaacgccccccccttgctccacaaacacatgtagtttgagtgcagaacgacaatgatgacgaggggtagagcccccaactctacaacgaaggagcgccgcttggtgttctaaaacacagcgcggggcgctgcacagaagtaggtctctaccaatcacacaagcgaggtagacacaacacgcagacaacacagctgagtcaacagcagacacctgt

SEQ ID NO: 535434 - DNA, 246 bp, Homo sapiens
ccgtagtttagaagtttcaatagcacctacattaatcaggtattatcgatggacatttttgtagaccacttttgaaacacttaattattttgcaacatagacaggactatacaactttcatttaactattaggttactgatttaagttgagtgtgcatatagagaaaaacctagaaatatatctcatggcagatacattaaaaagtactatcagaagacctttatgctattgaaacttctaaaact

SEQ ID NO: 535435 - DNA, 921 bp, Homo sapiens
aagtaaccccctaattaaaattaattaagccagcgtcattcatcgacctccccaccccagtccaacatctcccgcatgatgaaacgttcggctcactccttggcgcctgcctgatcctccaagatcaccacaggactattcctagccatgcactacctcagcagacgcctcaagcgcctgttcagtcaatgcgcccacatcactcgagacgtaaattatggctgaatcatccgctaccttcacgccaatggcgcctcaagtattctttatctgcctcttcctacacatcgggcgaggcctatattacggatctgtttctctactcagaaacctgaaacactcggcagttatcctcctgcttgcaactatagcaggcagccttcataggctatgtcctcccgtgaggccaaatatcattctgaggggccacgagtacattacaagcttactatccgccatcccatacattgggacagacctagtatcaatgagagtctgaggaggcgtactcagtagacagtcccacaccgttcacacgattctttaccgtttcacttcagtcttgcccttcattattgcagcccatagcaggcactccaacctcctattcttgcacgaaacgggatcaagagtaaccccctaggaatcacctcccattccgataaagatcaaccttccaccctttatacacaatcaaagacgcctcggtgtacttctccgtccttctctcctaaatgacattaacactattctcaccagacctcctaggcgaccagacattatacctagccaacccttaaaacccttcccaattgaagccgatgatttcctatcggcctaagaatttcgatcggcctacaaaatcgagggcctgccattataacacacattgaaaaaccataccaatttcaaaaagaaatg

SEQ ID NO: 535436 - DNA, 327 bp, Homo sapiens
cccgtatcccaagcactagcaatctaggtctactaaatacaaatctctgggtggatgatcttctagatacggtatgtattaaacttaacggagtgagagttgtaatgaaatggattgtagtcggtttgccgtaaacttgtggttctttaaatagtccttacggtgatatcttactatttttaagctgtctggggtttcagatatggggatttcagcccctggttaatcagtcttgtccctacaagtccctgatgcagtatgtttatttgtgatgtttgaagaacatttcttggctgggcgctgcggcttgcgcctgtaatctcagca

SEQ ID NO: 535437 - DNA, 426 bp, Homo sapiens
  misc_feature (187)..(187): n is a, c, g, or t
aacgttttatgctttggtggtcttagcccttgggccctgtgataagagagaatctcacagaagaacctcaaaggcagagcaagaaaggagccagaactcctaaattccaacaggcactgtcagctgtgggccagcagctccctccatcctcctccataaagggccaaaggccttaggtcaccatctntgggcccttttagcccagactcagactcaaattcaacttccaggcacactgtaagtcccgtttagtcctcagaagaatgatgtgtctatgtgtggttctgtttacagcaccatttggagtttgattgcttctagatgagaagaaacaatttgagttatagtattgtgtatacagggtccaaatatcaatacaagacacataagcaagagagggcttaataaaggggttaaccaattcca

SEQ ID NO: 535438 - DNA, 333 bp, Homo sapiens
  misc_feature (78)..(78): n is a, c, g, or t
  misc_feature (248)..(248): n is a, c, g, or t
gtggtggttatccctacaaggctgtttcctctgctaaggaaaaaaacatcaagagagacagggggttagttcgctctntacagaaagtcaaagaatatttttatgggcaccccctccaccccctaaacagagaccaaataagatgctaagcagacagcttgggtgccccatgccccaggctgtctatgcagcaactgagccccaaaacacacagcatgtacgtagaagtagctcaggtggacaaaatnccagcccaagctaggcgccagcaggtggtggtgtgtccacagcaggctagtgcctcttaaacaagtcaggtggcctacttcccac

SEQ ID NO: 535439 - DNA, 357 bp, Homo sapiens
gcgcgctgcaggaatcggcacgagccgactccctgccctccccagagtgggtatttgaggcctccccaccatgacgtgcttcacatggagggccccccccacccccctttgtaggaccatgaagggcgcctggtcaacatccggcccgcctcccgaaggatttcttcacaccactctcccccacacggcccctgctccccgcccccggcccagcccccccccctccctggaccccactcccgccccccgcccctccttcgcccgccctccctcgccccccacgccccccatcactcccctcccccttcccccccccgcccgcccccccttccccccccccccccccccccccccccg

SEQ ID NO: 535440 - DNA, 183 bp, Homo sapiens
cctatcactcatcagttttgtaccctatgatgagttattccctggtcttttagtttccaccacgcctaaaaggtatgaaagtgaaataatgatactttacttcatagaatggttacgaggataaataaggttaatacatgtggagtacttagaacatcgcaattatgggcaagacataggtaa

SEQ ID NO: 535441 - DNA, 363 bp, Homo sapiens
  misc_feature (21)..(21): n is a, c, g, or t
  misc_feature (50)..(50): n is a, c, g, or t
  misc_feature (61)..(61): n is a, c, g, or t
  misc_feature (151)..(151): n is a, c, g, or t
tacaccttcttagaagagatngaaaaggttgcggattctgctagctcttntggggcccagnggggaggcactgtagtatcagtcagtccaggaatatccttctctcctttttttacaatgggctataccaccatcttaattataaaatttngtttgtgggtgttagaaaccaaacgcatcccagcacctccactagattcaagtccaaaagaattgagagcagggacttgaacagatgtttgtgcaccagtgtgtcatagcagcattattcacaagagccaaaaggcaaaagcaatccaagtgcccatcagcagatgaacagataaacaaaatgtggtatatacacacagtgggaaggtgttc

SEQ ID NO: 535442 - DNA, 396 bp, Homo sapiens
tacggactctggcactatggtagtgggtggagaggagtcaccagttacaaagatcagactctgtatcaaaagtaactttgccctataggaagagtgagtattggagtcatcttatctattactccaaagcctccctttttatttcttgagcctggcttggaccttgagctaccgttagaattccttctaactggaacatttgtgtcgtatctgtaacactggccctgaactaacacacacacggataaaagacatctttccatcttgtactttatggtgtaggagtgaagccttgtagctaccatacccctatgtcagaggaggtcttacggacaccatagggtcggactcgcctttcctcagtctgagacattggactcttttaaaagacgaatt

SEQ ID NO: 535443 - DNA, 637 bp, Homo sapiens
  misc_feature (28)..(28): n is a, c, g, or t
  misc_feature (38)..(38): n is a, c, g, or t
  misc_feature (65)..(65): n is a, c, g, or t
  misc_feature (91)..(91): n is a, c, g, or t
  misc_feature (97)..(97): n is a, c, g, or t
  misc_feature (101)..(101): n is a, c, g, or t
  misc_feature (108)..(109): n is a, c, g, or t
  misc_feature (116)..(116): n is a, c, g, or t
  misc_feature (161)..(161): n is a, c, g, or t
  misc_feature (199)..(199): n is a, c, g, or t
  misc_feature (215)..(215): n is a, c, g, or t
  misc_feature (629)..(629): n is a, c, g, or t
tactcatcagagttactccctcattccngactactccntgctaaagcaggtctcagtactatcanattttatatagactgtccatatcagnaagacnagcnaagatgnnaagctanggatacattacatcacacactgtatctgtctctctgcttatgctntgccacagtgatatttcttcatatagtgcaatgtagtntgtaagctggttttanatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatntctcgtgc

SEQ ID NO: 535444 - DNA, 398 bp, Homo sapiens
  misc_feature (1)..(1): n is a, c, g, or t
nttaggaggggtaaccccaccccacaatatgctcgggatttccctctgtttgtcagcggaatgcgcattatgggcgtatttgtaggggcgagcgttgcagcaacaaggaggtagtgaggaacgttagagtcagataacaccgcagtcctcaggtgtgttctaaatagaggtgcacctctctcttgtatgttctcgctggggatattcagccccccgtcttgttttattagagatgagtagtgcgaatgggtggttgcgtggtttccaaaattgtgtggcccgacccgcctcccagagtgtttgtgatttgtgtgttctcttgttgctcccacaggaatatgatatatatgcggttataataaagcgccgcactggcgcgatcaaaagacagaagaaga

SEQ ID NO: 535445 - DNA, 301 bp, Homo sapiens
cgccctctgtggtcgcatggtggcctaggttcatattacagacaacgtttagggattaaactacacaaagagccttactcatactatatgcccctttgacttataacatattctcaaagagaagtgcaagaaacttgtattctttcttgattagatggagttacaattgccataataaaagtccaaggtccaattctggttttgaaactaaaaaaggaaaagatgttattatcagtaatgactttgggaagaattctttaacacacagagaggggcggagcagcagagaggggcggagcag

SEQ ID NO: 535446 - DNA, 798 bp, Homo sapiens
gaattgatgacataagcgagctctataagaaaagctgcggtctctgtacagtgaacacagctcatctggagctcagtgatgcctctgtctcactggagacctcgctagttcatagtagagcactggtcgcacgcagggcatcccaagctacgtgctgttgcaccacaaggcacacagctcgcgtgcactatcgtacacagcagaagtactatgcccttaagccagcgcagagccaatgttataccatctagagaacatgtctgtctgttgcacagtgtgactagcctaggtgggtcactagccgtggcgccaagtttcgtaccgccagatccagcgactactacagtcagtgagatgaaagcctggaactggctcctctaccagagcacacctctacactcacaaggctccggtgactcgccaggtgggtactggatagcttgccagctaggtactgctaccggccaggcgagcagctgccagcctttgccaaggacctgtctctaatcctcaggtcccgagctaacgctctacggagggatgcttcgattgctcaacagttgatgaagagacatcttagtccagagattatcacagtgagcttctgcgggttggtcctgtgtcctatggcggtctccgagacaggcaatcacagaagcaggagacacagcctcagaagggtgtgtctcacgtcaaagaaggccctgtcctagcaactagttgcaggagctggtgtatttaaagattgggacgactttcaggttttctgttgcagcagacgggtgcccagcaaagagg

SEQ ID NO: 535447 - DNA, 210 bp, Homo sapiens
cccgtcacgaaaattagagtggagcctctttgcactactactgtcactaaattttaaatcagtcggatatttaagcattttttaaaagctgagattaaagtaaatctataaaaagtgtaacaaactgggcacgacactaacttttatgtgataatcacacatattttatacatctacctttatttgagctaaaaacatatattatagcta

SEQ ID NO: 535448 - DNA, 105 bp, Homo sapiens
ggggctttggaaggacaagcaggaccagcagaacattccagattggatgcgcctcggagaaggacaggttctctgtcactggtgtgaaggcactcttcccagaga

SEQ ID NO: 535449 - DNA, 1016 bp, Homo sapiens
atggagatgaagatgaggaagctgagtagctacctggcaagcgggcagctgaagatgatgaggatgacgatgtcttgataccaagaagcagacagaccggacgaggatgactagacagcaaaaaaggaaaagtgacactaaaaaaaaaaaggccaccgtaacctattcaccctccattgcccgtctcaaaatctaaaacgtggtcaccttcgatttgagaggcccgccgcccaccggggggagaggagtgccacccgatagtatgacagcgcggctctccagcaaccaactccaaagcatgtagaatgtgcccagccggggagccagaaaaagaagcaagaagttccaaggccctgctttgttacttaagatgtcctttacatattggagactgtgtctgtaattaattaatgtctacaccttgaatattttggtgacgctagttggttagggatcaccccattgcaatgatcctcggtattaccaaataaggccttcggagcgtgcatcgttgtcctagctgggctgaactttgcccttggtggcgtgaccatagtacacgtatacgtctcacagtggacgaaagaaagagcttgtgcttgaaggcagcaagttggcgcccgagaaaacaatcttattccgagcattccaggtaacttttggtggggactggcttaggctggactataggaagtcggttcgtatcgaaatggttcgacaagggccaccgatacaggcttcctctgtaaccctttggcagcaaggtgcgataatatggggcgtttgaggctgtgtgaacacgtgtccccacataaccggattaattgcggcctgttctcacaaacacaaaagggggggggcaaatacccggggcacactagccccgtttgtaaagggcccagcaaagattaaacgcgcgcgtaaactgcggaagtgactagtagacaccttggtgaccccccacgtcatatggtacccggcctgttaaataatagccgtctctacctcctacatcg

SEQ ID NO: 535450 - DNA, 950 bp, Homo sapiens
cggctaaaaaacgggcccaccgaggcaccggcaaataagagatctgggaaaaccaagggggacccactgtttggacgagggtaggaacaaccacccacaccaagttggcgggggacccccccagacacccggctgcgtcccaaatatggtggcgcccccgatagcggaggcaactaactgttgtggggagcgcgaaacatcgttcggcgccccccagtcgtccgcgtaggggtggagcgcccccatagccagttgcgtcagaatacaccctcagcagccaccacagacgaggagtagttagtgcggcgtggatccacgcacaggtccggcccaactgttgtttgcgcccgagggcgccacaaaataggttggaaaagcagtgggactacacacgaaagggttttccaccagagagagagtgtgagcgaggcccaccaagaagaggtggcccccccgtggaatctccaacacaggggggcccaaccccaagcagggtctctggcgcgaacaacgcacccggccaccatccgcaccacaccatggggccgggcccacaggagggccgccccattacgcgcacgggcgccccacacacaagaagagaggaggacggttctttcttacaaacacacacacaacagctcagacgctcggtttgtgggcgcacacacaacccaactctctcgtgccgaggacttgtgtctgtcgtggcgagggtcatacttgcgaggagcacacacacgcgtgtcctgtatgcctgctctctcctctttcccgcggcgggaggagcttaaaaacactcctcctctcccggcacagtgcgtggtatgaagtccacgatggattgttttatcattgaccgcccacgcggttcgcgaggagggatgccgaaaaacagacccgtttcttgtttcgccccaaaaaaaagttttttttctttcaacaaaaca

SEQ ID NO: 535451 - DNA, 172 bp, Homo sapiens
accgtcccaaagtgaaaacagacacatcttgccatgatctctgactggacggacgcgaggaggcggccggccgcactgggagcagcgcggatttctcttatctctactcactctacttcctttcattactagtattctattattatattattctactactctctacgtatcg

SEQ ID NO: 535452 - DNA, 233 bp, Homo sapiens
  misc_feature (2)..(2): n is a, c, g, or t
  misc_feature (14)..(14): n is a, c, g, or t
  misc_feature (53)..(53): n is a, c, g, or t
  misc_feature (84)..(84): n is a, c, g, or t
  misc_feature (197)..(197): n is a, c, g, or t
anttactgaaaaantaatctgaaagcttaatcctcagctttagcttctttttntgaaagatggacagatgttgcaggttaagancactaatgggccaggcacagtggctcacacctgtaatcccagcactttgggaggctgaggcaagtcgatcacctgaggctgggatcacctgaggcatggagaaaccccatctntattaaaaatacaaaattagccgggtgtggtagcga

SEQ ID NO: 535453 - DNA, 285 bp, Homo sapiens
gggcaactcctgatctaactgtgtcatggagtactagggctgagcttgtacaccacagaaagagatctaagagaagggttctctaaatatggtcccatagccgatgtgtctatagtatatgaccagcagtctaggcgttcaagaggatttgcctttgtctatttcgcaactgtagatgatgccaaggaagctaaagaacgtgccaatggaatggagcttgatgggcgtcggatcagagttgatttctctataacaaaaagaccacatacgccaacaagcgcctgg

SEQ ID NO: 535454 - DNA, 421 bp, Homo sapiens
cagcaatccaactccagagcaagtactattctacatctgtagagaaataggaatttctgagtgcttactccacagtcatgtttggaagaaccttttcattttgagtctttctttagcaaaattaagataatctttaaacttgtataattaagctgaccatatcttttagagtccaaaccaggacccctttgagattgaaaggaggcattattaataattggcctgggcaacagctataaaacggggctgtcctgggcacatcatatgtgtagcatagtgtttaagttatcttcagaagcagtattttgggagtcacatttacctcctcccaacatcattatcctagatttttacactctttgaatggaaaggacagatgagttgacgtgcattaggacccacaatagtggttgaaacaggt

SEQ ID NO: 535455 - DNA, 345 bp, Homo sapiens
  misc_feature (18)..(18): n is a, c, g, or t
  misc_feature (61)..(61): n is a, c, g, or t
  misc_feature (100)..(100): n is a, c, g, or t
  misc_feature (149)..(149): n is a, c, g, or t
  misc_feature (194)..(194): n is a, c, g, or t
  misc_feature (220)..(220): n is a, c, g, or t
  misc_feature (249)..(249): n is a, c, g, or t
  misc_feature (255)..(255): n is a, c, g, or t
  misc_feature (261)..(261): n is a, c, g, or t
  misc_feature (292)..(292): n is a, c, g, or t
aagctaattgttgacagngtcaaagagtgtggatagcaagacaattagagcccaacttagngattattcagatattgttactactttggatctggcaccnccaccaagaaattgatgatgtggaaagagacaggaggagtagaaaaacnggttttctttacctgctcagcctttgtggaataacagactactgnagctctttacacgctgtcttacaccncttgtaccagaagaccttaggaacaaggngggaanggaggngaggcagataatttgggatgaattcctccanagattttgaaaatccagaggttcctaggagagggaccagcaacagcaggcttc

SEQ ID NO: 535456 - DNA, 404 bp, Homo sapiens
ttagagagaggtggggtggcttttaggtagtggcgagggacttcctgtaatcgaattcgactctgcatattcgtgaatgatagtaatagaaagaatcgaatgtgtcaatcaaagtcctcggtcacattgtgaactgagggggatgctagctccaaccgactgctgtcaccgttcaccgttccagtttttaaatcctgagtcaagccaaaaaaaaaaaaaaaacccaaaacaaaaacaaaaaaaacaaattaggcctgtgccattctcattcgggttttgggggcaggttagggttgggctcaaaaaggggtgtaccgcaattaagctcatagtccggcctaaaagctttggcgggggagacgaggagaggggcgggactcgtcatactcctgctggctgatctc

SEQ ID NO: 535457 - DNA, 1699 bp, Homo sapiens
ggaccggccactacctggtcctgagtctggctccagcgccaccaccagtggcctgtggcctcgccgtctgccgtcgccccccgtgagcctggacccctgcgctcccgcaccagcccccgcctcccgaccctgcagaagcccaagatctggtccctcgctgtgagactgccacaatgccctggacaaccctgctgcctgctcgcctccctggctgcgtgggtgtggtctccacctgttgtggcatgctggtcgcgccttcctgcccgtgcatgctctctccgtgccgccagcctgcctgacctagtcctgctcacatgaacttgtgtcatcaagcttgcccgggctagggcaaatagttccccctgtgcatttgtgaaccaaaacccagtgcactgattatccaagtggcccaacactatgaaccaggggacaccaccaggagcagagaaaacacaggagtccattcccgccgttgctttagtagagctcccaatagacaaacggaacaatgagacgcataggcgtgggaggaacatatcgccgccgagaaaagcgcagagaaaggggcacaaacacccagaggagatagcacgagcggcgggccgcaggaacgaagcacccaggacaacacggagacaaaacaggacgagaagaacgcaccgcgggggacagacggggaggagcgacagacagagcgacgaagcgcaggtagaagaaggaatgagcacattcaggagacagcagcaggagacggaaagcgagagcacaggataacacggcccgagcagggcgaaccaggatgacatgcgagccacggaggccaccgcacgagtcgggcgccgccacggagcaacggggcacccacagcaaggacgaagcgctccaacgtcacgtcgagcagagaccagccgacatgcgagcacgagacaggaaggccgagagcagacgcgcagagacgcagcacccgtccacgtaccgcgagccaaaggatcgacgggaaacgcagagcacacgatgagcagaagagaggcacacgacgagagaacacaagcgagacagagatcggacaacgcgacgagcaagacagaagagacagaagaagcggatatggccatgatcgagcaagcggtctcgagggagtgggtgcgcagaggtcgggagcgcggcgcggtatcagtagcgagagagcgaggacggacgcctcgcgagcgggcgcaggcaggatggagtaacgactagcagaacagacgcagcgtagagcgagcagccgcagacgatagcgcagcggggaggcgcagaggcgacgagcacaggtgcgaggagagagacgcaggagaagcgtcgactcggggaagagacgacagaggaaagagggggaggcgagcaagagaagacgaagcaaacagagaaggcagagaaagcacggggcacacaaccggacggcgcagcgaacacgcaagaaggagccgagagacggagaaagacgtacggagcgacaccgggcaaagcaacaggggcgagagagaagcgggagtacagcgcgcagaggacacggagagagggcgcaaaggaagaggcggaggcgacaggtgggagagagcgaggcagcgacgagtgagacgcaagagaccaagagcgcagacgagcgaacagaggagaacgagtagagagagaaggcggagcgagagcgagcacaaga

SEQ ID NO: 535458 - DNA, 818 bp, Homo sapiens
ggacgcgtgggcagcgagcctcccccgccacccgagacgcggcgcgcgacgctccggcctgcgcccggccgcggccattggcggccccccggccgtctcccgcgatctccgtttcggtctcggctccggctttttactgccccgcagaagaagttcggccctgtgtggtggtcccaagggcccaagagtgaattcccttccggcccggggacatgagagcctcccccggcacccggggcccagacgcgcacagaatgggccgggtgggcgacgattcccccagccgatgcccgagaacgagttgaccctggctcctgctcatccctcttgacagggcgactggcgaccgattgacgaaggggatgcatcggggcgaggatgccctggcgggaacgcatcgagtcactccgtcagcgaacgcaaatcaatggaccgatcgatgaggggccagtctattgagccaaaaccggacctggtcgaccaagcgcccacgcgaaacggacggggggtccttggagcggaactggcagtgcagagcgactgtgccgggacttcaccaaggaagccacggcactgcaacccagactacaagccaccagaaatgaaaggggggaaccccactgcgcatgggcacgcgccaccgaacctggcttgcgcagcggcctcgaacgtccgtggggctcaacactcaagggggctaatataaccagttagacaacaaatacgctaggagcagcgacgcatcacaggcgctcttccaaccttccgggccgtctcgactccagggcacgcactagggtacagggcccccgttccag

SEQ ID NO: 535459 - DNA, 159 bp, Homo sapiens
  misc_feature (100)..(100): n is a, c, g, or t
  misc_feature (116)..(116): n is a, c, g, or t
  misc_feature (130)..(130): n is a, c, g, or t
aaatagcgacgcacgtgcatggagttacaagttaaacaaataaattgaacataacaatcccattaccaatttaatttgtgagctaaaggcagtagctgtngtcactgtgctttagnagacccagcaactngaaacagactaattttcgggtggtttgcc

SEQ ID NO: 535460 - DNA, 1046 bp, Homo sapiens
cagtgttttcattttggttagtgcttttgtggcttaagaaattctttccaggctgggtacggtggctcacgcctgtgatgccagcactttgggggcagaggcaggaggattacttgagctcaggagtttgagaccaacctggacaacatggcgaaacaccatctctacaaaaaatacagaaattagctggacatggtggtgcgtgcctgtagtcccggctgctcgggtggctggggtgagaggattgcttgagcccagaaggtcaaggctgcagtgagctgtgattgtgccactgcacttcagcctgtgagacagagtgagaccctgtctcaaaaaaaaaacagaaacaacaacatacaaaaacacacggaggacaacccggtgtgaattttttcccactcccagggtcctgtgaagaattggttctctggagattatattttcgcggaaacatcctttatagctgtgctacacttccccatatttagggcctttaaattccccctataaattggggctatcgggcactattggtcgtgaacgcgtcagggatttccctttcacatgtttatactcactccattagggttatacacacaccgtgtccctatcaagtgctcggtacctcctacctgtgctgtgcgccaatttgtgcaatggccaccttcttgcgtatgttgtccccgctttttgacctctttgtcgaaactcggcaggggggatctctttccgtctggttaccatagtctgtcctgtcctgtgtggtccattttcaaggcgtgttcattatttcccacttgtgtcttgacactctgttacaaggtaacagtcctttttgcccacccgtttatatcaccttcttgtgcgaaggcgggctttgcgacaacatctcgagcccacagggcattttacacggtaaagggtattttccccagaatataggtttaaaaccgcgcttttctacttcccacacagtgtgttcccttatagtgtgcgacttgtatatcaccctataaccggttggggaaaactttgacttcttcaca

SEQ ID NO: 535461 - DNA, 234 bp, Homo sapiens
gccctttttttttttaaaaattatggtgccaaaagcatttgttggggtatttgttttgggggcccccctctaagtttttaccgcccccttcattgttttcaaagaaatgggggggtttggtttttaaaaaaaactattttgttttagatcataataggcataaaaccgtacagaaattttttgtaatgtgttggtttttaaaaaaggacccgttaataaagtttttaaaaaaaa

SEQ ID NO: 535462 - DNA, 429 bp, Homo sapiens
  misc_feature (9)..(9): n is a, c, g, or t
  misc_feature (11)..(11): n is a, c, g, or t
  misc_feature (159)..(159): n is a, c, g, or t
  misc_feature (353)..(353): n is a, c, g, or t
taaccccangnggcaatggtttgggtgactcactttcccctctaaggtggtgcccagggctggaggcccctagaaaaagatccagtaagccccaagtgtcccccccagccccccatgcttatgtgaacattgcgctgtgtgctgcttgctttggaaacntggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtngcccaggcacccagatgattcctatggcaccagccaggaaaaatggcagctcttaaaggagaaaatgtttgagccc

SEQ ID NO: 535463 - DNA, 430 bp, Homo sapiens
  misc_feature (76)..(76): n is a, c, g, or t
  misc_feature (258)..(258): n is a, c, g, or t
  misc_feature (270)..(270): n is a, c, g, or t
  misc_feature (280)..(280): n is a, c, g, or t
  misc_feature (287)..(287): n is a, c, g, or t
  misc_feature (307)..(307): n is a, c, g, or t
  misc_feature (339)..(339): n is a, c, g, or t
  misc_feature (363)..(363): n is a, c, g, or t
  misc_feature (371)..(371): n is a, c, g, or t
tacacttgctgcaacctgggggctgctgcgaatgaaacagtaagcgttgcttctaatcatatcttgagctctgctncttatggacatgacgtccaggccgacctccaatccttccctttccttaagtgtcagacactgtcccctccattttcctttccagcagtgccccagagactccctattacacagaacactagggtaaagatgggcttggttatcccaggagctcacactctcaaagtgcattgatagcccgcngcgatttgcccngatacacacnatatgtnaatacttctccttgcccctntattagtttcagggcacatcggaggagtctanaatatattctgcttttgccccggnaggctttntttaattcccttttaatgcattttgcccactatcatttggttcttcgtgatcaactgca

SEQ ID NO: 535464 - DNA, 253 bp, Homo sapiens
taattattgaacattcacattagtacagtagaacaataagccaatacaaacatgatttcattcgaaccattgataagatctctattgttattcttcatttctcttcttgtctctctattttctttttctgttgtcaaccagataactctgttattgtatccttcttcttttccaattttatactctgtttttccacttctgctcttcgttctcttgttcttgtctgtcctgtaaaccaggacccaggttatgc

SEQ ID NO: 535465 - DNA, 392 bp, Homo sapiens
taaatttcttgggaactatgaattctttgcaagcacagctcgtttctgcagattatttcccaaacgtttacaaaatggacccaaaacggaaaaccccttaaaaacctgaagaggcgcaactattaaaagctacgatttatccagtagcaagtgtcccagccttcagttgccagccgcttcctctctctttattcccaagtattagcgggatgaaaactttcttccccgcgtgtattgtttcctattccttttttctccggcttctgggcttgcgcggttcagcaccttgaggaagtcagacttttccccccgcattcgttttgtgaatttaggccttaaagcacttgatgtgttagtgcaggttgccccggaacgtgtggactcaggttgat

SEQ ID NO: 535466 - DNA, 829 bp, Homo sapiens
agcggctgttaccagagggctgggacggggcgacgtggccacggcgctgggaagaaccaatcggccgagaaccctggggaagtgaactgggtccataaagaccaagtggaggagtagtgggcgcggtcaggatgctggaaggcagagtgaggatgcaagcccctgggctgagaaactggggggccctggcctgggagcaagagcaggtgggccggtggcctggagcaagagcaggggcggggccccggagaactgggcgagacccaggtacagtaccccaaggccccttggggcagaacccctgagctgaagtgagcacaggcgtgcgaatacccaagagtaagaaacgttgcggaagggcgctggggttgccacacgaaggggtttggtgggccacctaagcccggtgtgttgcgaaatgttaacaacctggttgttttgccagagttccgacatggtgcaaatagaaacggccagataaccggtggggggacacctttataacagcaggggcgtgggcacggtgcttcaaacacccgtaagaaaacaattaggtagagagtccaaaagtgaaacccgaggcgttgcagaaggaaggccaacaagtgaaggttggggtacacttacccacgtgtggcatgcggcgatggcccgtgcactttacaagtgggaagtcgagagagggtcttcgtaaggcgcaagcggtatacattgtttggcggtgcacccacagccccggagtgtgttaaccccgttgggcgggtattccataccacggtgtggggccccagagtaatgatctccggaatgttcagtgggccagctggtg

SEQ ID NO: 535467 - DNA, 352 bp, Homo sapiens
  misc_feature (77)..(77): n is a, c, g, or t
gaacccccccccccccgaggggggtttttttgttgttataaaaaataaccccccgcgcctggggggggtgtccaaantttttcgcccaccccttggggcactttttttgtgttctccaccggcccaggcggaattgggtaaaccctttatggccccttgaaaccccccggggggggatttttttttcatttgcaagaaaaacttttttgtgaaagggacgcccccccgttttttttccctttccccgttccccggtaaaaccattttgttctttggggcttggtttggaattttttaactggacccgtttttcgccttaaataaaaagtaggttagcctggaaatgaaatta

SEQ ID NO: 535468 - DNA, 756 bp, Homo sapiens
agcggcctagatcacaccactgcactccagcctgggagagaaagactccgtctcaaaaaaaaaagtaattatatttcccaacataaatgaatacgagccattaaggaaaataacatggagattcatcagaaattaaaaatagaattactgtatgttccagcaatcccacctgtgggtgtatagctaaaggaattgaaatcagcatactgaagagataactgcactaccatattcactgcagcagtatccataatagctaagatatgaagagccaacctaggaggccaggcattagatgaatggataaagaaaatgtgatatatattacacatacacacacagacagtgcacacacataaaggaatactatttactctttatgttatttagttttattttgagatgtagtttcactcttgttgtccaggctggagtgcaatggtgtgatcatggctcaccgcaacctccacctcccgggttcaagtgattcttctacctcatcctccccagtagctgggattacaggcatgcaccaactagcctgactaatttagtactttgagttagagacgggttaactccatgttggacaggctggtctcgaacttgccgaactcagggtgtactccatccgcctacagacacatcccagaagatgctaggaattacagggcgtgagccatcattacccgatggtaactcatttactgtaaaatagttctcctgtgataatgagttcacagcactctggaccca

SEQ ID NO: 535469 - DNA, 109 bp, Homo sapiens
ggagtcggcccgcattatagcctcgcagcgcggtacttccagctccaatagcgtatattaaagtggactcattccaattacaggacctcgaaagagtcctgtattcgag

SEQ ID NO: 535470 - DNA, 91 bp, Homo sapiens
  misc_feature (74)..(74): n is a, c, g, or t
gagccaggtcggtataagcgccagaccatcgccgcagtcaagctgtccacatccctggcctcagccgccacatnacctgacctgcttacgc

SEQ ID NO: 535471 - DNA, 172 bp, Homo sapiens
gttgatcttgtattagccactgtactggaattggttttatcagttcaaatagtttttgggtggagtattgtaagatctccaatatataagatcatatgatctgcaaacaaggataatttggctgctgcttctgtcaatttctgtgcccatttcaagggggatcctcgtagag

SEQ ID NO: 535472 - DNA, 138 bp, Homo sapiens
tgtactgaacggggtcagcgcccagaaacccatatcatgatcctggaccatgagactcacctaaaggccagaaaggtaggtgctgagagcccagattctattatttttttaaatattaaatagagtttggagtcttgt

SEQ ID NO: 535473 - DNA, 214 bp, Homo sapiens
tggggggggggttttcccccccggttttctcaaaagggaaaaagttttcccccctttgtggggttttcaaaggggggggcccccggccctgttttttttccccgtgaaaagggaagggggggtttgtttttccttttttttcccccccctttttgggggccccccccccctggggggggggggggccctttaccccttttccttttttttttta

SEQ ID NO: 535474 - DNA, 864 bp, Homo sapiens
gaccggtcagaattactgaatggagagaagagtgaaagaatatcttactcatggtaggaagaattgacatcctagaaatgcagtgaacaagtgaataccattagaagatcaagctatgagggcggaatcgattaggcagtggcactgcatcttgaggtgggaccccggattgtcaagtagagaacctttgagaatgaatgatcatatggattggaccaatgatggccatctgggtctgacattcttgtggggcatccagaaggtaatttacagtctaggcatacgttgccatattcgttgtgcactaatggcatcgtgcctcggagatctggactgttcggataccatggcatcagaccaactaggatgtatagcccgatgaaataagaggagctgtctgagtagggactgaacaacggggactcgcgcacatggttactggagtgacttgaaaggctaaaataaaggctcctgccagtgagaacctgtattgcccattatgggggggatggggatcaaatcctacaaataacacggaccattcacatggaatgcgtgtaggagctgaccttctacaacccacattccggtgactgattaattgacacccagcatggaggttaataaggggacccgtgcctaagggggcggggaaaacctgctgatcgggttctcaacgcaagggcaaacacggtactgagcacgtggtttacgccaagtgcaggaaaacgaaaaccagattactgcagtacaagtccactgggagaaggaggggagggactagaaactgagtcagagagtaaccaaagggtgaagggccccaaaggggtagggcggaatcgaaccgaggaggagaaaacacgg

SEQ ID NO: 535475 - DNA, 124 bp, Homo sapiens
atcacaggtggggacagagcaatctcttatcaacatcaagcatcttggtaagatttgaactcttcaatctctgcactcaaagctgtaaagatagttaagcgtacataagttgcccgccaatcga

SEQ ID NO: 535476 - DNA, 188 bp, Homo sapiens
tttttaatctccaaataggagttagtcagctattaagaatatttggctaattggttaccaaatatggattatccagggcgagggtctaccggaaatttccccggtgaaagggacagggttcagtgagttggaacatggatacactcagttcttaatcgtctttctaaattcagggatgcccaacaggg

SEQ ID NO: 535477 - DNA, 146 bp, Homo sapiens
aaaccagtatcaagatgaatttagcctctgaaccccaggaggtcctgcacattggaagcgcacacaaccaaaagtttgacgtgaatagaaagatagcccttctgcatgtagtcaacaaataccagcactagactgggtttcgaggg

SEQ ID NO: 535478 - DNA, 158 bp, Homo sapiens
tataaaatgggttgagcgaagaaggtcttggtatagcttagggagatgtatcatattgcttatagactcgaaggcaatgggtatggatgaggtaacagaggcagtgatgtagaaatgagaaaataaaaataaaataataaaagtgattgttccccgct

SEQ ID NO: 535479 - DNA, 106 bp, Homo sapiens
ctggctacgtgatcacgcagcagcgaccgccggtctgcggcacctggttggcctgcgccaggaccgacgtgccggcctgctgcaggatctgggccttcgacttgtt

SEQ ID NO: 535480 - DNA, 427 bp, Homo sapiens
cacgaggagagagagagagagagagagagagagagagagagagagagagagagagagagatacagagagacagagagccagtccgctcggacgctctctaccacgcgccgagcacgtattgagttgggcagctgataagatgtttcttggctccacagcatacgcggcactgagaacgcggttgcacgcgcgtgaacgcacattcgactaccttttgcctacgctgacaacaggcgtgaccttcagttacacaagcgtcgggatgccgctgggagactgctatgccccagacggggctgatggcgcctgtcctaaaggaaagcctggccattatatagggacagagcgcgaccctggttattactgttcgaaatatacctatgtgtgccccaacgagatcagaatcttgggccgtggcagatatatc

SEQ ID NO: 535481 - DNA, 92 bp, Homo sapiens
cggtacctctactcccctgacacaaaattcattcaagaagaaatagataccagcctgagcaacatggcaaaatcccatctctacaaaacatc

SEQ ID NO: 535482 - DNA, 118 bp, Homo sapiens
cgttgccgtcggaggtcattggatccccgtctacccgcgcctctacatatggaccgacccggacgccaccatcgtccgcactgcccgcgaggccaacatgacgatgccccagtaccgc

SEQ ID NO: 535483 - DNA, 129 bp, Homo sapiens
gagattgcgaactgcactccagcctgggcgacagagacagactccatctcaaaaaagaaaataaataaaaaataaataaaataaaaactaatctttcaggcagggcatggtggctcatggctgtggtcc

SEQ ID NO: 535484 - DNA, 522 bp, Homo sapiens
gtcattttcctgcctttggctaaaacacactagatttattgtgggtgcacctatgctctgtgtggtggtttgaatatgcttggcccatgggaagtggcactactaggaggtatgtggccttgttagaggaaatgggtcgctgtggaggccagattttgaggtctcatatatttgctcaagtctagccagtgtgaaacggtctccttccgctgcctttagatcaagatgtagaactctcagctccttttccggatcatgttcgcctggacactgccatgcttcctaccatgatgataatggactgagcctccgaaattataaaccagccccaattaaatgttcccctttgtaagagttctcttgatcgtgatgtctctttacaacaatgaaattcctaattaagacactcactccctgctctgactagcaccccctcccctcctccccactgatatcttagcttctacccccaaactttttctggttctggaccaagataaagtaaaacttccacataacatc

SEQ ID NO: 535485 - DNA, 150 bp, Homo sapiens
tcgagctcgtgaccgactgcatctgtgctcgatccagattgtaatgctgccttccccaatgcttggttctgggtggcgctctctcctccctcatgctgtggggtatgaaagcagttgctctctgtgattgctccagagcctccctctcaa

SEQ ID NO: 535486 - DNA, 306 bp, Homo sapiens
  misc_feature (208)..(208): n is a, c, g, or t
  misc_feature (210)..(210): n is a, c, g, or t
  misc_feature (214)..(214): n is a, c, g, or t
tggatagtaagacttactgcagtcgatttgggatttgctaagtagttttacagagctagatctgtgtgaatgtgtgtgtttgggatatatacataagtaggggtagtacttgtttcacacccggggggagggagaaaaaatctttacagttgtctttttcttatttttaataaaatagaaaaatatgcacttgcgcgtcccccccccncncacntttttaaacaaggtgttacttgtgccgggaaaattttgctgtctttgtaattttaaaactttaaaataaattggaaaagggagaaactgaat

SEQ ID NO: 535487 - DNA, 957 bp, Homo sapiens
  misc_feature (462)..(462): n is a, c, g, or t
  misc_feature (467)..(467): n is a, c, g, or t
  misc_feature (471)..(472): n is a, c, g, or t
  misc_feature (477)..(477): n is a, c, g, or t
  misc_feature (531)..(531): n is a, c, g, or t
  misc_feature (847)..(847): n is a, c, g, or t
  misc_feature (886)..(886): n is a, c, g, or t
gacctagcagtggatctaataagtattgtaattttgaataatgatgtgcataaacacatttttctaggtatctacatcagctgtacaatgatgaaactatctatgattcctattggtgatcaaagttataggaaccttatacctctgaagtttgttgcctgcattttaatagaaggaaacgctaaatggtagttagagattggtggaaatctctaactacaattcattccccatccaagttgacaggcacaccaaaccacagatctgtgtgggtcagcagattgcatgttaagaatccctgatctaggagctttagtttaggctgtgagactgacacttcagtgggtagttatataataattgaaacctgagcaggggttttgtctcatttatctttacatttttataatctcacagtgtccagtaaacattaaacagttagttattaatagagctagatanataanttgnnggtantatatgggagattacttctgttagaagaggtagcattgagctgtattctaaatntagtatacattggaattttcaggttggatgaagtaaggaagaggtactcagaattgaggcatgcccataggaatagcatcaggaagggtatgacaggtttgatgattattgagagtcaagatacacatttaagggaatggcaagagatgagaggttgagataatgctggggctcagattataaggagagttttgtgtatactaggcaactggtaacttacaatgatatggtacaatcagctttgtgttttaggaagttatctcagttgatgtcatgacagaaaaatgggacagagtgggaagaaattagaagcagnggccagtgaagcactgttgcagttattacaggttagagngggcagggtcatgatggtagcagagagatgggaaacagcgatccatatctgggagaagaggattctatgct

SEQ ID NO: 535488 - DNA, 236 bp, Homo sapiens
acacttacgagtaaaaaaaaaaaaaaaaaatctcttgtcctcttttctttgaaacctttgagttcagtctttgcagtttcttttgctgccagtgtccacttttacccttagaatcattttgcctgtcactaactctgtcatcaagcccaccttgcacattggaacacattctaaagtttgcaaagttacctcctccaaaaatttttgaaaattgttccgtgtggcttttgtgtgaa

SEQ ID NO: 535489 - DNA, 1623 bp, Homo sapiens
  misc_feature (339)..(339): n is a, c, g, or t
  misc_feature (526)..(526): n is a, c, g, or t
  misc_feature (709)..(709): n is a, c, g, or t
  misc_feature (1293)..(1293): n is a, c, g, or t
gggtgtctcctccccgccaacccccccggcaatataagacgcggggggtctgtcccgtccttctcatacatgtgactcaggagcaatcgtttgtggcgcctccgttttattcagagcaaccctcttctttggggggcgcccctctttcttcttaggggcgccactcctgctcgaggggtatcaccccccatttcaatgttgtgtcatttcaaatgcgtggttttgtggccgccacttgtgtgtgtagcggccctgtcgagcgcgccgcgcgctgtgtattcttgtgtgctcactatacaattattaaccgggtcgatatcatgctttatataaaggcgncccgacgggggggagctaaaccccacgacacatgtgggggctgcttgtggggagaacactctctacattacacgaggggtgttatgtgttgtcgcataatgtattagaagagaccgggttgttttttcacgcggggcgccaacacaacacacgaaggagacgcgttctccttttttcgcgcgcgacnactacattttaaagaggggaaggcaaagaccattttgttgtcttccctacactccccccgcccgcgcctttttttaattaaagaagacttttttctccgcgcgcggtgatatagtacctctccagacgtatggttgcgcccctctcttactatttttctctggagcgcacacgcctgcgtggngaaagagaacaacacgaggcgagggggtgttgcgacgcccctcttttcttaagagcgcgcacgcgcgcggcttcatggagcccgtatatatatttctgtttgtgctgtgtggagagagatataatatttgtggtgagattatcttatattataagcgcgccttatgggcgtgggtctctccatcaatttctgtgagaaaggacatgtatagttctgtgtgttcgcgaggagaggtgtcttttcctcacacacacataggtgcgtgcttcacagcataatatatcgtatatgtctacatagcacatcatatatggcgtacacacggggcgggtcccgcccactctgcggaggggtcctctacactactcacacaatatagcgtgccgctttattatatgttttgtcttctgcgtgtagagtggggagataggtgagtaatatatttttcctgctctgtagcagtgtgggagtaacggaagagatacacaccgcctgggagtaaatagcatatgtgttagatagcaggcggtaatatatataggcagatagatgtgtatcactacatgcgctgggcccactagtgnccagcagtaatgttgacccgccggagattgttgtgacaagtggtttgttgttttctccggtgccgccccgcgggtgggggagatggacacataatagggggataccccctggaaaaataatattaacgtatcgtctgagaaattcaaaatagatgcacccaccgtgggaatcacagagtctttctttgaagaagggcgtaaaataatttggcaagagaagcccgggtgtgggaaatttttttttaaaaaaaattttctccggttttttttctcccaagagggaattgtgggttggtggggaaaaaaacccccgtgtggtgtgccccctta

SEQ ID NO: 535490 - DNA, 174 bp, Homo sapiens
actgacaaaataggactgtgcacaatgatcttttggcgtacgactgaagatggacgagccccaggctcctcacgagaccacatcagctccccctacgaaagacatcatagggatcctacgtttccatccagcagctctggcttccgggactttctgctgaagccggagctcctg

SEQ ID NO: 535491 - DNA, 382 bp, Homo sapiens
agtcgtgacggcggattgacaaatgatagctcttactcgaattccgggtgctggtggtgcatggccgatacgttagattggtggacgcagatttgtctggttaattcctgagtaacgaacgagaatctggcatgctaactagttacgcgagccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattccc

SEQ ID NO: 535492 - DNA, 349 bp, Homo sapiens
tgaaacaacaacagaacatgacacacgtcgagctcagtttacataacatgagaacggtatgttctcttttccacacacacagctgctgtcggatctagaaggtgaagaattttttcatgtatatatagacatatctatataaattgtctggctgaggcagggccttcagctatcatttggttaataaatacattttagtatttgcatttcctactgcctgcagagtttcaggtgcttgtagtgtgaaagttctgtagatgtgtgcaaatttaacgaaatgaaattgtatgtgtaaaaatgtacgattatacactgtgcaactgtaaattatacatacaaaatataattg

SEQ ID NO: 535493 - DNA, 116 bp, Homo sapiens
catagaggatcccatggctgtaacctaaatggctgttactaaatggctgttacctaaatggctgttacctaaatggctgtacctaaatggctagttacctaaatagcgacagcagg

SEQ ID NO: 535494 - DNA, 153 bp, Homo sapiens
gcttaaaagaatcttaaatgaaattatgctctgtgtaggacttcatcgaggtcccatttggcattatatatacagattagagctttattcctatgtgcccatctactgagatatgtgttagcattcccaagtattttacactggcaatctggc

SEQ ID NO: 535495 - DNA, 216 bp, Homo sapiens
ggtcaccatgtgctggctggacacttaggtcactttgaagcatgttactaaatgtcactgattaaaaaaaaaaaaaaaaaaaaaaaaaaaaaaaaaaccccattttttttttttggggccggggggggggggggtgggccccaaagggggccccgggggccggggaagggggggggggcggcgctcggccccacaagagtgccaggccaagggggg

SEQ ID NO: 535496 - DNA, 221 bp, Homo sapiens
ggtcgaccagaaagcctcctctttagactttcccagtagacacatagcagtgacaatttaaactgtggtcagtagccaggcatggtggtgcacttctgtagtcccagctatttggaaggctgaggcaggagaatcgcttgaacccaggaggcggaggttgcagtgggccaagataacaccattgcactccagcctgggcaacaagagccaaactccatctc

SEQ ID NO: 535497 - DNA, 246 bp, Homo sapiens
  misc_feature (2)..(2): n is a, c, g, or t
  misc_feature (33)..(33): n is a, c, g, or t
  misc_feature (59)..(59): n is a, c, g, or t
  misc_feature (78)..(78): n is a, c, g, or t
  misc_feature (105)..(105): n is a, c, g, or t
  misc_feature (107)..(107): n is a, c, g, or t
  misc_feature (117)..(117): n is a, c, g, or t
  misc_feature (162)..(162): n is a, c, g, or t
  misc_feature (164)..(164): n is a, c, g, or t
  misc_feature (183)..(183): n is a, c, g, or t
  misc_feature (198)..(198): n is a, c, g, or t
  misc_feature (208)..(208): n is a, c, g, or t
  misc_feature (214)..(214): n is a, c, g, or t
  misc_feature (221)..(221): n is a, c, g, or t
  misc_feature (234)..(234): n is a, c, g, or t
  misc_feature (238)..(238): n is a, c, g, or t
cnttcgtgtaccacaaggtcacaccgtacacgncgttatccccatacgtaggttattantcgaaaccatcagcctacntcagttcaaccaatagcccgggggcgnangcgctaagcngcgtaacattacgtgcaggccacctactcatgcacctaattggangngccaccctagcaatatcanccattaaccttcccnctacacttancatctncacaatnctaattctactgnctancctagaaa

SEQ ID NO: 535498 - DNA, 615 bp, Homo sapiens
gaaggggaagggaagggaagggaagacaattaaaaaaaaaaaaacaggcaaagaatatgaacaggcaattcacagaaggaaaacccaaatgacccacaaacatgaatagatgttcaaccacaatgacaatcagagaaattgtaaaaataaagcagcaacaatatatcattttacatttatcagctaagcaaaagctaaagtctgataatcccaattattggatggggtgtgtagaaaaagggggattctggacaacatgctgggtagaagtgtcaagtagggtataaggcccttggaagagcaaaaacagagatattcaccaccgctcttggtcccaacgcattccacattactaattctacgttaacatatcttggcagagagaattccaggcactaggtgctatagaaatttttttacagggaagtgtttatgggaacaatgtgtttaaaacaagaagaaaaaaacagaaacaaagtaaaggttcaccaacaggagactggataaacaaagtataaggtataatggaatatgttgtagcagttaaaataaataaagaaaagctacatgtatcattatagtctaggtagtatcaacttggataaacctcaaagg

SEQ ID NO: 535499 - DNA, 367 bp, Homo sapiens
  misc_feature (41)..(41): n is a, c, g, or t
  misc_feature (343)..(343): n is a, c, g, or t
aagcctcccttctttcttgggacacagcaatattgaaattnaggcccaattaaaaacccttacagtgggacaggcgcaagtggctaatgcctgtaatccccaacactttaggaggctgaggtgggcagatcactttgaggtcaggagtttgggactagcctggccagcatggtgaaaccatatctccaccaaaagtacaaaaaatagcccaggtgtggtggcgggcacctgtagtcccaactacactccagcctggacaacagagggagactgttttaaaaaaaaacagaggcaggaggattgcctgaacctggaaggtggaggttgcagtgagctaagattngccactgcactccagcctgggtga

SEQ ID NO: 535500 - DNA, 168 bp, Homo sapiens
cggaggaagagatatttctctggagaattaacgtttcattgaaaaggagcctttggacctgagagtaaacagactttagcggtgagagttgggtagatggaacaggaaaaaagtgaaatttaagaaaatatatgccaggcgtggtggctcacgcctgtattcccagca

SEQ ID NO: 535501 - DNA, 415 bp, Homo sapiens
  misc_feature (103)..(103): n is a, c, g, or t
  misc_feature (117)..(117): n is a, c, g, or t
  misc_feature (131)..(131): n is a, c, g, or t
  misc_feature (228)..(228): n is a, c, g, or t
gaattaaaaagtagaaggttaaaaaattaaaaataaagaaatattatatatggaaggaggagaggttaaagattactttgaaggattaaaatctgagtttttntttggtttaccttntatactctttttantgattatgcttgatacattgatacatgcattccttgctacagtggctttcgtggctgttcggctgtactgtacagtgtaactctttagggtggaagntgtgtggaccttggctctttcttggccaatgactttaattaccccatggttccctccagagggcagtgggcagtgcagtgggtcacccacacgtcccattttttagaaaacctgcagccatggatgcctaacttctactgtggagttattcatcgtcgacgcggccgcgaatttagtagtagtaggc

SEQ ID NO: 535502 - DNA, 320 bp, Homo sapiens
ctaaggatcccccattgagcccctgagatgccatgagcccctggatgcatggatggttatgaccctgattgtttttaggaaacagccaatgctctctaggtgttctcagcaaatgcaaggtatagtgggtcctgcatacccagggtattatttgacgccatggtaagcaaaatcagagtactgcttatgccctccctatagagctagttgtgtgggagaggccagtcaaccatggtacggcaggagcgagctcctgctttgccgtctgcagtagtcctccacatgttccctcattccagatgatttcaacgtgccaagcc

SEQ ID NO: 535503 - DNA, 187 bp, Homo sapiens
  misc_feature (164)..(164): n is a, c, g, or t
  misc_feature (178)..(178): n is a, c, g, or t
gatttgatacacagaggacactcataacatgtggtctcacagaggtcattagatttcacatctgcacaaaggtcattatgatttcatgtctgcacaaaaagctctattggacagtaactactataaacataaaagtgcgttttatccttaaactcttaggaatngggaagacacgaanggaaggttc

SEQ ID NO: 535504 - DNA, 101 bp, Homo sapiens
aacctatgattatggtggttttacaattaatgtttggatggaccgtcgcggacgcccagtggggtttcccattgaggggaagaaggtaaggttttgacaga

SEQ ID NO: 535505 - DNA, 423 bp, Homo sapiens
  misc_feature (201)..(201): n is a, c, g, or t
  misc_feature (215)..(215): n is a, c, g, or t
  misc_feature (250)..(250): n is a, c, g, or t
  misc_feature (259)..(259): n is a, c, g, or t
  misc_feature (289)..(289): n is a, c, g, or t
  misc_feature (292)..(292): n is a, c, g, or t
  misc_feature (314)..(315): n is a, c, g, or t
  misc_feature (352)..(352): n is a, c, g, or t
  misc_feature (365)..(365): n is a, c, g, or t
  misc_feature (370)..(370): n is a, c, g, or t
  misc_feature (392)..(392): n is a, c, g, or t
  misc_feature (395)..(395): n is a, c, g, or t
  misc_feature (400)..(400): n is a, c, g, or t
  misc_feature (402)..(402): n is a, c, g, or t
ttcagggccaggttggcccccgtgggcgacctggaggaaatccagcgtgggcacccaaagtacctgcacaaggccgttttcaggggcctgctcccggaaaaggcggggcccgtcattaaagtcatccccagcatttttaaccttgtggtcaagttccgcagccaggttatttcccaggcctgggggccccctgggggcccncggggggcaaagcnccccaactttgcactcatgcagcagtcctacaacnccttcaagnactactcccccttttttttcaaaatggtgnccnaactggtgaaccccggctaccnnccccccctggaggacttttttttgggcatcaacttcnacaactactaccnggacncctgagggtgcttttcgggggncgngcccnanaaaggggtttttgggccctta

SEQ ID NO: 535506 - DNA, 440 bp, Homo sapiens
tggggaaacaagcagcaagactcaacctcaaacaaacaaacaaaaagcacaaggtgctagagtcagctttcaccatcccccaaaaaacagatcatcttttgcagggtaagcattgtgttctatagcaggaagtcaagactacggtccagggtctgacctccttggatatctccgggagggctgtgatgagggccactgatgcggggggggggggtctccatttcccggcctctcacccctgcaccttcagggcacacgccacctttcctttttgacatggcagactagctgtgtctgcggggggccacgtagctccagaggggtggttttaagtaggtacagatctactaggacctttcattcaattaacgcttctaggaacggaaagacaacaggagacagagcaaaaaaaaaagaaagcagggggaataaaaagataa

SEQ ID NO: 535507 - DNA, 250 bp, Homo sapiens
ttttattttttattttacccatggctttaatttaacttcttgaaaaaaattttaaactaaaggtcatgtgcaactaaggtcataaaaacctcactttaacacattaattcaaggctggggaatatgaccattcggtattccaataaacacaaaaggcgtgaatttcattaacatatgcctggaataaccagtttttatgaaacctgtaaggcgatcctttaatttctgtccatttaaactgccctggggc

SEQ ID NO: 535508 - DNA, 152 bp, Homo sapiens
attcaccagtctttgattaaacataaatacagcacaattacttcagatcattcttcatatgtatacacacaaacccatgaacataatctgaagtaattgtgctgtatttatgtttattcaccagtctttgattaaataaaaaggaaaaccag

SEQ ID NO: 535509 - DNA, 1416 bp, Homo sapiens
tgttggtgtctctctctcggtgtgcttattgtttcctatggtatgatgtgtctgatttacatgttgacagtgtctactcatctcgcttctgcataataactaaggtctaatcaaaggctattcagacaatccgccaatgtgcatgctatcccaaacctatcgattgatttaccgactcgtatcgataggctatagtattttgcatggctctaaagtgagtctaattatggaattgtattgggattgaccatttttggtctatttacgtagacgcaggaaaaaatatgtaacaacttggtggataattttgttgaattatgcaagtagtgggatggttagtaattatctaacagaaggcttttttctggacgttctcgtgttgtgttactcaccatttagacataaaattgctcgaaatttaaagcgtacttgtatatccctcctctttgtatgaacaaagtatgctagtgcgtttagtggcctgaaattattgcatatattttgcatcgtgtactagctgtgggtagtacactgaggaggtaatgattgcatatgtgtaatataactgtattctggtgattaaatgcacataaagaagtaactgggtgaatttattgtgtgtctctggctgtatatggggttccttttctgggtgaagaacactacttgttgtgagtgtttaccctccctttcagaattggctccacgtgtgcatactatcacgggttacggatggattgttacggtttggcagggacatttacccaaataatttgttcacctaggctggcttgaaatgcctaattgcttcctcttcgtgtacaggcttcggacctatctatggggtttattgcaaatctctatcaaaatgaagcggtataggttctccatggaagagctttactccattcgctgtaaattattttgtccactatcgtagagggctacccaacgaaggaagaaatcatggggtgtcgcaggtgagcgacgcgacttaccaatttacggtgaaattgttcgcagtggcagcgtctaacaagttcaaagggtttgcgttccacttggccttaccgtttatggcctcgggatttaaattattttaccagggtactttcagggttgtcctagataacaaagctttggactccaagagggtcactccctgcggggtaatttcagcgcgacccgagataaatccatagaaaggatccattctgtgagagcaagaggactctaatgtgcctggtggccctgtcatcgaaacatgtgaagggtttcccgtgtttgtggtcccattgaattccgcgttacagtgggccctaccctcgactggtgataattgggaggagggtttacggaacaaaatggcgacactcgtgcagagacgaagaaaacaaagagtgaccgtgactgtaa

SEQ ID NO: 535510 - DNA, 196 bp, Homo sapiens
tggctctcctacacggggtcttctcagaggctgacatgcgcctctatgcggccgacatcatcctgggtcctggcagcaccatgcacgcaccgcttcgtgatctaccgggacctgaagccagccaacatccttctgcgacgagcattcgccacgatccgcgattctcggcaccttgggtccttggtcctggtgcact

SEQ ID NO: 535511 - DNA, 1214 bp, Homo sapiens
cgtctcatgtattccgcttgctactctgttgcctcatagccgcgccgcttctccttctgtttcgccgcgctacttcttgcactgctggctctccggctgtgtttgggcccttgctcttttttctaatagcgcggggttcgccgcccgttccgcggtgttgggtccaccccccccctccgctcgttttttatcgcggcgccccccctctgtcgttgtttgttgctgcgccaacacaccgttttttttgcgccccccctgttgggtggggggggccccttcttcccgcctctcgttgttttgttggagtgtccctcctcttttatttttctctgtttctccccccctcctctcggttcttttgtagtagtgtgttccccctccgcccctgcgtgtgttggttgtgttttctccccccgcgccccttcttgttggttgccccccccccctccccttcctccctcaataaattgcgtgtgagaaaattataaataataaggaggaggagaccccaccactatatttgttataaataaaataatagaaaaaagaaagattgctcccctcccccctcccctctgtctcttccccccctcttctttcttctcctaaataagatatatataatatcaagttggtgtgggctcccccccccccctcccctctctcggaggaaagtatttttttatataaacacacactctcttttattcccccccctctctcacactctcctctatacactccgtcctcccctctctctacactccctcttttttttcgcggggttcttccaccactccccctctctctgccccccgcctgtgttgtttgctccccccccccccctctctagaagcggcgcctctccccccctctctctctcccccgcgcgcgcgtggcgcccctctctttttacccacctcccccctcttttggcgcccctctctctgcgggggtgtctctctctgtactcttctttttttctcccccccccgcgcgcccccccccccctctctctctccccctccctccccgccgcgcgcgctgtatctcctctctcttgtgggccccacccctcgctttttatattttgatagcccccccgctttttgataaaaatctcccccccccccctgcccccccccccaaggagagggggttttattataataaaattttttttttttttttttttccctctttttttttgggga

SEQ ID NO: 535512 - DNA, 2890 bp, Homo sapiens
  misc_feature (115)..(115): n is a, c, g, or t
  misc_feature (2121)..(2121): n is a, c, g, or t
  misc_feature (2129)..(2129): n is a, c, g, or t
  misc_feature (2132)..(2132): n is a, c, g, or t
  misc_feature (2138)..(2139): n is a, c, g, or t
  misc_feature (2145)..(2145): n is a, c, g, or t
acgccgcacgagcggtcaagtgctggaattacaggcctgagcaccgtgctggccgagttattaacttcttaagagcaatgtgctaataaatactcattgatgaccagctcaaatntaggtcattcagacatccagacactggggcacatattctgcaagcaatgctgagacccctgacatagagaaagcaaaggatatgcctatgattagtctaaaatgcagccatcaccccccatacctcttctatggcattcatcctaacatcatggaggcctttgtcctagagaattatgtgacttgccctagagaattagtgaatgaccaaaaagagactttccatttatcttcctttgacttaaaaggcatgaaaataaggcaaaaaaatcaataaaataattttcctgaggaaaggttaagagatggcactttcctttccgggcccagagctggatttctctgaggtttgaccatctcaggactcagacagactccagtgctattttctggacatttgtggtgaagcctcagccaccatgttcaaggtggtttgaatgaaaacatactcagattgtcacatttatagcagggaaataaaaactcaaattaggcatcctgcagcaggctactctgaaaataacattaggcaacatcagagcttcacttgcaaagaaatgttaaaatcattttagggaaatcagtgaagtctctttagaaacagacatcttgtgtatggcgtaacccagtcttggggccctcacggagaagagggggaagtcttttcattgattggtcaaaacaaatctctcatttgcctgatttgaagcatttcaacagtgcctggagagtacattattttcaggggaaaaaaaggagagagtcttttttatatgccagctgggatcatgggaacttcgaatgccaggaatttactactgtttctggtaattctgtgtgtagtcatttgaaatgttgaagtgtgaaaagagaagaaattgggcacttcttgcggcgggggaggggggaggggggggcggtggctttccagattttatgccagttgcaccagcatgcagaatatttgtaatgcatttcaaagtggatataatggcacccttgtcagaatcacaaagctcactgcggactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctgaatttgcactaatggtgtctgagagcaaaaagagtgtgacctctattggaaacctttgttcaaattcaataattcagagatgctacatacttctgcaagcttcctgattatgttcactgtaatattaatgacctaagtttgaatgtatttccttacagtccattaatttgacatccatcttttacctggggattattacaattgcaataagtcattaatgttttcttcacacagcttcttaaaccaagtttctctgcagctctttcggttctgcttacagtgtgtgggaaatctgatttttttcccctagtaatagtttgataagaaatttagtgtattgactgcctcagtgacacaatttatctttaaaggtgtggaagctggtggggaccaaatgttacctgtgtttttgctgttgattgctattttcagaagcaaaccatgtttttcacttacagtaggagtcaacaaatttgggattttagaagggggaggagggagctatttgtgtaagactgctgtcatatttgactacatattaaaaacagtaaatgagcatttgttttaatttcttaaataccttgtctttcaacatacgttttgtttccnttcttccnttngtgttnnaaaggntctacccttgtggaagaaattctgtgtgcagaattcagaggcacaaggctgatggcaagatagaaagttattttgcttctaaacccaccccgatgtggaaactgatactagctagagggagctgtagaaaacaaagatttcaggattgcacagtgtgtgggcaatgggatggagactttttcccctattcccagccacagtgcccaagcgttcaagtctcctggatcagacagatgggattttagctgctgctttaaatcctagtgctggaataagtcaaggtacttcagttcagctcttgcctctgtcactaatcttgctttatgaactcctttgattttctgaataagttccagaaggttctctattattctgtccttcttccaaactggaaatggctgtatctaattctcaggatattttggatgtgtgcctcaggtaatttatgtggaatgtgtaaagcaagatgtctccaattctgaatattccttccccttttcccaatcctccactcttggactacctttataacaacaccgagtacgcacagacctgaacccatgcccaagaagcacacacaatgactggagctgtcgggaattcctgtcagtggcattccctgagcactggctctgtacaactcaattataattttttaagaatcatacctctgtatagatcttttggactgtactgattaaactttgatattgtggagtaaattcagaagtgcaattttgaaaaa

SEQ ID NO: 535513 - DNA, 2070 bp, Homo sapiens
  misc_feature (115)..(115): n is a, c, g, or t
acgccgcacgagcggtcaagtgctggaattacaggcctgagcaccgtgctggccgagttattaacttcttaagagcaatgtgctaataaatactcattgatgaccagctcaaatntaggtcattcagacatccagacactggggcacatattctgcaagcaatgctgagacccctgacatagagaaagcaaaggatatgcctatgattagtctaaaatgcagccatcaccccccatacctcttctatggcattcatcctaacatcatggaggcctttgtcctagagaattatgtgacttgccctagagaattagtgaatgaccaaaaagagactttccatttatcttcctttgacttaaaaggcatgaaaataaggcaaaaaaatcaataaaataattttcctgaggaaaggttaagagatggcactttcctttccgggcccagagctggatttctctgaggtttgaccatctcaggactcagacagactccagtgctattttctggacatttgtggtgaagcctcagccaccatgttcaaggtggtttgaatgaaaacatactcagattgtcacatttatagcagggaaataaaaactcaaattaggcatcctgcagcaggctactctgaaaataacattaggcaacatcagagcttcacttgcaaagaaatgttaaaatcattttagggaaatcagtgaagtctctttagaaacagacatcttgtgtatggcgtaacccagtcttggggccctcacggagaagagggggaagtcttttcattgattggtcaaaacaaatctctcatttgcctgatttgaagcatttcaacagtgcctggagagtacattattttcaggggaaaaaaaggagagagtcttttttatatgccagctgggatcatgggaacttcgaatgccaggaatttactactgtttctggtaattctgtgtgtagtcatttgaaatgttgaagtgtgaaaagagaagaaattgggcacttcttgcggcgggggaggggggaggggggggcggtggctttccagattttatgccagttgcaccagcatgcagaatatttgtaatgcatttcaaagtggatataatggcacccttgtcagaatcacaaagctcactgcggactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctgaatttgcactaatggtgtctgagagcaaaaagagtgtgacctctattggaaacctttgttcaaattcaataattcagagatgctacatacttctgcaagcttcctgattatgttcactgtaatattaatgacctaagtttgaatgtatttccttacagtccattaatttgacatccatcttttacctggggattattacaattgcaataagtcattaatgttttcttcacacagcttcttaaaccaagtttctctgcagctctttcggttctgcttacagtgtgtgggaaatctgatttttttcccctagtaatagtttgataagaaatttagtgtattgactgcctcagtgacacaatttatctttaaaggtgtggaagctggtggggaccaaatgttacctgtgtttttgctgttgattgctattttcagaagcaaaccatgtttttcacttacagtaggagtcaacaaatttgggattttagaagggggaggagggagctatttgtgtaagactgctgtcatatttgactacatattaaaaacagtaaatgagca

SEQ ID NO: 535514 - DNA, 1056 bp, Homo sapiens
taaccgggatcgcgctcggacctcttccggccctgctcgttcggctctccagcttgggatggcctggcgttagctgcgggtcgtgcgctcgctctgcaggagcctcaggctctgctggcctggtgcctgtggcgccggcggccctgacatgtccccacctcgcaagagcagccgatggcgccactatgtccgacaaaaggatcaaggtggctgaagcccgtggtggagatggatggtgatgagatgaccctgtattatcttggcagttcatcacgcgcgaagcatcatccatgcctacgtggacatccagctagcatgtattttggacctcagtgctcccaaaccgtgaccagaacgtgatgacgcaggctccccattgcactcgtgctactggccacccagaaagtaccagtgtggactgtacgacgtgtgccacccaatgactcgcctggatagcaggcgcatgctgctgggaagcagtttcaatgcgtgcagacacgatggtggacacagctcccgtaagttgggcagactttatcacgctgaaaccatccagtggacagcgtggacaacggatcgatcacccgcggcagaccacgacttatgtcgttgcataacatgcatcacgtcgctccacgtgcacgtatgttcaccatacgaccttggtagccaagcaggaccgccaaattagccccgattatgggcacagtgaatatcgccgccgcgttgggcacaaaagcatatgctcacagtcacgggccgccgagggaaggcttcagctcctagaggccaatagagccattatttaactcagagctcgactcgttttcacgacacagctgcgcataatctccattgtgcccgtaaaaacacgctgcgtgttaaggggcggcctgcgtgcaaccgtgcaaggcactagtccccccgacaccatcgcatgtccagacgcttacgcacacgcgactacaacctcgggtgcgcgttcgcacgcagccactattggtgccactgtgatccaagaaagagaacccagaccgctgctcgttgccacgcgtc

SEQ ID NO: 535515 - DNA, 626 bp, Homo sapiens
agcggatgtgggcggaccgtgcgggctggaggtgtgaggatccgaacccagggttggggggtggaggcggctgctgcgatcgaaggggacttgagactcaccggacgaacgccatgagggccctgtgggtgctgggcctctgctgcgtcctgctgacctgtcgggtcggtcatgagctgacgagtgaagttgatagtggagtggtacaagtacgaagaggatctgggtaagaagtagagaaggatcaaggacggatgatgaagtagtacagagagaggaagaagctattcagttggatggattaaatgcatcacaaagtaagagaacttagagagaagtctggaaaagtttgccttccgaagtccaagagttgaacagagatgatgaaaacttatcattcaagttcattggtagtagaagaagtaaaggagattgtgccgtgagagaaactgactttcacaactgcctgtctggagtgctttagagtaaggataaggggtaatatccactgactgatgaaaatgctctttctggaaatgaggaacctaacagtcaagaattaaggggtgataaggagaagaacctgctgcatgtcacatgacagcggtgtaggaatgaccagagaa

SEQ ID NO: 535516 - DNA, 853 bp, Homo sapiens
ggaagtcactgccatggaagctttcctttaatatttcttacacttgtggcgcagctcgatctttgttttataccacatagccaaaacatatctccttgccttctaatgtgtgaaactgcgattttctctaacgtgagattcaagatctgcctttgtaggacctgcgctttgtgacacgcagaaaaccgatcattctactacgagctacctaggaacgcctcgaaggttgagacgcagttcataaacatcgatcgcatgcaccagaccatgattcactcagcggtcgagcgaaccgtagctgagttagtaaaacacaaattcaccatatggccctatcaatggagcacagccaactatgttacttttacctgttgtccaaattttagatgcacattttactaacaattttaaaccatatttcttccttcttcatactccactttctaactccatcataacctagcttattgtttaccatataatactttgtatacaattcagcgaaggaaagttttcaaagcatcactgtctcatttgatatccacaacttattgtcaggtaggaaagcagagatgtttttcccacctgtcagatgaaaaaactgaagctcataaagggcttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctatttttacactttatagctcctgttattaatagcaagttaaatggtataaag

SEQ ID NO: 535517 - DNA, 100 bp, Homo sapiens
gatatcggaccagtcagcggtcagtcagcggtcggttcgcctgctgggggtctgttgtgttggaagaagacagaggtgctccgcttactgagcttactga

SEQ ID NO: 535518 - DNA, 561 bp, Homo sapiens
agcttatccagtgtagaacgagggatcagtgatgtgatactactttgtcatagccgtgtcctcgatgtatagcggcttagctgtttccccagtatatgtctcggtatctttctagaaatagaaaatgagttcactgtagatgtgtggatttgtttctgagttctgtattctgtccattggtttatgtgtctgcttttacgccagaatcatgctgtttaggttactataactctgtagtataatttgaagtctgataatgtgattcttccagtttagttctttctgcttagtatagttttgggaattctggaacttttgtagttccgtgtaagttttaggattgttttttctatttctgtgaagagtgtcattggtattttgatagggattgcattgaatctatagattgctttggatagtatggacagtttaacaatattgattcttccagtccatgaacatgaaatatctttacattttattggtgtcctcttcaatttcattcagtttgcttttcagattggtcactgtcaatgtttagaaatgctgctgactttagta

SEQ ID NO: 535519 - DNA, 204 bp, Homo sapiens
tgggatgaggagaaagatgataacagtaaacaaataatactagtagtgatagctgacatttatatggtgcttactgtgtgccaagtcctgtttgaagtactctacattattcactcatttaatctttgaaataagcctgtgagatattagtatccctatctgacagatgaggaaaactgagttccagggagattaagtaatttg

SEQ ID NO: 535520 - DNA, 156 bp, Homo sapiens
  misc_feature (15)..(16): n is a, c, g, or t
  misc_feature (20)..(21): n is a, c, g, or t
  misc_feature (24)..(24): n is a, c, g, or t
  misc_feature (27)..(27): n is a, c, g, or t
  misc_feature (37)..(37): n is a, c, g, or t
  misc_feature (64)..(64): n is a, c, g, or t
  misc_feature (112)..(112): n is a, c, g, or t
gatcctccacaaaanncacnncgngcnaaaagcggtnattcagtcggtaccctggacaagaatngatgatggtgtgggtggagggaagcggcaactagggtagaagaatgtnctgagtggggaagcagcagccccactgtgtcctagtagcagcct

SEQ ID NO: 535521 - DNA, 530 bp, Homo sapiens
  misc_feature (12)..(12): n is a, c, g, or t
  misc_feature (29)..(29): n is a, c, g, or t
  misc_feature (35)..(35): n is a, c, g, or t
  misc_feature (44)..(44): n is a, c, g, or t
  misc_feature (64)..(64): n is a, c, g, or t
  misc_feature (78)..(78): n is a, c, g, or t
  misc_feature (471)..(471): n is a, c, g, or t
  misc_feature (476)..(476): n is a, c, g, or t
  misc_feature (507)..(507): n is a, c, g, or t
  misc_feature (516)..(516): n is a, c, g, or t
ttcacaggatgncaatcattgtgtcactncactgncagcctagnaacttcctgggtgctcaagnccatgcctgctagncctcagctacttgggaggctgaggctggaggattgcttgaggtcaagtattggaggctgcagtgtaccatgatggtgcctataggaatagctactgcactccaacctgggacaacgttatcaagaccccatctcttagtaaaaatgccaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaataataaaaatagttggatatggtggcatgtgtctgtagtcccagccactctggaggctaaggttggaggatcagtagagcccagggaggtcaaggctncagtnggccatgatcatgtcactgctctccaacctnggcgacatncagaccctgtctca

SEQ ID NO: 535522 - DNA, 178 bp, Homo sapiens
gctgacctcagatgatccgcccacctcagcctcccaaagtgctgggattacagcgtgcgaccgtgcccgaccagtgtattttatatgtggctcagcaattcttccagtgttgctcagggagcgaaatattggacatcctggagacactcatactgaatgaggtttaccgataggcatg

SEQ ID NO: 535523 - DNA, 406 bp, Homo sapiens
ctcggggtctaatattgcatgtggaattaggtccaaggatctccagagggtgaaacgctggcgtctgtcagtgtccgtactgagacagcacagccaacctagctagcaacattggttaaaggtctgaacaatatatacttatagaattcagtcaaagatacacaatctgaaacagctacaatggggtgtactctcaacagtagttgcaatgtattagaatgagcacttacttctctgctatctagatctgacactccgtggctactttacttagtacaagccccagccaaaggaaagccagttacattaaaagtgggctcagtgagtctaagcagcttaacctaaaattattgagcacccgaaagggggtaaccggagcatcagaattacgtcaatcccttggtct

SEQ ID NO: 535524 - DNA, 339 bp, Homo sapiens
  misc_feature (63)..(63): n is a, c, g, or t
ctccacccgatgggtggaggtgaggtttggtagaagatgactcgtgttgaaatgtgctccccnagtgctggtggtgaggtttggtagaagatgactcgtgttgaagtgtgctccccaatgctggaggagaggtttggtagaagatgactcgtgttgaaatgtgctccccaatgctggaggtgaggtttggtagaagatgactcgtgttgaagtgtgccccccaatgctggaggtgaggtttggtagaagatgactcgtgttgaagtgtgctccccaatgctggaggtgaggtttggtagaagatgactcgtgttgaaatgtgcaccccgtcgggtggag

SEQ ID NO: 535525 - DNA, 166 bp, Homo sapiens
atgtaaaactttcttgagctgcaggacaagctggtgctactcttcctgtagagccaaaagctaaacctccaacttaagaatttgtaccttggtctcctctaatgacatactactcttccatactaccttatacttaccttctctcctgtaacttaccttaatactt

SEQ ID NO: 535526 - DNA, 873 bp, Homo sapiens
gctatccctcggtctgggcttctctgagagctggcgagagatggtcaggtctggagctcaaccgggccaggtgttatcttcaggaaggcacactggacctgctaacacttaacaaatggaaagaaagcgacctatttaagaagaaataccacggttttaatgcagacttctggctagttccatccattctgagttcagaaagtcaggcctgacaactgtacactgggccttgactgcgttgtgacttcatttgctgagaggacacttcttgagacaatgacagatttcaggcttcaagacaagcagccactactgttagaacaaaccaggactcgtaactttcgtacggaaccgttataggaaagacgcaacaaggaataccgcgaattcagacacacaaaggtacacacagcaacaatgaacatagacagcaatttaacgttaatttccgtgtatgggataagcttccaagcaaagagccaccaccgagttccagtcgtttgcaagcaagttaaagtacacgcaaacacgccaaggaattagccttaacgtggaaacgccatatcctttcccttacggaaacgccttggaacaccaggaacccaaaccaatcatacttctaggaaagcccgattaggccaaggccccaaagcaaaccttggagcgttcaacttctggcctagcacgtaacgtcccagtacaaacttaggaaaacctggactcgcgttatcccaacgcccacaatttaacagcgtaacgttagaccccataacacgacccggcaatcccttggcattgcaaaggccaacccaggataggagcaacgtaaacaacgtccaaaagaaaagttgggttccaacccgttggaaacct

SEQ ID NO: 535527 - DNA, 340 bp, Homo sapiens
  misc_feature (155)..(155): n is a, c, g, or t
aagcagaattcggcacgaggctttggcagctcgggactaagtccaagattaagcatgtttcttcagaggctctccaggttctcctctgtaattcggtcagccgtttcagtccatttgcgggggaccattggtgttaaagcagtggcatttattanggaccttgatcctttacagaactctttgtggcagattagagatacaatctaagcgacaccatctggggccctttgatgctagttcagagtacaacagactgagaggagcttttagctcagaaattttgtatgcgcatgattcattcccctctattggggaccatttgggcacgaacccgggcctg

SEQ ID NO: 535528 - DNA, 143 bp, Homo sapiens
  misc_feature (142)..(142): n is a, c, g, or t
aattatgacagaatattggtgaaagttagagatttacaaatgctgacaaaatatttcctagcatcagtagattctggcatatgttctgctagctatatatttaggaattcaaagcataaaactttggctacatctaccgtgng

SEQ ID NO: 535529 - DNA, 179 bp, Homo sapiens
  misc_feature (117)..(117): n is a, c, g, or t
gcctgggattttccaaacaattttaatttcctcagagtcttccttaatccgtagggaacaaggaggctggcactggaagtagggcccagtatagggggctggcttttctactccctncccccacaatataaacaatactagacttttttattttttattttttattttattttctctta

SEQ ID NO: 535530 - DNA, 274 bp, Homo sapiens
acttacttcgggctcttatacaattgttaagaaatatgaagtggacttttgttgtagttgttttcagatatacccagtctgtcacccgtaactgatatacaaagggaaaacagtgaaaaaaagtacatattctgtggcacatgcacgagatcagaacaaatataactaaactgttatgacattaacagttgccatgcatgtagagtttcacatgttactacgaacttattataattacacaaggtttgctaaacatgctaaccatctacatgca

SEQ ID NO: 535531 - DNA, 189 bp, Homo sapiens
gacgtgagtcttggtggctggtctggctgctcctggcgcacactcgcgtaggtggctggttgctgtttgagccagcttggacttgcttggactgcacaggctctcagtgcaacacactgtgctacaaactggagccacagatgaggaaacgagccgcaggttcaggagcagtgtgtgctctcgcctttt

SEQ ID NO: 535532 - DNA, 1091 bp, Homo sapiens
tggatactgagcagtaacaaggaacgtgggcatctggttgaaaggagaagaccagatctgaattaggtgacgactgtggacaaggtaggtctagcactaggcaatctgcccacccccgcatgggtgttaggctgccgactagagccgggcctatgctcactagactagtcaccaacgtgctacatcttactatctggtgcttggctatttctgctggcgggctcctacacttctcctaaaactactcggctggcgacaagttagacacgacggaggacacaagccactgtatgacgactggctgaagaacgacttactacgaccgtaggtccaagagaccactctaccgctcgcgacctgtggagcacgagacactcggacgccgctactccactactgtacggcactccgtgccaacgtagacagcagacacgcctctgactcccataccacagaacgaccagagacggcagcactagacacgacgttgtcatcgggacacagaaggctgatcggcagcttccatgagcacatcacaaaccgaacatccccggcaatcccaggacagagcaggatccacacacagacagattcgacatcaagcacgcacgcggaccgaactgacactggagtagataggccacgaattggccgaccataccagaccccatacatctaccacattatccttctatgaagcataccaggacagacaggacttacaacgactcccccgacgcagcatgaggcacgcacatcctgaattatccccattggagcatccacagtcacgccgctgcatgtcccccctcagaggtacccacaggcagccatgtaaatgttcagccaatgaaaagcggccccgaccatcgccggcacgcaggggattccgaaccacctaagcgggccactattgacccgaccgagttgtcacgactagaaaaaagtatctcacacgcaaaccattataggacccctactttgtgcaccaccgttatctgcacgaagaatccaccttactgactatacacccttgagagaacacaaccggatagtatcaccacaaacaaagtaggagatcgatcgagccc

SEQ ID NO: 535533 - DNA, 763 bp, Homo sapiens
  misc_feature (488)..(488): n is a, c, g, or t
  misc_feature (576)..(576): n is a, c, g, or t
  misc_feature (595)..(595): n is a, c, g, or t
  misc_feature (605)..(605): n is a, c, g, or t
  misc_feature (647)..(647): n is a, c, g, or t
ctggtgtgcagcctcagtgacgtttatcagatggagaaggacattgccatggagcaagagaggaatgctcgctaccgaacccccaaaatcttggagcccacagccttccaggaacccccacccaagccgagccgacctaagtacagaccccctccgcaaaccaacctcctggctccaaagctgcagttccaggttcctgagggtctgtgtgccagctctcctacgctcaccaggccctatggagtatccatctcccgttaactcactgcacaccccgaccgtctccaccggcacaatgtcttcaaacgccacagcatgcgggaggaggacattcatccaatcaccagcagcctgagaagaggcccagcagcgtgtggagaggctgaaaaggtcaaacatgcggcaaatcctggacgaacagcagaagcagatggtggaggactaccaggtggctcaggcaggaggagaagtccctggaccccatggtntatatgaatgatacgtccccattgacgccagagaaggaggtcggctacctggagttcacagggcccccacagaagcccccgaggctgngcgcacagtccatccagcncacagctaanctggaccggaccgatgacctggtgtacctcaatgtcatgganctggtgcgggccgtgctggagctcaagaatgagctctgtcagctgccccccgagggctacgtggtggtggtgaagtgtggggctgaccctggggctcatcgggagcgtggatgagc

SEQ ID NO: 535534 - DNA, 568 bp, Homo sapiens
  misc_feature (293)..(293): n is a, c, g, or t
  misc_feature (381)..(381): n is a, c, g, or t
  misc_feature (400)..(400): n is a, c, g, or t
  misc_feature (410)..(410): n is a, c, g, or t
  misc_feature (452)..(452): n is a, c, g, or t
ctggtgtgcagcctcagtgacgtttatcagatggagaaggacattgccatggagcaagagaggaatgctcgctaccgaacccccaaaatcttggagcccacagccttccaggaacccccacccaagccgagccgacctaagtacagaccccctccgcaaaccaacctcctggctccaaagctgcagttccaggaggaggacttcatccaacccagcagccgagaagaggcccagcagctgtgggaggctgggtctggctcaggcaggaggagaagtccctggaccccatggtntatatgaatgatacgtccccattgacgccagagaaggaggtcggctacctggagttcacagggcccccacagaagcccccgaggctgngcgcacagtccatccagcncacagctaanctggaccggaccgatgacctggtgtacctcaatgtcatgganctggtgcgggccgtgctggagctcaagaatgagctctgtcagctgccccccgagggctacgtggtggtggtgaagtgtggggctgaccctggggctcatcgggagcgtggatgagc

SEQ ID NO: 535535 - DNA, 1229 bp, Homo sapiens
caccctcccgcgcgtgtcattcatcccgggtcgttctttttctgtgaccccttcatgattctcctcgggtatccgcccattcagccgtgttttttgctccctcctttttgtgttgtctcccgggtgagccggttttccatgtcctttcggtgacgttctagcctttgggtcctcgtcggttgtccggtattatactatgttgtgcacacacctgtgtatatcgtgctattgtgtacccttttttgggcccctatttttaggggttaccatcttttccgctacatgtttgtgttccatatatagtcttggctctgggtaccctggttcccgggtattttcccgtggattctgtcttcctgctgtatcttgctgtggggcggcttcttgcaatgtgagatcttggattaccttcagcctgtgtctagccatcatctgatgggcaagaatcgttttgcgtgtcatcgtggggcctgctcccgcctctcatcgcagaccctggtatcagattcggtacaatcgaaccgatagtccatgaggtgcctcatgatgggccctatgtgtgacctcctctggttctgacccagtaagtactacctacaggtctggtggcgtgtagcccccgtaggagtccggctacctatttggcagtgtacgtggtggcccagttccaacgctagcctaatgtactattgacatgatcctgccgtgtccctacctatctggtgatggaagggttacaagtggcacttctaatgagtacggtgctcactgtgtggtcggcacccaactatctgctaccgctgtgggtaatgtggcagccatcttggagctggtacgagcatctcctagtaaagattgtcatctatcttttgagtgcatgctccccttagagacatcggggcatcgcctctccatagaaagcccgtggccgtactacgttccatgtgaccccgcctcggcccctgccccctcctaacccttctggcccatcgcaccactgtgaatctgccaatcttccatcagacggaggactgggagtggggggagagtctgtcctggctctgctgtcccccaagagggtgattacgagggtgaggacttctcatggagaggcctggagacatagacatccatgttcatcatcctctctccccaacttgaaaccactgaagtttccaataatttatttttcatttttttccttcttttactctgttggtttatagatt

SEQ ID NO: 535536 - DNA, 230 bp, Homo sapiens
actctacttgggtgaaggagtgacactggtgtggtatacagttgtctgcacactgttgtggctcatataagcaggttctagagccttctttcctgccaggcgtttcccaataccaaccgctggttcctcaccgtgcattaaccatgccccagttcctgggctgtcgttgggcgaagtgaaacgtgtgtgagacagatggcccatgtttgatagctaaaaatgtttgcaga

SEQ ID NO: 535537 - DNA, 248 bp, Homo sapiens
  misc_feature (32)..(32): n is a, c, g, or t
  misc_feature (86)..(86): n is a, c, g, or t
  misc_feature (197)..(197): n is a, c, g, or t
  misc_feature (204)..(204): n is a, c, g, or t
tcacgggcctcgtggcctgcttcattgacatngtggtggaaaacctggctggcctcaagtacagggtcatcaagggcaatattganaagttaacagagaagggcggactgtccttcaatagttgatgtgttcacgctgaacgccgccttcgtgctcgtggactctgtgattgtggctttcatagagccgttggctgntgacagnggaatcccccagatcaagtgcttcctcaacgtggtgaagatccc

SEQ ID NO: 535538 - DNA, 461 bp, Homo sapiens
ttatttttatttttttgagatgagtcttgctctttttgcccaggttgaagtgcggtggcacgatctcggctcactgcaacctccgctcctgggttcaagcgattctcctgcctcagccacccgagtagctggaactgcaggtgcccaccaccacacttgactaatttttgtatttttagtagagatggggtttcaccatgttggccaggctggtctcgaactcctgacctcaagtgatccacctgccacagcctcccaaagtgtggggattacaggcatgagccactgagcctggccgagaaatattttcctaatacaatatataatatgagctctcttgaaagtagcatctgagaattttgaaaagaatgaatacattgtaccccctaagaagaggagcagtgtggaatttttagtttgtttaatctacccattgccgttgaaatggtgctggttaatag

SEQ ID NO: 535539 - DNA, 526 bp, Homo sapiens
  misc_feature (500)..(500): n is a, c, g, or t
  misc_feature (510)..(510): n is a, c, g, or t
ctcttgctttgcttatcatggtgtccaagagctcgcgcggtcccggcatggccgccgccggcagcgaggcggaggaggcgctcctgctgccggagcgcgtcgccggtgacgcgggggcgcctcccggcaacgcgtccgtcctcggcgcggtgttcaacgtgtcgacgagcgtggtgggcgccgggatcatgtcgatcccggcggccatgcgggtgctcggcgtggccccggccctggcgctcatcgtgtgcgtagcgctcctcgccaacgtcgccgtggacttcatgctccggtacacccggggcacgccgtcgtacgcggcgctgatgggcggctcgttcggccgcgccggcgccaagctgctcaacgtcttcatcgccttcaactgcgtcgggaccctcaccgtctacctcataatcatcggggacgtgatgtccggccccgtgggcagcggggaggcgcacgccggggtgctgccggagtggttcggcccgcactgntggaccggcnggatgcggtgctggtg

SEQ ID NO: 535540 - DNA, 117 bp, Homo sapiens
gtgaatgagccaatttattaacccagcatggtgtgggggggtgcttcttgttggcagctgccacctgtccggcgattctgtccagatctctgggtcgcttatgtcgtaatctaacag

SEQ ID NO: 535541 - DNA, 460 bp, Homo sapiens
aagcagtggtatcaacgcagagtggcattatggccgggggggggttaaaaaaaaaaaaaaaaaaaaaaaggaaaaaaaaaaaaaaaaaaaaaaaaaaaaaaacatgtgtgtggggcgcgcgcgcgcgcgggccccgaagaaaagttttctaaagaacaccaccgcgcgggggggcgcgcgggggcgcccaagagagggaagggagagaaagggggacacaaagcggggttctctctaagagagagagacacccgggggcacagagagaaaagggcggggggtttctcccccaataaaaaaaacgcgcgcgcggggggacgaaccggagggggttaggagaaaaaatacccacaagagggaggttctggggggcaaaaggggggattattaataaagggggagaccaaaaggagggcccgaaattaaaaattacccccgagggggggggataaggaaggag

SEQ ID NO: 535542 - DNA, 236 bp, Homo sapiens
ccatcctcccacaaaaacctgtacacaaatctcatagcatcattattcatagtggccaaaaaaatacacttaacccaatgtccatcacttcatgaactgacatgtaaaatatgatatatcacaacaatggagttattcagcaataaaaacacaggcctggcatggtggctcacgcctgtaatcccaccactttgggacgctgaggcaagtggatcacccgtgggcacgaaaatcac

SEQ ID NO: 535543 - DNA, 150 bp, Homo sapiens
  misc_feature (107)..(107): n is a, c, g, or t
  misc_feature (119)..(119): n is a, c, g, or t
gagaatgcagcgacgatgtgcgaaggtcctacggcgcgggcttcgttagcgggccctttgtcaccgacagcgaacctcaacttcgtcgagtaagaatgtttaacccnctgtgtcgtcgngtaccgcgaagcgtcgacgcgaaatggtctg

SEQ ID NO: 535544 - DNA, 102 bp, Homo sapiens
ccctgtgaagtaaccaactggtttttggtttttttttccccccccgttttaatgttatgggtaatggatttaaacccctatttaaataaaacctgttttcca

SEQ ID NO: 535545 - DNA, 619 bp, Homo sapiens
ccggtcaatcaaattagtaaaattaaagagaagttagaaaactcaatataggatgcagcatagctacaaaacccactctacttatgggactattacttcgagaaaataatttaagagaaaagccgggtgggttgtggtggctcacgcctgtaatcccaacactttgggaggctcaggcaggtggattgctttagcccaggagtctgagactagcctgggaaacatggcaaaaacccatccccacaaaatattaatatatagaaattagccaggagtggaggcacacgcctgtagtcccagctactcaggaggctgtgacaggaggattgcttgagcccaggaggtcaagacttcaagtgagccataatcatgccactttccagcctgggcaacagagtaagaccctttctcaacaaaaacacaaaaatcactgtttaccttctctaacccttatcattatgtaaacataatttaatagtttaatcagtatgccttattattattttttcctcttattcatttagtatcattttttaaagtatatttctataggcactatagaaccctgctgaaattggctgaggatactcttcagtggggccagaagttcttagcatta

SEQ ID NO: 535546 - DNA, 715 bp, Homo sapiens
gggttgatgggaatcatcatatttggtttcattataagaaggaccattagccacacaacggttgatatcattttggcaaatccgggttcttgtatttggtagatcttgcagctgtgtgtcagctgaagacagcggacaatgctgacaaatgctaagaagataattgataaatgcatgttgatatatatgaggcaggctgttacttggcactgtattatccttagctcgcaaggtgccacacccgagtttacagcagttttcattggtcaagccagagtgagctgtaaatcggatgtaagaagattatgtaagtagatgctcacacacctgtgattcgtattcttgacgataaaagcccactttgcataacaccttacacatattccaattcaacatccttattcatctagcatgttttccagcttgctccagcattctatctatagagcaactttctctattctaccggtattcgagttcaattggcctaattgcccaattttgagtgttactacaattaattgctcgatgacataatcttatttactgttgagattttgcgtatacgtcctaatttgccgtatttccaaagtttttaaccttttgcctaatggaaattggctctgaccgtttgtctaaagttccgttaatttttggttcattattctattttctacccgtagtttgtctctagcccgttcttattcatgtttcc

SEQ ID NO: 535547 - DNA, 597 bp, Homo sapiens
  misc_feature (597)..(597): n is a, c, g, or t
gggggtaaatagtaggtgcatatatttatggaatatatgagatattttggcacaagcatgcaatgtgtaataatcacataatggaagatggggcctacatcaccttaagcatttatgcattgcattacaaacaatccaatgatactcttttagttattacaaatgtacaattaaattattattgactatagtcaccctgttgtgctatcaaacactaggtcttattctttctatttttttgaattcatcagccatcctcacttaccctccaaccccccactacgctttccagcctgtggtaactatcctactaggctctatgtccatgagttaagttattttgatctttagatctcacacataacttagaacatgtgatgtttatctatccgagcctcatttatgttacttaatataatgacctccagttgaatttattttgtttaacgatattcttttaacataggtttttgagagttagtaagtatatgccagtcccagcataccaaacattgcaccttaagaaatagagtccacgcttggtacatagaaagcgtacagccaaatctttatttgcatgttctaagacttctaaan

SEQ ID NO: 535548 - DNA, 385 bp, Homo sapiens
cataactcataccctgtagttcaacaatgtgtagccagtcactgatcagtattacttcagtaaaccaatgaaaatcctgacaaacaactttgcatcagcccactccttgtctcccctgctcttccacctactttttttggtctttgctacctgcttgtaataaaggctgaactgaacaggagcttatatccaaggttacttggatctgagtcttctgggcaattttcttagatttagctcaagtaaattcattgaaattatattttgtgcctcagcttctgcctttaggttggacaaagtttatttaactttgtgatatgtttagatttaggtacttttttcccaaacaggcaatggggtgttttcctccaaaatcaaagtgccc

SEQ ID NO: 535549 - DNA, 236 bp, Homo sapiens
cccccaaaaaaaaaaggggggcagaaggaacaataaagtcaaaacgggtgggaaatttctcctttgctctgaaaattttacttctttgggtctcaggtccccatttcccccccaaagacatgcaaaacgattttttcttgaaatccctcgggaagaagacatgtttattgaaactgttccttcagccttaaatacaaaaataaaactgaaactgctccagaaagcagctttttcca

SEQ ID NO: 535550 - DNA, 320 bp, Homo sapiens
  misc_feature (19)..(19): n is a, c, g, or t
  misc_feature (66)..(66): n is a, c, g, or t
  misc_feature (77)..(77): n is a, c, g, or t
  misc_feature (88)..(88): n is a, c, g, or t
  misc_feature (253)..(253): n is a, c, g, or t
  misc_feature (282)..(282): n is a, c, g, or t
  misc_feature (285)..(285): n is a, c, g, or t
  misc_feature (288)..(288): n is a, c, g, or t
agaagtagttacttccttnagaatatcctcaggaatcttatgatccaacaagataacctcctgatnagctgcatccnacgtgttcctnagtattaatctggacgctggggaaggcggtcttgagcaggtagaacatcttgcggttggacagcacgtcgccgctggtcatcttgtcctcggctccctcgcgcgtcttccccttggacttctcgtggaggacgttgctctcgggacgcgcctcacctcgttcgcncgcggactgcggccagcactgacacagcnaanatnacgcgcaagtcccacggtgcccacacgacgcc

SEQ ID NO: 535551 - DNA, 1019 bp, Homo sapiens
  misc_feature (50)..(50): n is a, c, g, or t
  misc_feature (112)..(112): n is a, c, g, or t
  misc_feature (123)..(123): n is a, c, g, or t
aggagagtgcgcctgcccctgccccgaagagttaggtatcttggaaaganggtcatgtaacttgagacaatttttgactgtattctccagcagcactgcggtggctctgggnacattggtggngagaggtccttttggataggtttgaacgaccaagtgcatgctggccactgggagtggatcggtggtgaacctgttgccttcaccaatgggagaagagggccctctccacgctccaagcttggaaagagctgtgttttggttcatatacaagggagaagggaaacaaaagactgtaggagagccaaacctgataattatgtgtgttccagaatactctaaatataacagaccctacggggggccatttggaaatttgtcacctatttaattccgaggatgtggcaaatatggctctatacgaaaacaaaacaggcagaatggactggggaaacctttgccaacagtgtgcgagggagacggggagctctaggagagggctagccacactaatctattgtctagtgcttctcttacctgattactattatgagctgacgcctgtagcatccgaaaacgcccacccagcagatatttcaagtgatgttttacaattgtttatgcatctcacaccacccgcccgtgtatttatatgtagaaatgtcacttggtttgtacaacctgtgaaaaaaccactctattctgctttcgtggtaccactgggaatgggtatcacacagaacggtacttgcgagtgcctccccccccaaacgagtagggattgaaaaagtgacacatagggttggtagtaagacagaaaccacaccatcagacactggagtgccatcgccagacactttgttcatatcgtggatagtaagaatacgggcgaacgatcaccgtgttttggatctgctacctcacatctagcactccaccggactccgcattattcctgcccggcgtcgcgtttattctactctggtgaaggtggtacgcgtaaacttacacaaatatgg

SEQ ID NO: 535552 - DNA, 421 bp, Homo sapiens
ggtatagcgagtatgtcatgattaccggtcatcgctttattgacatctgacatgccatcatacctcgacgaattggcccgtcaagaatgacctgaggtcccgatggacgaagacttcaaactcggcaccctgaagcgtctgggcctgcctcactcgacccaagctgacgtcggtaaggcctggcaggccatgctggcacgagtacgcgactggcacgatttagacccccgctttaacacggagatggagaaacttatcgatttcgtcacgcgtgaccatgtcgacgagctggacaatggggagatggcatgagtattgacgtcgacacggtgtctgacctcatccgggatgtgagtgccagggttatcgatccccggttccggaccctccacgatcatcaaatccaccagaaaaagcccgg

SEQ ID NO: 535553 - DNA, 567 bp, Homo sapiens
  misc_feature (421)..(421): n is a, c, g, or t
ggaatgtatttttaatccgcagcccattttgcctgtgggaagtttttttaaagagcggcttgtccagaccttaaaaactattgaacctgcagaagcccaaaggcctcttagacctttctagaatgtaactaagtatctggaaggacgggtggttttggatcaaagccattgtttaagaactgaaaaggtgtggctacatctactggccaacaaaaacagggataatccagctgctttgaaagctgcacagaaaaccttacttgtttcacctctgcagttgataataatgaagcacagaaaaaaaaacaggaggcattgaaacttcagcaggatgtaaggaaaaggaaacaagaaattttagaaaagcccatttgaacacagaagatggtaatttcaaaactggggaaaaaaattaccaaantgaagatgaggtcaaggtggtttttctggacgctgtttccaaaaaggttaaaaaccagactcagatgcccaaggaattacctgcccacgactgggtttatatgcaggtcggggaagaagcacctgtccttatggagggttccgcct

SEQ ID NO: 535554 - DNA, 819 bp, Homo sapiens
ggagaaaggtgtacttaggtacacatttcgctaagtgggcgttactgtgaacggttgaacctgctgagtggcgcgttgtagagctccagtgttcacgttcagtgtcaacaccattcaacagctgtgtgcacatcttcgtacaacataatgctggctttggtgccccgttgtatgccgaccgtgtagatataattgttataagcaggggtcccacaactctactgcaaatgatctgtgaacaggttatcagtggatatgagttgcgtcctagaggagtcaatattgtatccgtttaaggggttttctaacttgttgctatccctcccgcgtgatccaaaatagaagggggggtttactagaagtttacacatgataaacggaacacagaggagtggccgtggggctctcggctcatgcttgtagtccattcaacacttgcaggaaatggagcactaggccctcatgggagctcatagcaagagcttgaatgaatagcttgtcactcgtggagtcgagaccgttggaaacaatccaaaagattaggagaagcctatgctgtctctttgagggacggggggtcagaggatttgcaaatctaggggggatcggatgctgccattggattccttgaactcgaataagcgagtggacgaaggccatttctatttgtagtgccacggaaaattgtctgcgtattgaggtgacctcccagtcttagtatgtggccgattgtattcctaccaccaagaaatcctctggaagacgccagaagcaatgcttcaagaaaggctctaaccccaagggcgtaaatagagctcc

SEQ ID NO: 535555 - DNA, 897 bp, Homo sapiens
  misc_feature (7)..(7): n is a, c, g, or t
  misc_feature (202)..(202): n is a, c, g, or t
  misc_feature (240)..(240): n is a, c, g, or t
  misc_feature (252)..(252): n is a, c, g, or t
  misc_feature (262)..(262): n is a, c, g, or t
  misc_feature (266)..(267): n is a, c, g, or t
  misc_feature (276)..(276): n is a, c, g, or t
  misc_feature (284)..(285): n is a, c, g, or t
  misc_feature (289)..(289): n is a, c, g, or t
  misc_feature (310)..(310): n is a, c, g, or t
  misc_feature (319)..(319): n is a, c, g, or t
  misc_feature (331)..(331): n is a, c, g, or t
  misc_feature (341)..(341): n is a, c, g, or t
  misc_feature (351)..(351): n is a, c, g, or t
  misc_feature (361)..(361): n is a, c, g, or t
  misc_feature (388)..(388): n is a, c, g, or t
  misc_feature (396)..(396): n is a, c, g, or t
  misc_feature (403)..(403): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (422)..(422): n is a, c, g, or t
  misc_feature (425)..(425): n is a, c, g, or t
  misc_feature (442)..(442): n is a, c, g, or t
  misc_feature (445)..(445): n is a, c, g, or t
  misc_feature (448)..(448): n is a, c, g, or t
  misc_feature (454)..(454): n is a, c, g, or t
  misc_feature (465)..(465): n is a, c, g, or t
  misc_feature (504)..(509): n is a, c, g, or t
  misc_feature (515)..(518): n is a, c, g, or t
  misc_feature (520)..(520): n is a, c, g, or t
  misc_feature (522)..(524): n is a, c, g, or t
  misc_feature (526)..(526): n is a, c, g, or t
  misc_feature (529)..(529): n is a, c, g, or t
ataatgnatgtaaactgaatacaatacttcaaatcattctgcacaaagaaattacagatcacattgtgttttaataacaaaatgtctacttgtttaataaaatgtttttaggaacttacaatgttcaaaaccaaagaataaaaatattaaatatatcactttatggcacatgtgacagacataaatttatttttgtaacacngcaggcaaatttttgtgctagaaacaggatggagaaanatctaaattaangcaaaaagtnaggnnatgggtgtncataagtnnctgnttaactgtgactcaacatttnttgtaaganacggggcctctnaacatcagantttgtttatnaaaataaaancttcctccctgtctctgctaaaaatanaaaaattngctgggngtggnggngcntgcctgtngtnccagctactcgtggggntgnggnaggtgnagcctggcganagcagagtctgcctcaagaaaaaaaaaaacaaaacaaannnnnncccccnnnngngnnngnggncatcagattttttcacctcagcaaatactttttcctttgataattcataatcctgctgttcatttgtcacatttatgaatatctggtaatttcataaacaactaccaatggtacacttcaaatgctgattctgttgaatcttcttattttttttcccccaatgaacttagggcctatgatagagaagatactgaaacatgctaagataataattggtcttagaaagactttacagcaagtatttaatgaaagccactacacttccagctctaaaaagagccagacacaatccctgcttccagagttcaccattcagaatacaggaggtcaagcactgattctgaatcattaatgggctttgatttcgt

SEQ ID NO: 535556 - DNA, 442 bp, Homo sapiens
  misc_feature (275)..(276): n is a, c, g, or t
tgaacactggcagttttgaaaacttccagtctcttagttttataaatatatatgtgcagagtatttgatcacaaaaattagtcacgaatccaacgcatgttactacaaatctggttaaaatctggtagtcgctcaataggacccagagcagcaatagctgggcttttgtcatgaatgtacttggtgcacactcgtccgaaccgtctccgcatccacagcatcaattcttgcttcaagctcggggataggaattctcctattatagcatagcatcnngcctaccaatgtcttcacaaattggagttgacccatcaagctgcagcagcatgtttgttttcagaagattttttgcacgtgcaacctcactctcagtcacatctgtacacagacgcttccattcgttttgtacaacgtgcagcatgtcagcaaccgtggcttgttc

SEQ ID NO: 535557 - DNA, 249 bp, Homo sapiens
ctctacaggatccccccagttcctgcttcttgaaataatggacgttcacccctgcaataccaaggcgtagtatctgtctcgtattgagggcggcagtgagtgtgatattcaacttatctgggctatccttatttggtaagtgagactgtggaacaggatgacaccataaaaggggagcaaactcggcgcaaatactcccgccgtgagcttgcagcggtcaggccctggtttcaagaagcaggagactgg

SEQ ID NO: 535558 - DNA, 607 bp, Homo sapiens
agcggatggtgccgtgcgctggagccgagtttcgctctgctgcccaggctggagtacagtgatgtgatctcctgacgtcaagtgatccattcgcctcggcctcccaagagttctgggattacaagtaatacaaaatacagttaaacataaaatgtcaacctcctggagtgatcggttacagaagtgcagcagatatgcctgctaacagtggataagcatgccctgaacaaagtatcgtcgagaagccgtatcatcgggtgtttgtgaagccgaagtttagcaagtggacaacagataaagtgttctcggtcttcgactatggattatacccttgctgtgtacagagtccccagaagtatgagatcccgttggattgtatgaggcttactggtggagagattagtttctattggctatccccaggagtagctcagctttgcttactgattctacattccctacgcaggggacttgtcatttgacacactgctatggcaacatcttctcgcaaagtcgagtgcctatggaaacctcttggatctgtgcaccatggcatttaacctcttataaggggaccgagaaactacacgaacagtatccacaatac

SEQ ID NO: 535559 - DNA, 101 bp, Homo sapiens
ttgctgttctcgaggatctccgattgtgaataggtaggtggattgcttgaggcaagagtataggaccagcctgagtaacaatgacactccatccctaaccg

SEQ ID NO: 535560 - DNA, 296 bp, Homo sapiens
ttttttttttgagatggagtttcactcttgttgctcaggctggagcgcaatggcacgatctcggctcaccgcaacctccacctcccaggttcaagcgattctcctgcctcagcctcccaagtagctgggattacacgcacacgccaccacgtccggctaatttttctatttttagcagagatggggtttcacatgttagtcaggctggtcttgaactcctgacctcaggtgatccacccgcctcagcctcctaataaaatttatcttaataagataatatgttaatataagataga

SEQ ID NO: 535561 - DNA, 375 bp, Homo sapiens
catatgtaacatatacaacagcacggtatattcaccaaactgaatgcaggttgttgagatcagtgctgaggtcatagtactgaagccattagagtcccttccacattagtgttgctggatagctaaatttctcctgggtactagggtataggtcagacaacagatgcttcacaggatataagtaagcctatggtttgtgatatttccttattcattaactgtggctattaataggataactatgtgccccgccatacgaaatatggcctacaaactaaagcaattagactaatataaatagtactatgtttttacagtacctcactactagaaagcagaccctaaataaagcaagtcttgatatcagaatatcta

SEQ ID NO: 535562 - DNA, 310 bp, Homo sapiens
agctaattaaaaaacttgtaaactctcagcggggcaatgactcatacttgtaatcccagcactttgaaaggtcaaagtgggaggatcgcttgaacccaggtttgagaccagcctgggcaacatagtgagacctgtctctacaaaaaatacaaagattggccaggcatgctggcatgcacctatagtcccagctacttgggatgctgaggcaggaggatagcttgagcccagaatgttcaggatgcagtgaaccaaggttgtgccagtgcactgcagcctggacaacagcatgagaccctgtctccaaatc

SEQ ID NO: 535563 - DNA, 1443 bp, Homo sapiens
taaccaacacactaaccatataccaaatgatgagcgcgatgtaacacgagaaagcacataccaaggcccaccacacaccacctgtcccaaaaggccttcgatacgcggaataatcctatttattacactcagcaagctttctctttctatcagcaggacttatctaactgagcccctctttacccactcccagcctagccacctaccccccaacttacgagcggccctgcgccccccaacaggacactcacccacgacctaaactccccatagaaaagctcccacatccatacaccacactcccgctactctacctcgccactcaccgcagcctatccacactcacccctcgaccctccccccacactacctcataactaccaaacaaccaaccgcaaccccccacacctacccctcacaccccccctagaccccactccaacaacttctctaccatcggcatcctcccactctctacaccaccctcccctcaccacagcccctcacacagactacctctcccacactcctcacccctcccaccccaacaacccagacaccagcccactcctaccgcgacgtcacacacacatacaccccacgctatcccaccccacaccatcaccacacagcgcacccctctccaaccgctccaccctacatctagcaccactccaacactctcacacctccacctacctcctacgacctcccacaccacacccaacacctacactactcctcacccttcacccctccccaccaccactcaccctcatacgacaccctcaccacacaagcacctgaacccgcccctcagcaatcatcctctggaccactttccctccctccaccactctcttaacatcataccaccctcaactccaactagagcactaatcaccttcaccacttcccacatctcacacataacaacacatcccattaacactcactcaacacccacaatcatcaccacccctcattgacacacataaccccatcaatcccccgctcgccgacaccaaccgcacctcactcccgctctcccctctcactccctcactaccacgtccgaccacattcaccagtaatccactctaccgaccaccgatcccaccacctacccacgttcgccaacacccagccaacatcgcagcccacaacaaacagaacgggccgagcgagcgaacgcacaggatcacgagcacaaaagaaagcggcagagagccggatgtcacaccgaacaaacaatatcatccagacagcacacggaccaggacgacgtaagcaacaccaccagacaggcgcgacacaaacaacgccgaagagcccaagcacatcataccaccatggactccacacacacatcagcagaaccacagcctctcagcaacgcacgacacacagagaaacacacgtgagatactccatcgagaagcg

SEQ ID NO: 535564 - DNA, 225 bp, Homo sapiens
gggtgatctgaggatccctcataggttcgcaggctgagaggaatggggacggggagtgattgcataatgggtacagagtttctgactgggatgatggaaaatctgggaaatggaaagtgatgatagttgcgcaacattatgaaagtactcagtgccactgaattgtatactcaaaatggttaaaatgataaattttatgctatgtatattcctgcgaacctatga

SEQ ID NO: 535565 - DNA, 420 bp, Homo sapiens
cccagggccttaaccaacgcattgcatgcctcttgtttatgactgtccatcatatgaagccaaacgcccggtggaatacttcctcaatccagttgtaatcttacttccacttattggcacggggagaaatcatgtttatcacaatcaacattttatggtttaaaggaactggcttcaaacttgccaaatcctccttggcacttttcttgaaaaattgctctccctttaaaacacctatgcctgtgttgaccttattcacaaaggtccaaactgaaaaagtttgttgggtgaagaaagttgtccattaaacatcttaaatttttgtactcacacaacagcacttactaagttttctacccagataccttattatctcccaattaccaaagagcttgatgtatttgggtctttggcccctcc

SEQ ID NO: 535566 - DNA, 172 bp, Homo sapiens
tgtctgaggtgatctagaggatcccgactgcatcaacgccgccagtgtgcgtcacatgcccggctaattttggaattttttgtagagacacggtttcaccttgttgcccaggctggtcttgaagtcctgggctcaagcagtcttcccaccttcagcctcccaataagtgttg

SEQ ID NO: 535567 - DNA, 228 bp, Homo sapiens
  misc_feature (6)..(6): n is a, c, g, or t
  misc_feature (23)..(23): n is a, c, g, or t
  misc_feature (27)..(27): n is a, c, g, or t
  misc_feature (66)..(66): n is a, c, g, or t
  misc_feature (102)..(102): n is a, c, g, or t
  misc_feature (208)..(208): n is a, c, g, or t
  misc_feature (222)..(222): n is a, c, g, or t
aactgnaagcagttattgttgtntagnctcttgcctctatgtatgccaaaacttttgtaaaagganccataaacacacaactactctgtacacaatgcaacnccctagctttcctgctccccagagctgtgcatgaaggagaatactgctttaaaatgcaatacttctgtgacactgtgcatctaataccataaattccaaaatatgncactctattgtccncatggc

SEQ ID NO: 535568 - DNA, 145 bp, Homo sapiens
ttatatgtaagcatttagaagatctggtgctgctattctgctggaggaatgaatagatggctggtttcaggttaagctattagtaataaaagtgaacattgctactatctgaagctacatacataaacttgtgtgattcaataac

SEQ ID NO: 535569 - DNA, 208 bp, Homo sapiens
tgtcgcgggctggaattatgggttctccgaagagggcaatctgaccccggacaagctccatgagcggggcattggcagttatctgctcagcgaatcctgtcggcagaagggcagtgagaaggctcgtggtgtcatgcagccgtgggacgccgtccgtactgatctgagtaacctggctaagctcaccggcaatgaaccgaccgggaag

SEQ ID NO: 535570 - DNA, 185 bp, Homo sapiens
ccaagactataagcatgcctcccagaaagactactccagtggttttggcggcccgtatggagtgtaggccgaccgagtagacaagagcgcggtgggcttcgactaccaggcaacacggagaatcacgagtcacagagagattactccaaaggtttcggcggcaaatacggtatcgcattcggtct

SEQ ID NO: 535571 - DNA, 367 bp, Homo sapiens
caagggcagtttctgtttagttattttttctctaagtatcgtgtattatcctggttcttcatatgccttgtgatttttttgttgaaaactggatatttgaatcttaataatgtggttacattggaaatcagattctctcaataccccagagattggtggcttttgttatttttgcttgttgattctggttctgattgttacaggctttctatatgccaaagatcagcctcagcctaaggtataaacttaaagtcttctcagatcctttctgagcctgtacctttttctgggcatccattgtcactttctaactctccatgtgtatgcagttgtttttgaatatgctggtctttaatgtctggctccc

SEQ ID NO: 535572 - DNA, 469 bp, Homo sapiens
ctcattttccagttttggcgccagtggtttctaggttctgagtgaagtgaaacagaatctctcagggcatgtggtacagataatcccctactatgtactgcgtagagttcacagagcagaggcgagagcatgaagataaaccagtacactccgtcgttcacataccactaactaccatgatactcccctttgcttcctggtgaggtcagttactcaatcaatccactgatgtcgctttttaatttccatcacatcctttaactgtcttcatatcaggtcattgcaagcagtcaccataaaaggccatccattttctacattttgaacaatagttagagacaactaatatcttctccatcattacagtcttgctactgtctcatgcagttccccaacatagatatattatctgcctgcagacgtcatgggccaatgtcacactttacttggttaggctaattatatttct

SEQ ID NO: 535573 - DNA, 230 bp, Homo sapiens
  misc_feature (105)..(105): n is a, c, g, or t
  misc_feature (123)..(123): n is a, c, g, or t
  misc_feature (207)..(207): n is a, c, g, or t
gccaacccgatgaggatccaagcgttgtccggaggaatacaggtgctggtcacatatttttatcactgatcatatataccttgtcttatgtgtgtttctgcttgngacactttatttaatatntacgttgattcattaactctgactctctaggcaacagattataactctgccttacaagcttatctaacacacacatttcctctnaggacatccagcctcttgcactt

SEQ ID NO: 535574 - DNA, 487 bp, Homo sapiens
ctccctcttcgttcacaaagtggatccccgggaaggatgcccactccaccctgctgtccaggaaggaaaccagcaacctctataagatccagtttcacagatgtaaagcctgaatacgctggatgcctacaacatgcctcacggaggctgtgctgcccaagcttcatcctggtatgaggacatacccagtgctcactcgtgggcaattggaacacgtggtatggggagcaggaccaggcagtgcaccttgtggcgattctcaggtggctactccagccctcatggactgcagtgaacaagctctaaaaacaataatggagtaccttggagttccgaagggagcggagccagaatgctgcttgatccaggagtaagaccatgctgcgtccttgaggttcagcttctggaagtgagccacatgcccagtaatgggtcccaacatcgtatgagctgaggacatacaagctcaggccaggaaccatgatcg

SEQ ID NO: 535575 - DNA, 746 bp, Homo sapiens
atgttcttttccgatacaaaaaaggctagcttggtttaagcacacaagacacctttaaattgttgtcttgtggggggaaagggcgcaatactgtcacctacaatagaaatggtctcccgaaggctggacttgaattgtcggaagaacacgaccgtttcccgtttctaagtctttgagtgacttccgtcctttggctcccaggcaggagggatttccatgacgtatggacacacactaggccacccgttggcgacaaaagccttgatcggtatagataacgacatttggtttactgtcctcttctcccgtttgccatcgttcagcattagacgtgaactcccttaaggcccgagacatttcggtgagacctgacccctagtcatgtggttaccagtgtgtcaggcaatctgaactttcgcagtgatgccagcgtgagatggcacctgtcaaaagagcagtggttccattatcttagattgttggatcttcacgagaaaattcggccattattcatttcacttcccatgaaagtcagggtcggcttgtgaaaagttgttaaacaacatgctaaatgtgaaatcgtcaaccctcactgctaaactttccctgattcagagcatcagatgaagacttcattgggttgtatagtggctttctgatttttggtagtccatgaagaagggagttcgaaaagcttgcttgtatagctgttaaccgacttgttctgtaccatggtcctgcctgca

SEQ ID NO: 535576 - DNA, 323 bp, Homo sapiens
ttgtggattagaaatatcctgaggatctcaacgcctaaacgaatttgattttcagtgttttgatctgctgatcgagtccgattcacccctaaggtcataatcggctgaggacgagatttagctttgagctgctcgatattggcttgttgacgttgcgtttctaattgcaaactacgctcaaacaaattctcaatgttttgttcatcagtcttcacagctgtggctcttgcccaaagctcattgacagttggtgcaatcataaattgattcgcatcactgccccagaaactggctaattgtttctgtgcgactggggatcctct

SEQ ID NO: 535577 - DNA, 160 bp, Homo sapiens
ccaaaacctggtcgcttttgtcctggtttgggttttttttgaaaggccgaatttcccccttagtttttgccgatttttagggacgtaaatttttttggttgcctttccccaagtttggagatccggtttttttcggggatagatgcccccaaaacctcca

SEQ ID NO: 535578 - DNA, 473 bp, Homo sapiens
  misc_feature (48)..(48): n is a, c, g, or t
  misc_feature (184)..(184): n is a, c, g, or t
  misc_feature (427)..(427): n is a, c, g, or t
ggacccccccttttttcccccccttccccgggggccgctttttcgccnacaccaaggggccgggtagggttttttcccgggggtttccctcttcccccccctttcgcttatggggttttttttgcccccaaatacccgggccttccaaaatttttttaaaaccccccccctttacacaaatggnggtggggggccccgccggccctccttttaaacaggcccttttttggaccccccaattcccctgggggccccccccccttttttttcctcccttgggaccccccggcccccccccccctccggtttttttccttgggcgggggggggtttattttttccccggggaacccctttgcccctttccccttttccaaagtttttttttgggccccttttggagggccccccccaggtcccggcccgnattctccgggcccccccccccccccggggtttttgttcccttttta

SEQ ID NO: 535579 - DNA, 416 bp, Homo sapiens
tggacttgtttggcttacctcatcactttgccaccatgtttcgggtgtgtgagcagggaagggaactttcctgccttatttaaacctgcggccggaggattcgtaggaatctagcttgatcacgagactctgagtgccaagaaacgcatcatacttacttggccatgcttcttgaccgagttttttatatcttgttgcagtttaattcagcgccctcgatgtccgttgtgggcggatatccacgggacttagcctcgtcacaggtgctgctggtcccccaggggaacacacagaagaacttagggcggggaagtggacttaaagcctgacggtgcccgagaagcgctttgtccttctggggatcatagttcttcaagctgatctgcaactccaccgtctccaggaacttgcgggca

SEQ ID NO: 535580 - DNA, 408 bp, Homo sapiens
ggcacgagctctctctctctctctctctctctctctctctctctctctctctctctctctctctctctcactctctctatatcgagctctatcacactctatcgatcgcggcgggacacggaacccaatgcgagaaaaagagagaaacataacaaaacagtgaccaacaacatacaacgataggcactaggaaaaccatagcggagaccaactgaagagcgctcgaagcacaacacgcacacaccagcaggcgagaagcagaagaggagcgcaaagatagcccgaaaaaacgcgtgagaaggctgtatgatcagaggcaaattgaacgcgtatacacaaagcgaaaagccctatatagcagaagaatagacacagatatagccggccagaacagaggaacacgagacc

SEQ ID NO: 535581 - DNA, 984 bp, Homo sapiens
  misc_feature (726)..(726): n is a, c, g, or t
  misc_feature (984)..(984): n is a, c, g, or t
cacgcgtcgggacttatgtgctagagaggtctcctgaaggcagcagatggttggtgatcgcatgtggatcaaggactggaacatagcccctttgtggccatggtggaaaggacctcagaccatcatcctgaccacccccaaggctgtaaaggtagaaggaatcccatcctgggtccaccacagccatgtgaatcctgcagccgctgaaacctgggaggcaaaacagagcctggacaacccctgcaaagtgactctgaggaggatgacaagccctgctccagtcacacctggaagctgactggtctacgcacagccaaaacatgaggaggatcattgtgggactcactttccttataatttggacttgtatagtaaaaacttccactgattttcctcacatgtaggactgctctcagtgtatacatcaggttaccgaggtagcacaagttacaacaatctttctgttctatagttactatgaatgcccaggaaatttaaaacggaatatgtttatataacgacactcagtataaggtatgtagcccaggaaatgactggccagatgtgtgttatgacccctttgagcctcccatgtccacagtttttgaaataaaattaaggactgaagactggtggggactcataaatgatacaagtaagtattagccagaacagaacgaaaaagggtgcccaggatgcgccatctggaaatttggattcctgggngcggtccttcaatagccatagactgaggaacggggatatagccccttgtggcgcaaagggtctgtgggccaataagttacttgtctgaatcgacgcgtggaagaagtggtacggcggcctgggcggactgatatcaagagactgcccttcaaggaagggctctttagggaggacctatgtaaaccctgcggagggggctaaacggcgaacaatggagacccgacataaaacaatttccctgtggccccatctctgggn

SEQ ID NO: 535582 - DNA, 334 bp, Homo sapiens
tccccatgcgaatacgttgcatggtccatggatcataccattttcgatctgtccaatcatgtcacagactttctgttctggataattcagattctcatcgaattctcctctcacaatatgaacatcaccagccagattcttgatcatagtcataaccctttccctgtgctaaagtttcctgtgcagagaatgtgctgaatttttcctggcaccaggagttttttgaatttagctggcaaactgttgcaccggtgtgggatgtgcagatctcctaataccaacaccaacatcctgtcaccgggctccgctcagtcaccaccaccgtcgccgccct

SEQ ID NO: 535583 - DNA, 410 bp, Homo sapiens
tgtacatatttcatatgtacataactcagaagctcggcttctgtgtcgtatgatgtttctgcaattctgctgaccctgacgcaggttgttagcatgatgaccgataaattatagcgtttatataggccatcgcgcatgttgacctaaggtgaaacctagattgttgcacattataagatcacttgctactattgaatgactcatctcttatggtttgtccttatagtgatgatgagccgagtgtcctttgcgtctaatgagtgtaaacctttcatatagatgaatgatgatcaggtgcaataattcctcaaagcttagtggaactagcacactgttctggctaacatgtacccgacatttaggctatgttttgcgaactggattatgacttcacttccctgatggtttgc

SEQ ID NO: 535584 - DNA, 710 bp, Homo sapiens
  misc_feature (136)..(136): n is a, c, g, or t
  misc_feature (164)..(164): n is a, c, g, or t
  misc_feature (238)..(238): n is a, c, g, or t
gcggcccaggccgagcatgtcgcgcagccagtcggtggtgacttcctctatttcggtgagagccggactggattgccaggacaacccaatcacacccaggccggtgctcaggcaatcgcccagcactgaggacagntccacattggaagggaagaaccgaaganactgggatgctgccaatgcagcaagccgggcatgatcagtttttcgacgtcgcccatgatctgttcgaacggtncggccgtgtcaggcgggctggccggtagggcagctttgatctcgccaggtcgggtggtgggctgcacgccgcgttgttcgatgttctgtcggtagtctgcaatcaggtcgatcatggcatagccatgttggcggaattcttcgggggtcatagataaacgtcgatgtgcacgagcaataaaagtattagacaccagaagtaaaacggttcgccgggggtatagccgataaacgactgcatgctgatcgcgttttcccgaatcgaacccgcagatggcgtgtgggcggcgggtattgatgagcaccagttcgttcttgcgtgggcggatgcgcagcggttttcgtaaacacggttcggtcagttgggcaccctcgaggcgcttgacctcgtcatagctaaaggcgggggtatcccagatgatcaactcgccccccgaaggcggtgttcgcaggtagatattggcgctgaattg

SEQ ID NO: 535585 - DNA, 320 bp, Homo sapiens
tctataggatccccatgcattcggggtagtttgatgaatgagctgtgatgagcgtattattaccatagactcgcctagttttgagagagctactgcgtgcaagctactattgaccctgtcgatgggggcttcgacgtggtctttagggagtcataagtggagtccgtaaagaggtatctttactataatagctattgtgtacgctagtcatattacgttgttgcgcatcaggagtttgatagttcttggccacgtgagagtgagtagtacaatgttctcaggtgagcctaagctgtcgtgattgtaccgacccttgcgag

SEQ ID NO: 535586 - DNA, 935 bp, Homo sapiens
  misc_feature (935)..(935): n is a, c, g, or t
gggccgggcgcggtggctcacgcctgtaatcccagcacttcgggaagctgaggagggcagatcacaaggtcaggagatcgagaccatgcccggtgattttgtattttagtagaggggtttcaccataatggtcaggctggtcttgaactcctgaactcgagtgatccaccagccttggctcccaaaatgctgggattacaggcatgagccaccatgcccagctaattttgtatttttagtagagacagggtttcaccagcctgccaacactggtctctgtgaaactccgtctctgctagaaaatacaaaaattagctggacgtgtggcgggcatctgtaatgccggctacttgggaggctgaggcaggggaatcacttgagcccggggggcagagtgttgcagtgagctgaggtcgcgccagtacactccagcctgggtaacaggagctagactccatctcaaaaaaaaaaaacaaaaaaatctccttttaccccaagttggttcttccttaaatctcgggtcaccaacaccaacttttgggggtgttcaacaagtcttcctaattcctgtggggctttttaaaacgtggctacttaaaaacttcagtttttttcaaaatattaatgggttatttggaaactttttccttatatataagccctttcttgagaaccgtcgagtggatcttacggttatggtttcacccagacttttggtgaaaccctaggggtggcatctttgcgtggccttcagatttgactaagtctgtgcaccggcccaattggttgtgcctttataggaacccttggacgaacgccccgctttgtgttcgtacacaagtggggtttgtcgtgtttgttggcccggatttttatactaggggtgattcgtcacactcgcgtgcgtaatgagagcgcaaagaataagatcgcgn

SEQ ID NO: 535587 - DNA, 218 bp, Homo sapiens
tgacatgagattgatgacatacagcccacttctctggaacaggaaagcatgatcggggagggaacacaggtcagtgtggggacaggggtcacggtggacaaggagggtaggctagtctctccacctcctcacataatgctaacaggaacgcagacacatatcagatgccctaatgcaagaaagatgatgcccgaggatctagaagatcacaaaggaga

SEQ ID NO: 535588 - DNA, 827 bp, Homo sapiens
gagggcctgaatagaaaaaaaaaaaaggttaaggaaggcagaattcaggccttccggcctgatggcttgaactaaaatattaatcttctggttcccttagcttcccgggttctggggccttcagattggaactggaattacaccatgggtttcctggcgtcttcagaaaatgggcatgaggaaaaaccatctgggcttttctggctggtaattattcttctggggataactctcagaataattttggttctggatttggtcaaggttgggcaattatgaataaagctgctggtaaacattcatgagcaggcttttggtggtgggacataagtggtcgactcattgggataaagaccaagaagtgggattacgggattatatgtactatgccaatcagagtggtcaaataccagggttttatacagaaaaacctaagacaattaaactacgtatggattggcttactttacctccttgaaaatgactggactgggtgatggttctccaatagattcaaagatgcagataatggtccccaagaggtcacattctaatcaaatgctgtgaatggtattattggcaagaagcttggatctcataagggaccagctaagaaaaaggtggtcttaggacgcaattctttaacgggggggtttcatggttgtgattagttggaaatccgggatactaggtcattggataggtaaataatcgggtaaatagggaaaggaaactttctgccatgggggtcaagacggaaagtcaatgtgttacggggtagaatgcatagaagatgtatgacaatggtgaagaaacaatagaggagc

SEQ ID NO: 535589 - DNA, 886 bp, Homo sapiens
  misc_feature (11)..(11): n is a, c, g, or t
  misc_feature (69)..(69): n is a, c, g, or t
  misc_feature (71)..(73): n is a, c, g, or t
  misc_feature (78)..(79): n is a, c, g, or t
  misc_feature (98)..(98): n is a, c, g, or t
  misc_feature (121)..(121): n is a, c, g, or t
  misc_feature (123)..(123): n is a, c, g, or t
  misc_feature (135)..(135): n is a, c, g, or t
  misc_feature (155)..(155): n is a, c, g, or t
  misc_feature (171)..(171): n is a, c, g, or t
  misc_feature (183)..(183): n is a, c, g, or t
  misc_feature (201)..(201): n is a, c, g, or t
  misc_feature (220)..(221): n is a, c, g, or t
  misc_feature (225)..(225): n is a, c, g, or t
  misc_feature (228)..(228): n is a, c, g, or t
  misc_feature (233)..(233): n is a, c, g, or t
  misc_feature (243)..(243): n is a, c, g, or t
  misc_feature (261)..(261): n is a, c, g, or t
  misc_feature (309)..(309): n is a, c, g, or t
  misc_feature (342)..(342): n is a, c, g, or t
  misc_feature (438)..(438): n is a, c, g, or t
  misc_feature (444)..(444): n is a, c, g, or t
  misc_feature (491)..(491): n is a, c, g, or t
  misc_feature (559)..(559): n is a, c, g, or t
  misc_feature (598)..(598): n is a, c, g, or t
  misc_feature (616)..(616): n is a, c, g, or t
  misc_feature (620)..(621): n is a, c, g, or t
  misc_feature (632)..(632): n is a, c, g, or t
  misc_feature (739)..(740): n is a, c, g, or t
  misc_feature (768)..(768): n is a, c, g, or t
  misc_feature (874)..(874): n is a, c, g, or t
ggtagaaaggncatgcttgaggacaacagaagttcactaaggatgcacgattgatctgagaagtttttnannntcgtnntcgccctcctcctcctcgntctccccttgttcgtcggccgtngngtcctggtactnctggtactcggtcaccaggncgttcatgttgctctnggcctcggtgtnctccatctcgtccatgcnctcgcccgtgtaccagtgnngggnggncttgngccggaacanggccgtgaactgctcggngatgcgcttgggcggctcctgggtggccgtgctgttgccggtgtgggnggccggcatcttcggggcgcggggtggggtgtngcgcccggccgtcttcacgttgattgggggtccactcctcggtgtagctgctgttcttgttctgcgcgttgagcttcttttcgttcaccttcttcntggtcntgcggccccggttgttggctgcttttgttttgttgctgccgtggtgngggttgcgggcggccatcatgttcttggagtcgaacatctgctgggtgagctcgggcacgtgagcacncggtactgctggctgccccggctggtaaggggcgcgaancggggcatgaagaagtgnaggnnaagcccgggcnccatgttcaccgccagcttgcgcaggtctgcgttcagctggcccgggaagcgcggcaggtggtgacccgctcatggtggccgacacaggtggttgaggtcccgtagnngggggtggtcagcttcagggtgcggaanagatgtcatacagggcctcgttatcaatggagtaggttcatctgtgttttccaccagctggtggaccgggagggtggcgttgtagggctccacaccgtgtctgacncttgggtgaggg

SEQ ID NO: 535590 - DNA, 162 bp, Homo sapiens
cgtctttcctggtatcccaccctcaaccgccacagttattaaccacagtcagcatctaaaaatacaaacatttttagtctctactaaaaaagcacaaaaagttagctgggtgtggtggcgctcgcctgtagtcccagctacttggggtggggataccagggg

SEQ ID NO: 535591 - DNA, 879 bp, Homo sapiens
  misc_feature (8)..(8): n is a, c, g, or t
  misc_feature (137)..(137): n is a, c, g, or t
  misc_feature (156)..(156): n is a, c, g, or t
  misc_feature (173)..(173): n is a, c, g, or t
  misc_feature (177)..(177): n is a, c, g, or t
  misc_feature (395)..(395): n is a, c, g, or t
  misc_feature (488)..(488): n is a, c, g, or t
  misc_feature (544)..(544): n is a, c, g, or t
  misc_feature (822)..(822): n is a, c, g, or t
  misc_feature (849)..(849): n is a, c, g, or t
acagatgngatgcgcattgccaaagaggagattttttggaccagtgcagcaaatcatgaagtttaaatctttagatgacgtgatcaaaagagcaaacaatactttctatggcttatcagcaggagtgtttaccaaanacattgataaagccataanaatctcctttgatctgnaggnaggaacagtgtgggtgaattgctatggcgtggtaagtgcccagtgccccttggtggactcaagatgtctggaaatggaagagaactgggagagtacggtttccatggaatatacagaggtcaaaaacagtcacagtgaaatctctcagaagaacatcataaaggaaaatacaagagtggagagaagctcttcaatagctaagcatctccttacagtcnctaatatagtagattttaaagacaaaatttttcttttcttgatttttttaaacataagctaaatcatattagtattaatactacccatagaanacttgacatgtagcttcttctgaaagaattatttgccttctgaaatgtgacccccnagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaatattcccngtaatatttagctgtaaactgaatatnaagctttattaaaaccaccttgccatgtga

SEQ ID NO: 535592 - DNA, 256 bp, Homo sapiens
tcgtgcctagctgttatctgctatcgcactgaatgtctgtgtcatcccaaaagtcccactctccaaattgcaccacgcccagccggctagaatattatccacataagtcatcagcgacgcgaacactcaaggagtactatcatgcagatctccatgtattactaataagcataacagtcatcggtagacagacgcacggctttctctgcatatcaacttgactacatactagcaaatactatatagtttccctggt

SEQ ID NO: 535593 - DNA, 285 bp, Homo sapiens
aggtgactagaggaccccactaaccctaatcgcctacctctccaaacggcttgaagccacagttctcagatggtctgcctgcctccaagcactggaggcagctgctgtcttcatccttgaaagcctaaaactatctctccatgccaacctaacagtttattcaacccataatatcaaagacatgctagctcaccacagtgtactaagtctcatctctgccccacggctcctccaactgtatgctctgttcatagaaaccccccaaatcacgcgattagggttagt

SEQ ID NO: 535594 - DNA, 390 bp, Homo sapiens
  misc_feature (9)..(9): n is a, c, g, or t
  misc_feature (33)..(33): n is a, c, g, or t
  misc_feature (44)..(44): n is a, c, g, or t
  misc_feature (60)..(60): n is a, c, g, or t
  misc_feature (69)..(69): n is a, c, g, or t
  misc_feature (144)..(144): n is a, c, g, or t
  misc_feature (187)..(187): n is a, c, g, or t
tgtgcaaanactaccaccagtgtgaatgtgtanaaaaaggcgantgcccccaagcctacnagtaccccnacctaagctgctgagcatggacccgccttgctgccactgttgttggcatatgcgaacaagcatagatcctgctanaactgccccaaagaagcacttttgctggcatcacccattggantattgttgctagtggtcctaacctccagcagccagaggacaaagccaggggcccgataccagccccctagagttatagcatgcagcccagaagtgctgagctgatccttggtctcctaaaatcttccagaaatgaagacagtcaacttaacccaccttatataacaatcaaaaccgcaagggcatcaaagaagataaaagcaa

SEQ ID NO: 535595 - DNA, 100 bp, Homo sapiens
ggcaggatatgaatagatattacataaccagatatgtatgtatatcacatataaatatacacacccacgcagactttagaaaccaaaaatttactagtgg

SEQ ID NO: 535596 - DNA, 456 bp, Homo sapiens
tttcaaccaatcgcacattaaagaatttctaggctaggtgtggtggttcatgtctgtaatcccagcactttgggaggccaaggcaggaggatcatttaatctcaggagtttgagaccagcctgggcaacaacgacaccttgcctctattaaaaaaacaaacaaacaaacaaacaaaactcctataacctgtaagtcccaagatattttgactttttgggccaaaccagtgtataacccccatgtgtttttttctttttcttttctctttcattttttgagatagggtcttgctctgttgcccaggctggagtgcagtgatgtgatcatggcttactgcagtctctaccttctgggctcaagcaatcctcctgcctcagcctcttgagcacctggaactatagatgcatgtcaccacacctgactatttttgaattttttgtagaggcaggtcttac

SEQ ID NO: 535597 - DNA, 387 bp, Homo sapiens
gataaatgaatggggaagtgtaaaggaaaggaaggagataacagaacttagaatataataggtctaaagattaaacaaagtaagggacacagtcataagagctcggctttagcacagaatgaatgtttaaagacacacacaggtgtctctgggacaaccaagaaaagtgcaacaggcagatggacttgaggagctctggctaaagataaggatctaggaactgctgaattaaaattacccaagcgtgagaagtggcgtcgtgattacgagagccaaaacaaaactggcggtctgaggcataccatctacggaataactgaacaggcccaaaggtggggggtggtccaggagtgaccaacatgtaccaagtcacgggactacatcttc

SEQ ID NO: 535598 - DNA, 550 bp, Homo sapiens
gatttttctttaatcgtgggttggtttgggaagttattttatgtgtgtgtatactttttcatttagatggtaaatgcttctctatcttctccttcatgtacttcttttcccggttctaaactgaattttattttattttttggagatagagtctcactctgtggcccaggctggagtgcagtagcacaatctcacctcactgcaatctctgcctcccgggttcaagtgtttctcctgccccaacctcctgaatggctgggactacaggtgcatgccaccacatctggccaatttcctgtatttttagtagagacagggtttcactatgtgggccaggctggtctcgaactcctgacctcagatgatctgcctgccttggcctcccacggtgctgggattacaggtgtgagccaccatgcccggccaattcaggtgacttctgaattctcattctgattctggtacgttacatgggaatgctaatctacctaaatttagcccaaaagaaaagaaaatgcccctccaaaaagagctgtaataacgatcgaga

SEQ ID NO: 535599 - DNA, 169 bp, Homo sapiens
tggacctctaggggcggggccttcccgtttcctgtctgagtctcagcttttcctccaggcagcctgaggaaactcaaaggcacagttcccagatactccgagagaacctccatactctggcaacagtttaccataccaagcacggcatcacgggctgtggacgggcgat

SEQ ID NO: 535600 - DNA, 572 bp, Homo sapiens
  misc_feature (50)..(50): n is a, c, g, or t
  misc_feature (93)..(93): n is a, c, g, or t
  misc_feature (417)..(417): n is a, c, g, or t
atgtagaggatcccccgagcccagagactggagtgcagtggtgccacctnagctcactgcagcctcaacctcctagtttcaagcgatcttccngccttagccccccaagtagctgagactataggtgcatgccaccactcccggctgatttttgtattttcagtagaaatgatttctccatgttacccatgctggtctcgaactcccgcgctcaagggatccacctgcctcggcctcccgaagtgctaggattacaggcatgagccaccacacctgactatactccttgattttaaatatgtttgcattctctcttcttaattcccaatgccatcttctcattaatggtgttacattttataacatttatatgaaaaatccggaatatattgccatattcatcaacatctacatggnttatttcagaacatgagtaatttaaaatcactgtgacatcagcagtctttaaaatacaccatatgtcttggtatgatttatgtataggatagaaagttttacatctgcagctgcaggctagcactagatactattaatctttctggaggcatata

SEQ ID NO: 535601 - DNA, 342 bp, Homo sapiens
  misc_feature (43)..(43): n is a, c, g, or t
  misc_feature (45)..(47): n is a, c, g, or t
  misc_feature (135)..(135): n is a, c, g, or t
  misc_feature (152)..(152): n is a, c, g, or t
  misc_feature (159)..(159): n is a, c, g, or t
gtggagcgggggatagaataagagaaaaaaaggaaaagggggngnnnttgcttattagccacaagacccaatgtgggactcagacccacaacctgctcctaaaaaatgaaaacatctgattcctccaccatagtnaggggggggctacacanaaaaacntacaaaagaacatctccagaggaactgctgaatgaccacgccctgagagaacagaatcaacccccaccaaatggaggaggaggaattcctacaaataacgactgaaagacctaaaaagtattaaaaagctggggggggcaacctttggcaatgaaaataaagattgagaagctgaaaaaaaca

SEQ ID NO: 535602 - DNA, 733 bp, Homo sapiens
  misc_feature (578)..(578): n is a, c, g, or t
tctttctcacagatgtactgtggggtttttgctatttgaagctcattttgaattgtccctcaactagtttatgcattaagagagagcaggaacagatgacaaaagcttttatgggtgaagacactagtttgaggggcaagttattatcttaccacacacttctccatctgtcttttcagattcatgtgcctgttaatggtagaccatttcttagaatgaaattgctacaagaattaggaaataaacatgtaggcctttaatagaaattaagagcaatcagtctatcctttctattgataagcctgcttaaaaaaataaagcctagctttttaaaaaacttagagttctaaataatcacaatactatgctcctaaatttctaataaactattattttgaattaagaaaaataagttcaggcatgagccaccacacctgactatactccttgattttaaatatgtttgcattctctcttcttaattcccaatgccatcttctcattaatggtgttacattttataacatttatatgaaaaatccggaatatattgccatattcatcaacatctacatggnttatttcagaacatgagtaatttaaaatcactgtgacatcagcagtctttaaaatacaccatatgtcttggtatgatttatgtataggatagaaagttttacatctgcagctgcaggctagcactagatactattaatctttctggaggcatata

SEQ ID NO: 535603 - DNA, 179 bp, Homo sapiens
gagcggtctgagtaaaggacttttattcttcatgattgtgtagagagttccctgcactgttaacctccaagcatttttgaagcacataaaagaccatatggatttccagtgtaaaggcactctgacttgggtgtttatattgctttgccagaccgctcgtaccgagaccgctcttaccg

SEQ ID NO: 535604 - DNA, 122 bp, Homo sapiens
cctgcatatggaaggcaaggagttgtgtaaggcagcggacactgtcggacatcctctggagttgaagagacgagaagatgaaccacgtgacgaaataggtgccttggccttgccatatgcaa

SEQ ID NO: 535605 - DNA, 835 bp, Homo sapiens
tggggaaacgccaccgcgggggaaaacggggtctattacccagggtcaaccccacggggttcttcgaattggccgcaaggggaacccctggggccgggtccccttggagcggttggcaaacagggtcccaaagacgagcgaaaaaatttcgggtgctcgtggagccacgggagagaaagggatggggttataggggtcccgtgctttcacagaaattttcccgggctttagtggtgtcgggggtgggtgacttcacaacgccatatgtggccacgtgggtggcaagctccatctagtggggagacacttgtgagagaatgagaactctcatcctaaagcatacgggtccgggacattctgggtgcccagggcaaatggctgggacccaaccacaatgtggttccccaagttttcacatcctggcactggccaaaaactggatgggtgttgggatcgggaaagcttgttcggtggtcgtgggcaacagtggaaacagaagggcatgatattggggggagcgcatggaagcgcttgggttccaggaatgggcacaaccagaaaaaaatcaccatggcttgcggggggacaactcgataataatttggactggtgttttactcttaaaccacaaattatattcctttggtgcccaggtgagccccctccacccatgtggccgaagatatcctaaaactgtggcccagtagaatgccttgctgcaaggtgcctggtccccccatgctactgatggaaatcattttgtcttgaatatatattcccaaaaaaaaaacgggttcttggtggaaaagtaaaaggctgcttgtcggaccttgta

SEQ ID NO: 535606 - DNA, 328 bp, Homo sapiens
taatgattacaatcagctcggtaccctcgataaggcaaatcccatgtcatcatgactcttcaggactcctccttcgttctcatctttcttctcctctgctgcagcagagcgcagaaccagcagcaggggctgtaaagtcctggtgtgcagcatagtacggctacagccccaccagcatgtacactggcaagcttgccaataccctgtgtgaagttgttttccagtgaattttccattcagctcactgataaccttgttgagccggtcgtcgtccgcctcgatacccacgctgtccaagatcttcttgatgtccttggcccttatcgag

SEQ ID NO: 535607 - DNA, 549 bp, Homo sapiens
ggttggcgtggagtggctgtggcgtggcggggtctcgtggcgctggctgctgcacccggagctgtggacggagacgtgcctccctctggcctcagtttcctcatgtgtagtacgcggaggcatggcccggatcgggcccccgagatcgccccgtgcaacctcaccgccagccttgggtggcctcagcggactgtggacgggaccaaggggctctggggtagttcgtccctgaccacccgtcctcgtgtgtgacgtgactagaacccatctcttgttacctcaggatgaccgcaccaagccgcgagtgcccggagatttgtacggatccgtaggttggcaacatgtggtgagacacgcggctcgcggggatcacctcgccttatgcgtacagttcttgacgacggcaagggcttcagagggagctcgcagtttgcactgatgtgaagtcatgatacgtaaggataggtctgagcgcaatgcaacgtggtcggatggtaccagagcgcttgcgagcactttttgtcggttttggatcggtcgcttggtgga

SEQ ID NO: 535608 - DNA, 313 bp, Homo sapiens
caacgtgattctcattcctcagcctcacgagtagctggtattataggcgtgcaccaccatgtcccagctgaattattgtactttcagtatagacgggttttcatcatcttgaccaggctggtatcgaactcctgacctcccaaagatgttgggattacaggcatgagccaccactcccaactccatgtgacattctagataagataaagcttacattaccatttaatgtataaacagtattcatcaagcatactgaggtctgggcagtctgtactaggaaaaccaagaagttgtcattgaccatgggggttgg

SEQ ID NO: 535609 - DNA, 554 bp, Homo sapiens
aagggtctctaccacataggatattgtagaaactaggagccccccatagctagcggaccataggaccccagccctagaagcggccctccccaggcaggctgctacagctagtgctagggagccatggcagccaggcctgcacataaatcagaagtgtgagctgcgccacaagccgcagcgtgaagaagccagctagggcaccggtagggccccctacccctatggaggtcctatcagtatgagctctagcgggctcctcccagacacggcctaaaacctgcagatacactgcaaccgctgggccctgcctggccactggagcgactaggagacccagcctggagctgagaactaccgaacgggcccccactgtcagactgaacaattaggtggcggcaagaggcaagtggacccccaggacagtgcagcttgttctgcacgaccactgcccctggagaagacagcggacggatccaaggttatgtgctacctttggagacccctacaggtcaggctgggggcatcctgccctactgaacacacagagtacagtg

SEQ ID NO: 535610 - DNA, 197 bp, Homo sapiens
cgggatcaagatccctttcgctgctgagtccagcatacctggtgtgaccgctgcacacggaaatgccaccgagcatgattcaatggcatctgacattcgcaacgtcagctgagtgatgcaggcactacgtgtgcaccggctcaacatgtttgccatggaccagggcacagccactctacatctgcaagggaaccacg

SEQ ID NO: 535611 - DNA, 1090 bp, Homo sapiens
caccttcttgactgcgaagagaatcgggcagatccagtggcaggctgctgaggcgctgtgggtgggacacccagttgcgaaactcctcatccaggatttctctctaccatctcttttctttgtacaagtcccatttcctattaccattctctgtcaataaagctcaagatctaccatgatcgtgcacaaacaataaaaagacatgataaacaaatacaacacagacagaagagtacacgagagaatatcaatatacataagaaagatacagataaagaaccaaagaaaccacacacaagttgccgagacgacagatagacatgttggcgacatacatcaagaagttggtagtctgcggccatggtttggtaacgaccgccgtgataagacacacactagaacagaatagccaagatcaatccttcaacacaatcacgacgagtagattagttgaatatagttgaaactccttaagaagtgagcacaccaatggactatagtccaccacactagtcgtaccgcataatgacccttatcgagcaggggacaagtgggacactggtgtaaggacggctttatgacagatcatacacgagatgctaggtcgttagaaaaccacataagtttggtacactattgaggactcgtagtggacatattggcacaactatggaagacatggatcacacgtatagttacattcaaagtccactggtaatcctataatcatgatcagcatgactgactatatacacacgacgagagaagacacagatacgatcataaacatcatctaggccccgggagctaggcaggtgcacgcgggacatagactcctacgagacataacacggacaagactcgcaaccatcccggagtagacgcacaatagactacgtgagcgtcgagaattaccttgaagataagctgggaacatcacagagatacactggaccaacaaacccgagagaaaaatacaagaggaattaaaaagtaaagaaaccgggggatacaacccaaggttgaggacacaggaaaggtcaccggacgccctgaccaacaagaatattgcccgacaccaagccgccac

SEQ ID NO: 535612 - DNA, 1105 bp, Homo sapiens
tgatgggaagaggttccagactgttgcctgcggaaggagtgcaggtgcgatgaaagtgagaagactaaggagagtcgtgaagtcagttgtacgtaatagaacttctgagtcctctgctgaagttggattgtaaagataagagccctgtagaggacacagattgaaaagggctgtggttgtctcaggctgcactcgaacaagaaaatcttcgctagaatgttagcgttatttgggttgtgcccaaggccatgttaccgcgacttgacgtcgttggacaacacatgtgagactgatgacaagtcggctcgatatagtgccatggaaaggcggatatccgaatatctgggggcgcaggggcagcatttacatcttgaaccaacactgtatcactttaattgccggaaggtatccgaagaacaaaagaaaaataacccacttttccgggacaacacgttttgaaatttccccgccaagagaatgattgcctctgggacgctgcatcgttcccggaacgttgcccgattggccttattcacggaacggcgaaacacgttttggcagcgtggacataccgtaagtaggaaacacatgtaaccttggaagttaaacactagacctgaaggcctcctattggcgggagcaaaatttccattgctggtcccataggattagggaggactagaccaatagggattgtagtggggaaaacaattcacagatgtggagaatatagcagcgtgcctttttatccgcggggcattaccaaaagggtggggttaagttgccccacttttgtagaggcgccgaagcgccaataccgccagtcgtgttacgacccactggtgcgtcaagctaaaattttgggggtgcaaggggcaacagttacttagggctgacactgattaagcgaacattctcacggtgaaatgacgctttggcgaccctagtatccggcggacaacacgccgagttcccaaatcgttgagtattcattcaatggaacaggagcgtctaagcatttgcggtgaaagccagcgccatgtttagagaaaatctggtgccgcaagcaaacacgtgtgagctatgggatggacaatcatggtgc

SEQ ID NO: 535613 - DNA, 134 bp, Homo sapiens
caggcccaaggttcagcacagcatgcaacccagtgcagcacacatagcaaacaagctcacatcatggcagttgtgcccctcacgccaggtccttgtgccttgcccatcatgccacagggtccctgcagctacgc

SEQ ID NO: 535614 - DNA, 173 bp, Homo sapiens
  misc_feature (23)..(23): n is a, c, g, or t
  misc_feature (42)..(42): n is a, c, g, or t
ctcttgggctactgcagcgcatngttgtggggtggacccagnaactctgaagtctgaggagacaaatacatgcccaccataacaacatcacacaatacctagagtcaaaacagttatccctattcctacccccaactgagttattcaataaaggcctggcctcgttggcctca

SEQ ID NO: 535615 - DNA, 364 bp, Homo sapiens
  misc_feature (309)..(309): n is a, c, g, or t
ggactgaatattatgtatttatcagtgacagagtcactatagaatggtgtatatcaatataatatatatgatcggaagcagtgccttccataacttatgacaggtttactgtcggttttttttaaataatagcagtatctgctattaaatatcccaacagactactggaagtttgcactctctatggtcgacacttatgggttttagaatacagccgtcagccagatttaattaactaatgttgaagctatgatttagagatcaattatattccttaggggttgctaagaagcgagcactgaccagatnatattgctggttttcctaactgcagtgaattgtgaccaagttataaatcaatgtc

SEQ ID NO: 535616 - DNA, 426 bp, Homo sapiens
  misc_feature (312)..(312): n is a, c, g, or t
  misc_feature (342)..(342): n is a, c, g, or t
aagctccacctcctgggttcacacattctcctgcctcagcctctcgagtagctgggactgcaggcaccggccactgcactccagcctgggcgacagagcgagactccgtctcaaaaaaaagaaaggtaaagcgttcattaatatcaagcagggcagaaattaactgcataaactgaactaatagaacactgaagcaatctttttaacttttggcttaaaatattcctaatccttttatttttcaaagtcaaaaaaagttttaagctatcaacaattaagtatacgcctaggaacaaaactgggagcatattngtttctctctacctaatttcttcagaattnggaaactatttgtgtgtgtgtgtgtgtcaggtgtgtcaaaaatcagtgggtggtagctgcgtggtgttatttcggagagtctcc

SEQ ID NO: 535617 - DNA, 702 bp, Homo sapiens
gaggcatgaggcagccagcggcaggggcttctgctgagggggcgaggcggagctctgaggaagaccgcagataagtttcttctctgtgaaagataagagattaattacaactacttaaaaaatatagtcaagtagggttacgtaatggatactgcttacgcgttgaagtgtttgtaacgtaagttttaataggcttgaagattttgaagagaaagatagtgaagacttagaagagtagcatgaggaaggaaacgatacaaaggtttctaaaacatgacggaggttgagatggaagcttcttcatggagtaaaaaatgtatttacaagagagaatgacgagaaaggactactggagccccgaattaataccaatatgacgggcagtgcttctagatcacaaatgaacggtgacttaaacagcttaaagttgtagtttacaagtgtaggtgattaaaatactttgaaggcgatcttttcagagggactaaaccgaaggtgattagaagaccttgaaatccatgacgcagggagaatggcgtcatttacagtctagttaacgcatttactagagcgcatgacgaaaatggcagattcacttgggagtggtaggatgaaacaattggagcacgatcgacagtttgcacgtggagactggaagaccagaagtacgggaaggcgagaaaagaatagagaagatagggc

SEQ ID NO: 535618 - DNA, 298 bp, Homo sapiens
  misc_feature (296)..(296): n is a, c, g, or t
agagcagcagacaggggaaaatcccaaaagcaatcaccccgaaaagatgtgctttttaagaatgaagactgcagtttatcaggagtcagcttcttgtctcaatctccgggctcacacttcacaaaatgagaattttttcggaagacaaacaaacaacaacaacaaaaaaaacgaagcagaactggaaaaagtggctcaggccaacaacccaagcacaatgagaggccaaggagggaggtttgcttgaggtcaggagaccaagacaagcatggacaagaaagtgagaccctgtcaanac

SEQ ID NO: 535619 - DNA, 129 bp, Homo sapiens
aattcaagcttctaacgatgcccggggacatgccagatacttggggggataaggtgggaggattagtgagctgtgattctgccactgcattccagcatgggtgacagagtgagaccctctctcaaaaaa

SEQ ID NO: 535620 - DNA, 153 bp, Homo sapiens
agtgtacattcctctacagagctgctgttgtcttttctcccttccctccttcttcctgcctcgaatgtggttctaatggcttgatgttccaaaaactactctatgacctattggcaaccttgaggttagaagccacatgccaggtatggaact

SEQ ID NO: 535621 - DNA, 233 bp, Homo sapiens
tcacctgcttgagtctttgcagctggtctgtggacgagctctgtgcttgtcttctcaactatcgtagtcgtctccttttggggctacttgcgcatggtgtcctctagcttcccagcctcaaaagcctggaggactcggggctccaggctctaatatagcctcctctctcgccaacactcagccctcaagggcgctcactcggccccatggtgtgccagtgtgctcccccgtgg

SEQ ID NO: 535622 - DNA, 458 bp, Homo sapiens
  misc_feature (74)..(74): n is a, c, g, or t
agagtacatgtgcaggtttgttacataggtaaacttgtgtcatgggggtttgtagtagagaatatttcatcacncaggtattgagcctagtacccattagttatttttcctgatcatctccttcttcccaccctccatcctctgatacggacccctattttagatatgggaaataggagaggtcaggccctcaaggtaggtgtgatttcaaaggcttgaaggtgtgatttctttttttatttttatttttattttatattatatttttaaaattttattattattaaactttaagttttagggtacatgtgcacaacgtgcaggcttgttacatatgtatacatgtgccatgttggtgtgctgcactcattaactcatcatttagcattaggaaccaacccaaatgtccaacaatgatagactggattaagaaaatgtggcacacatataccatggaa

SEQ ID NO: 535623 - DNA, 336 bp, Homo sapiens
tgacccgtaccgtgcacccctgaacatcatatagggttagtgcatcctgatgtcattccctacatgtgtagtcagcagtcccgtgtgtccactgtgatccttcccaagcactcctgagcctcaatctgcatcaggcccgcgggaggccggtcaagctgtgaccggcaatggggtctcagccagaggcaccagcccagggcagggagaaggccgagaaggccgggagcgcggctgctgccccactgactctactgtctcctcaggatgtggcttctcctcacataacaacagagctttctccaaaatgggaaatttcagttttaataactctcagtt

SEQ ID NO: 535624 - DNA, 100 bp, Homo sapiens
agaagcagtgttctgctccagatctgacatttagaactcagagctgttggtggccacactgtggtgcccttgaaataccatattcttgtatcttctcatg

SEQ ID NO: 535625 - DNA, 985 bp, Homo sapiens
atttctttccttgtaaaaaatcctatcatttgcaataacatggaggaacctggcaagaacattatgtaagtagaaatcaatgccagagacaaagagagtacctagcatgcatgttctcctaggtacctccgatgttcattgcgaataataggattccttctccttgtaaataatagtaatcatgccacaattggctatagcagtccgaccagcaagtagacacttaggtcgttttcgatgagataatccggcagttagtggtgaaacctgcttagcaggtcagacactgggtatgtcactaatgctactactctatacgagatgatacatagagttttcacccttctttcttcctatattgtatgacccacgaaagctggggattctggtgctatcaaatggatggtgtctatcctaaaaggtatgagggagacccgtcctactacattgtgctgccatagaatggcggttactcacacttaaccattcttcagcaaacctaggatcacttatgggctatccacttctgcgtctcaaccattggtcgccgacagtatcgtattatgcatgtgccgtttataataagtaacgaggcttaatcgctagatcgggcgtagtagactggttgagccgtccccctcgcaatatgcagtgctgttagaatttggcattctccactcaccctgaatgtgtgtcgactagcttgagggaaataaagcggcattagccatccgggatccgaatctccgttgccctctccgttggtgtcgagcatatgaaagtcgcctctaataattaagcacggagtgatcacaggggggcgccttgtagatggcctgttggccaccgtgaaggatcccgcatcttgtgaggctacccattctggtgaaaaggcacagaaggccccacggtgcaagcagagcaactgtcctcgagggaggaatgacccacctgggatacgaacccagcgcctcatcctgcgacg

SEQ ID NO: 535626 - DNA, 384 bp, Homo sapiens
cttgagacagtaactttttgaataaaaataaacctacagtaaacagtacaattaggacaatagaatgtggaggaccaccaggtacagtaatagtataagacatcgagcgtggctgaacgacagcatgcagagaatctgcattacagcacaagaagtacgtccattcacaagagctcaggacaacaactatcgacactgcatacttacatgtgtcctctatctgatagatccgctcgcacatctcagctacatctgcacgcactctgactcaacacatacaatacccatgaccatcaaatatgccttccaacaaccccgaactcatcttcagcatcggccgtaactaccaccaacggccttccagcctcccagtcaccgatacca

SEQ ID NO: 535627 - DNA, 328 bp, Homo sapiens
ccacctcccgggttcatgccattctcctgcctcggctcccgagtcgctgggactgcgggcgcccgccgccatgcccggctggttttttgtattttggtggggatgggttttcgccgtgttggccgggatggtctcgatctcctgaccttgtgatccgcctgccttggcctcccaaagtgctgggattaaaggcgtgagccaccacgcccagccagaacttgttcattttatgactgaaagttgatgcctttgtggctaccatctctccatttcccccatccaccagcccctgttccccaccactcaacaataaactggttcctgctat

SEQ ID NO: 535628 - DNA, 964 bp, Homo sapiens
ggcgcgctcccggaaggcgcgcaccgaagagggcggatcgcaggagccggtccgccgccgagaacgggagcctgggtgtgcgtgtggagtccggactcgttggggagacgatcgcgatgaacacggtgctgtctgcgggcgaaaattcacgtgttcgccatttttcgcttgagatagtgaatagagggcgcttaacctttacggttggttcataacacagggctttcaaaaggacaggaagcgtccctgggtggtggatggaaacgtttcggcgggatcaatgctataaaaatgtagaacgatttacagttggaccctaaggaggaaaaggaaggtggatgctgggaatttactccaccattgtggaataattaactggggtgatctaggaagacatataattgggatggggaaattggtgaaggcagggtgttctactttaatttaatcagcgagaatatatttcaaagaagaaaaattaagttgtcttgaaacaaaaggtggttccattagttggggagaaaagacttgggtttgaagaggggtgattaatccagaaaggtggtgggtggacaaggattttgaacgacccagaatataattttctctttgaccggatgggaaatgggtctccaaggggaaagtgaattgtgaattggaccctggttgtggaacggtcggtacccaaaattggtgtaattctaccttctggtggacggggattaggacacgtattttggtccattgtccagatacatattgaattacgaagagtcataacattattctggattgggaacaacgatattttgattattaagtaattgtatctattaactcttacattaaattttaggatagaggggaggaagggaaggagaataattatgggggtagaacaaataaggcggtagggaagataggcctaatttagaaaaacagggcggggattttaaaaaaaata

SEQ ID NO: 535629 - DNA, 174 bp, Homo sapiens
actgtatcctgcaacatcacgcctgaactactcatcctcagagaagacattcctgatttcccctgaacagatatacaaacccttcacagatttttgaaccctgtgttgtctttctcccgtagcatctgatccagtcacagtttcacgtgtgtgtgtgtgtgtgtgcgtgtgtgt

SEQ ID NO: 535630 - DNA, 508 bp, Homo sapiens
gacacagctctgcacgcggctgcctcgaagggttatgcagacattgtccagttgctactggcacaaggtgcgaggacagacttgagaaccaatgagaagaagctggccttggacatggccaccaacgctgcctgtgcatcgctcctgaagaagaagcagcagggaacagatggggctcgaacgttaagcaacgccgaggactacctcgatgacgaagactcagactgattacccccggggccgctttgattgttgcctaaacttcttttgcttttgccattccggagcctgggttgtttgccagaagagtattgataactgttgcttttaaagtctgtatgagcgcgacactgctgcactgtgatctgtgatgagtcgttgtgagggtgggtcattctcacccacgccttgccaataagtgaagagatactttgttgtataaaatacatatatgctcaccagggtaaaataaacgaaaaaaaattatttctatttatcaagctaaaaa

SEQ ID NO: 535631 - DNA, 290 bp, Homo sapiens
ccatgtgctacgatcttgggacgaactgaaccacgagcgtggcttttagggccgtccgaacgctgcaggccggccaggtccctgggggtccaggcctggcctacgcacccctttgtcccttagcgtttaaaggtttttttccgaatttcaggccctcagctacctgcaggttttgtcgcgaaccggctgcaagtttttaacctaagtaaacctcaatccggagggcctaacggtaaggtgggcgctgtgtttatttaggtgcttaacaataaaaaaaggtagtgagttta

SEQ ID NO: 535632 - DNA, 350 bp, Homo sapiens
  misc_feature (102)..(102): n is a, c, g, or t
  misc_feature (202)..(202): n is a, c, g, or t
  misc_feature (239)..(239): n is a, c, g, or t
  misc_feature (308)..(308): n is a, c, g, or t
  misc_feature (318)..(318): n is a, c, g, or t
acgaagaagagggaaagggcttgggaacagaataacaaggctaaggatggagtgacacttctctggatacacgatatattttgtaataattctgactctcanaaccatagtaatttccacatgctgacatggtgtcagaaaataaagaaaacttcaaaaacaaatgggggtttgttgaaagaacacaggagccaacctgaangagcccataacagccaatgctggaacgaatacagcancaaaataaatgatagtactagatcaaaaacaaggagtaaaatattaatgagtccatattgatataaacnatctgataantagatggaggaaaagcgacaactcttcttcgt

SEQ ID NO: 535633 - DNA, 154 bp, Homo sapiens
gtcgactgcatattctggcgactgagaaaggatgaaggtagagagagaagaaggaatggagagaaaaaggaagagcagagaagaggaaagaagagagagaggagggggcaggcagctccttttatagcatacctggctattgccaggtaactgt

SEQ ID NO: 535634 - DNA, 242 bp, Homo sapiens
tgatgtttgtgtctccctaaaatctatttgaaattctaaccccctatgttatggcatgtgatgatattaggaggtgcggtctttgggaggagcatgtaagattcatgggattcatgctcttatcaatacagactccagagagttctcttgtgcctcttttggccatctcaggatacgagtaagatcgcagtctgcaaccatagacggctctcaccagaacccaaccatgctggtaatctgat

SEQ ID NO: 535635 - DNA, 196 bp, Homo sapiens
cggtaaccatcaccctgcagcgcgagttctaattgttcttcaaagtttgcttgccgtttaggatcgtttttaacgtcatctgatttagcttcacgattcataatggctttcgcaccagaattggccgtcatattattattcaagtctttaaagttaatcacacggcccatattcatcactcaagcggccatcatcg

SEQ ID NO: 535636 - DNA, 726 bp, Homo sapiens
cttggcctcccgaagtgccaagagtgcagcctctgcccggacaccaccccgtctgggaagtgaggacgcgtctctgactgggtgcccattgtctggacacgtgagcagcccctctgcctgactgcccagtctggagagtgaggaagtgggctctgtccgtatcgatcactctccattctatggtaagagagagagtacactacttagcaaaccgtcccaatctccagtctatgtaacggtgagaaaaatattataccctgaacgctcatcgtctgatatagtgaagaggaagcacctctgccctggcgagaaaccacatttggaaagtgaggagcaactctgacccaaaactgcaccggcttgagaagtgaagaaagaccacttcccaggctggagaaaacttgcacccgtaactgaacttatgataaaggaagggcacaatactggtccaggcataaaagaacaccgaaaatgcagaagctggaggaagacaccaaacataacaaaacaaacaaacacatagtcatagggggaaaggatgaattaaaaacagataaatcccagaacacaggaataccacaagcaaagttacaagaagaaggagcacgagaggacgaggagatcaaaacacaagccggtacagaaaaataaagacgcacccaaatacaagacgaacgaataaaaatcaacgcacacaatgcaactaccaaacacaccataacagag

SEQ ID NO: 535637 - DNA, 212 bp, Homo sapiens
gcaggatcccgtgagcaaactaatatttacaatcagcagtaaacaggcatcagtatgtgaaagcacattacaggtcagaactcattcaggaacagactttaaaatatcactcaaggggcataacaacatgtgcaacaaataaatataccagtgacattaagcaagtgtgcgcaaacttaagtgaatgtattaatttactgtgatcttggtcg

SEQ ID NO: 535638 - DNA, 962 bp, Homo sapiens
  misc_feature (39)..(39): n is a, c, g, or t
accatttttattttcagggcggagggcggacctgaacanggcccttaattgggttgaggctgatttcccccggggatgcgttccgcctccacactcgtacttaccatccccgggcctgtcggatgcggaccgtttggcacgggacccgtgacctgccagtgatttggtggcccaccccccccacgtagtcgggcccaactgagatggcgggcctccatttctgcccgggggccaatactggactgtttaagatgggggaggaccacttttggagtggccctccggatacctacttcgtctgttccgttgcctttttaaaccccgtctcagtaggcacctggaacagccagacttcgggggtgaacacccccgtgagtccctttacaaggatttttgccagggactccccaaagggagggacttggaaatttagacaaaccgttggcgcccttgtagaaagaacagtccgtgtgtccctctcaaacatttcccagttgaacgccagtataaataagtgttggaggtaacaccttgcgatataagagattttaggggggtgatagctctttctgcttctgcccatccccacacatcctcggggggaagggagagctccactgagggtatactaatttcacctgagccccacgaagtgggaagcttgggttgagcctaaaacatttctgagttatataggctagctgatttttttaaaaattcgttgcacttgaaggagtattttgcaatgtctggaacaccccgtcacaaaacttgtttgtattgatttctgagtaatttttgcacgctgagactaacgtgtaattgggcagatcaacttttgcagctagattatgcgcatcctcggggccaaattttgtatttttaggggttggttccaaccccctttttgctgtttgaggaaatggaaggttgggtatttttatttaaacattttccatcca

SEQ ID NO: 535639 - DNA, 229 bp, Homo sapiens
cggtgactctagcaggatcctcgccaacggtaatttcaagggttattcacaatgagttacttgtttgtggtgagttttaaaaatctcgttattggccgggtgctgtggctcatgcctgtaatcccagcagttgggagactgaggtgggcagatcacttgaagccaggagttcgagactagtgtggccaacatagtgaaaccccgtctctactaaaaatacaaaaaaaaa

SEQ ID NO: 535640 - DNA, 82 bp, Homo sapiens
cagactccagttatggctcaacccaaagaagatgaagaggaagatgatgatgtagtggctcctaaaccacctattgaacctg

SEQ ID NO: 535641 - DNA, 317 bp, Homo sapiens
  misc_feature (53)..(53): n is a, c, g, or t
  misc_feature (113)..(113): n is a, c, g, or t
  misc_feature (163)..(163): n is a, c, g, or t
  misc_feature (211)..(211): n is a, c, g, or t
  misc_feature (226)..(226): n is a, c, g, or t
  misc_feature (252)..(252): n is a, c, g, or t
tgaaaacacaacctaatcagcagtaaatctctctactcggcgagcgcagtgtnacgcctgtaatcccagcactttgggagaccgaggtgggtggatcacaaggtccaggagtncgagaccagcctgaccaacatggtgaaaccccatctctactaaaaatacnaaaattagccgggcgtggtggtgctcgcctgtaatcccagctaccccnggaggctgaggcaanagaatcacttgaacccgggaggcagngggtgcagtaagccgagattgcaccactgcactccagcctaggcgacagagcgagactctgtccc

SEQ ID NO: 535642 - DNA, 171 bp, Homo sapiens
  misc_feature (135)..(135): n is a, c, g, or t
  misc_feature (147)..(147): n is a, c, g, or t
cgctgcatatggtgcgatttgtgtcaacttgctgtagactgattgaagatctgcccagtccgggggctgcatcttccagcctctgcaaagtgaaggaagagaaggagaggcatccaaacgctgatgtgggtgagnggtggcaccagngatccccaatcctggggccccact

SEQ ID NO: 535643 - DNA, 251 bp, Homo sapiens
cgacactagaggatcccgaaaccctgataacgcatatatcagacaaaactttcattgaaaaagatgtatggacccctatattccttgcagcaccactcacaacagtcaagacatggaaacaatctaaatgtgcatcaaaagatgaatggattaagaagatgtcgtatatatacacaatgaaatactacccagccataaaaaagtacaaaataattccattttcagcaacatgggtggaactagagtatctc

SEQ ID NO: 535644 - DNA, 458 bp, Homo sapiens
  misc_feature (170)..(170): n is a, c, g, or t
  misc_feature (198)..(198): n is a, c, g, or t
  misc_feature (285)..(285): n is a, c, g, or t
  misc_feature (333)..(333): n is a, c, g, or t
  misc_feature (339)..(339): n is a, c, g, or t
  misc_feature (404)..(404): n is a, c, g, or t
tagtggtctcagaatagaccaggcaaattttcaaacatgtacagcacttacatggttctaagtgctgtacactgttctaagttctttctcatttaatcctcataacaaaattataaaattatatcataaaattatatttatttttaataaaatgaattataaaaactagnattagttagatacagaaattttactttnttttgagacaaggtcctactccttcacccaggttggagtgcagtggtgcgatctcagcccaccgcaatccccgcctcccgggctcanggcgatccccccaccccagcctcagtagcctgcactataggcgcaacncccatngtccaggccaatttttgtaccttttgtagagacggggcttcgcatggttgcccaggcccggtctnaaactccagaggtcaagcaatccacctgcctcagccccccaaagttgcggggac

SEQ ID NO: 535645 - DNA, 601 bp, Homo sapiens
atttccctgttcatagttctgcaagccctgagtcctcacaccagcaggtgcctcacaaaaggagacaggtacggagatgaccgctcgtgaatatacacaccctaggaggagaacttgaacaaagtctctgggtcacgttttgcctcatgaacactggctgccagtgtttaagaatgtatatcagagaaaacaataggtatttcttccagtgagtgttgaaatctaagcttaaaaaagaaagattttatgtgcttgaagattcaggcttgcattaaaagactgtttcagacctttgtctgaaggatatacaactgctgtatgtcattaaagtgcacctgtgtcctgaagtttacattatttttcatttccaaagaattcactggtatggaacaggtgatgtggcataaggtgagtgcacggtatgttccagatcacaagtgccttatgtccgaatacagcaatatgtcaccgccgcagccggggcgcacgcatgtgaaacaacaccgagcttgaattgtggagtctttgaaccttataccaatcagttagtaactttaaatttgtcaaaaagttgtattgaatatcataatactttaaattg

SEQ ID NO: 535646 - DNA, 384 bp, Homo sapiens
  misc_feature (34)..(34): n is a, c, g, or t
  misc_feature (36)..(36): n is a, c, g, or t
  misc_feature (43)..(44): n is a, c, g, or t
  misc_feature (124)..(124): n is a, c, g, or t
  misc_feature (164)..(164): n is a, c, g, or t
  misc_feature (192)..(192): n is a, c, g, or t
  misc_feature (255)..(255): n is a, c, g, or t
  misc_feature (266)..(266): n is a, c, g, or t
  misc_feature (358)..(358): n is a, c, g, or t
  misc_feature (362)..(362): n is a, c, g, or t
aaccatgatatataattatatcttctctctctgntnttctttnngggtctttactctgaatcctcttttgcatttttaggcttctccttgagctttcatatgtacattaattatttagatagtnctgtattacacttttccttggtgaatggttaatacccttngccattatctttatgacttctagttggntttaataatttacttacttaaacttctctttcttggatttacaaatttgctttaatttcttcntaacttgggcnaaaattttaatcaattaacagtggtgttgaatagcgttaatatatagagaggcagcaaagtataattgttgagtgccatgggctttggaggnctgnttgggattccctggctctcccc

SEQ ID NO: 535647 - DNA, 187 bp, Homo sapiens
  misc_feature (92)..(93): n is a, c, g, or t
  misc_feature (137)..(137): n is a, c, g, or t
  misc_feature (148)..(148): n is a, c, g, or t
  misc_feature (166)..(166): n is a, c, g, or t
ccattttaaaactttaatgattatcttctctcaaaagagaagtggcactcagaggaagtggcacctgtctgctggacaacccctgcaatccnnaaccccccggacaggctggcaccactgctgaccacagcgcttgntcaggcatggntcacatatgccaatcctnggatctgacccaggcagccac

SEQ ID NO: 535648 - DNA, 850 bp, Homo sapiens
cgggccgaccagaaggggcttcgaggaagttaagaaacacggaggtgttaaatctagccttgtagaaatctaaggacactttgggcacttgggttactgttggaacccaatcggctttgcatcccttgatcgcggtaataactcaagcttcttctatccacggtggggactctttccacaaaccaacgttttctaagcagtcgtaaaggatactcaacgtggtctcataggcccttcccatatctataccaaaggctgtctagatgtctcgtcaacctaagttcttcattgttgaacacgcactaagctactcgacactttcttttcactagcaatctctttgtgtggtgttacattagtcatcaatagccaggagtatcaagcaacatctaatttcactataatgagtagtgattgtgtgatatatcgtagtgtgtgctatgagcaacttcagtttttcctccatggacacacttcatcccatcaccaatcaccactataaagtagagatttgttacactccagctattatgagaatgaacactacaaggttctcaagaagatagttgcataatattcgacagatgaaataagtacggaaatcaggcccgggtagaggtaggctcatcgccatgtaatcccagcactttgggaggcacaaggtgggcggatcactaggtcaggagttccaagaccatcctggtctaacacagtgaaaccccgtctttactaaaaatacaaaaaattggccaggcgtgatggcaggcagaggtagtcccaagactactcgggaggcttgaggcaggagaatctcatgtacgtggaatacagcggcttgcggtgagtctga

SEQ ID NO: 535649 - DNA, 370 bp, Homo sapiens
  misc_feature (93)..(94): n is a, c, g, or t
actaaatcagataacacatttaacttataacccctccaccctccccctttgcaacaccgagtccttcaaaccaaaattacacccaatgcctcnncctgagttacccacccatcttaatttaagcaaaaagcaatgctctcaaagccacaatcatcatacaattacggcgttcttagtgaaaataaaatattaataatgctaatattaataagttttttttatttgtttgtaattgatgttggattatttatattattacaaagaagtataatttgtttgtgggggggattaattcattaagattaaattgaacctcaaaggtgggttttttttccaaaatgataaaggccaccaacactgcaagggtttg

SEQ ID NO: 535650 - DNA, 595 bp, Homo sapiens
  misc_feature (21)..(21): n is a, c, g, or t
  misc_feature (61)..(61): n is a, c, g, or t
  misc_feature (80)..(80): n is a, c, g, or t
  misc_feature (96)..(96): n is a, c, g, or t
  misc_feature (107)..(107): n is a, c, g, or t
  misc_feature (113)..(113): n is a, c, g, or t
  misc_feature (116)..(116): n is a, c, g, or t
  misc_feature (139)..(139): n is a, c, g, or t
  misc_feature (151)..(151): n is a, c, g, or t
  misc_feature (187)..(187): n is a, c, g, or t
  misc_feature (191)..(191): n is a, c, g, or t
  misc_feature (193)..(193): n is a, c, g, or t
  misc_feature (222)..(222): n is a, c, g, or t
  misc_feature (229)..(229): n is a, c, g, or t
  misc_feature (240)..(241): n is a, c, g, or t
  misc_feature (247)..(248): n is a, c, g, or t
  misc_feature (295)..(295): n is a, c, g, or t
  misc_feature (304)..(304): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (325)..(325): n is a, c, g, or t
  misc_feature (331)..(331): n is a, c, g, or t
  misc_feature (334)..(334): n is a, c, g, or t
  misc_feature (340)..(340): n is a, c, g, or t
  misc_feature (375)..(377): n is a, c, g, or t
  misc_feature (448)..(448): n is a, c, g, or t
  misc_feature (459)..(459): n is a, c, g, or t
  misc_feature (467)..(467): n is a, c, g, or t
  misc_feature (485)..(485): n is a, c, g, or t
  misc_feature (503)..(503): n is a, c, g, or t
  misc_feature (517)..(517): n is a, c, g, or t
  misc_feature (520)..(520): n is a, c, g, or t
catctaaaatgaacagctttnaagcaaccatgtcttcaaattcatcagcattgaacttggngaagccccacttctttganatgtggatcttctggnggccaggaaanttgaanttngccctgcgcagggcctcaatcanatgctccttgtnctgcagcttggtgcggatggacatgataaattaaanaatntnaaccctggccacaataccctggggctttncaaaggnaccttgcatgnntgtttnntgcttattagccccagcacaggacaacatcttgttgatgcggatgangtgggaggngtgntncngcacccggatatngaagcnatntttgcnacaactttttaccatgtacttattggcacaaattnnntcagcctccagggcttcataggacagctgctcatattcatctgataccatgtggccacaaattggaaactnatccacttttntttttttncgccccaggtcaaaaatncgaattttggcatcaggnacacctcggcagangcnagattttgggtacggcttgttcttacaatatcggtaacaacgggcggggcggcggccatggcgacaccaggatct

SEQ ID NO: 535651 - DNA, 310 bp, Homo sapiens
gtttctctagctaccgagcttctctcctgtgctggaggtaataagggtagacttccctctttacttacactggtgacaaatgcagtgcggattcaatggtcgaaattgagtcaaagttaaactaacacagtctcctgtcccacttacccgtcctctaaacccatccaccagccctaagtggtcatcacatgatcagaagtcagctgggggaagagcagggatagatagagcaattcaggagcctctaatggggtaagccacataacaggggcatagcaacagtctttcatgagtggccgaaatcacccac

SEQ ID NO: 535652 - DNA, 337 bp, Homo sapiens
tcgacctcagcatggagtgcaactgacaacttggcaattggccaggtgcagtggctcacgcctgtaatcccagcactttgggaggccgaggtgggtggattatctgaggtcaggagttcaagaccagcccagccaacatggtgaaaccctgtctctactaaaaatacaaaaattagctgggcatggtggcgggctcctgtaatcccagctactcgggaggctgaggcaggagaatcacttgaattcgggagttggaggttggagagagtggagatccgcccctgcactccaaaccaggtgacagagtgagactctgtctcaagtcgacgcggccgcg

SEQ ID NO: 535653 - DNA, 115 bp, Homo sapiens
taacttagaggatctgtggcgcaggttggaagaggcacgatctgtcgccaccaagcgcagtcgaaagaagatggcggcgctggagtgtgaggacccggagcgagagctgaaagaa

SEQ ID NO: 535654 - DNA, 1211 bp, Homo sapiens
tgtgtggtgcgtggggaggtagcgcagggcacggtggatgggtgttgtccgcggcgggaagtgggctcggcgaggggggcggggtaggtgccgtggcgcgcgtgtcatgcgaccggcacgaggggggggggcggcgcgggggggggggcgaggggggcgggtgctgcagcgactggggggtgggaggatactgcgtggggctcgagaggctgtgttgtggggcgcgtactgtgttgcgcggggggggtattcctggtcgtggtctttctgggggggggcccgcgtgatgtcgggcgggcctggcacgggcggcgtttgttgctgtggggtgggggtggcgacgccggagtgtggtggcggggggggggttggtgcgtgggggcccggtgggttgtgtcgggaggagagggcgggcgtcgctgcgcccgtcgggcgtcgctgtggttgtgttgctctcgccatcggcgtcctcgtcctcgtcgagtgttggtttcggtcgggcggcgtgttatgtggggcgggacaggggccgcgctgctgggggggggcggttgccttggggcgggtgtcaagaggacggcctcgcgggggggtggtggtgtgtatagggcggctcattgagataggagagaggggggggtggagcacccgcgccactcgctgtgggtgggctgcgacccttcggagtaagcagttgtttcgtcacccgcggccgggttgccacgctaccacgtctgccgggggacaggatagaaaggaagtgttcgtatgcaccaggcgccgcgcctcccgcaggcacgcgccgcgggaggggataacacacatcgttcgtgcttctagtctctctcctcctcacgggttgtttcacaaacaagacactcgtggggggcgactcgcgtgaggccgcccctctctcctctcaccgggggcaagctacgtatgcttagtcgggtgagagggcgcggcgccatatcattctctaatgacgtcctattgttgggaggggagagctacgtcactctctctttccaccccctgggtgcccactacaacaagtggcagacagaaagatgcacgcccaccttgtttatccttgtgctcggtggtcggcaggtcgggcgttccccgcccccccgggaaaaatttttttttcttcgcggtgcgtgtgtgtgtgtgtgtgttatataaaaacgcccccttttttttatata

SEQ ID NO: 535655 - DNA, 556 bp, Homo sapiens
cccaccgccgttccgggtaggaaaaggaaaaaaaccattcatttaattaccaaggaggggggtattttttcccctttctaccttcaaaaagtggtggtaggcccagggaagccccccaggccattttctttttccaccaagaagaggaataggtaatgggtttcttaaaacctattcaactttaaaggccgaactggaagccaccaggtaatttttgggattaggaaaggggatggcttttgtattcaaacccatggcccaaatttaaaaaaaaaaatccaattgggaaggaaatcttaaaccattgccacctttttaagtaaaggaggtgggaaggaaacctaaggtaaatgggttaggggataataatttcttaaataaccccttaaaccattttaggggattaaaaaaatccttaaaccccttaaatgggtttgggtgaaataattcaaaggggttaggagggtacccttcccccacctttttaataagggaaatttggggattatggaagccaagaaaggtttctttttgaaccagggaaaaaaccttggga

SEQ ID NO: 535656 - DNA, 230 bp, Homo sapiens
cagaggcaccaaggaggccggctgtagcgcaggcacctgtacagtctgaggcccacctccctgggcaaaggctagtgcctggcccagctcccctaggcagagtgaggacccaggaggcagcgtcagccccatgagcagcatgcagaggtgtgcccagttcatacagcctcgatggcggagagccgatgcctcctccagcagtgctgtggagtatgaggctcagggtagag

SEQ ID NO: 535657 - DNA, 915 bp, Homo sapiens
  misc_feature (8)..(9): n is a, c, g, or t
agattgtnnctgtatgtgaggagtcgcgccttgaatggctataagggcatatttgggtgagcagtatattgtgaagagcccatatagttgagaccctagcctggtgagcccaacaagtggtgggggaaaaacaggggtattccactcggtgaacgaggccaacaggtgtgtggagaagatatcaaaagggtgtccttacccagtaaatgcccaaggccctgcgccgcattccccggatagttacgcgcatccattcttgaaagcccgaaaatgttggcggcgccctgtgtgtctgtcgcaagttacttgacgggagagccctttggggaaaagacttcattcggggaggccatcctttctaacaaccgttctgtccccccctttgaaaagagccccttccgagtgcaagatatccttaggtgggcgaaaaaacccagacccgggagttatccccggtgctcgtcaccaagctccctggcgttgccatctattgggtcgaaaattgaggggcgcgtagtgaaaatattccaccaagtggagtacaggaaagattcaagttgtgacgcaatacacctgcgctaaaatacaaaaaatatttttttttaaaccactttttataggacacttctcagtgaccaccacacaggggtctcaggaaaacatgattctttcctaggcctcaggtttcaccgccttgagtttttacacgcaaccacacaaaaggggtattacgcttttgttattgtatattactaaaatactcatatttaatagggactcatattctcaacttatatttttttaaggaaaaacactattctttgttgaataaaaaaatcatttgactacgatcaccattttaacacaggaaatttggtccccaaatttttggaaaaaaaacccccccacataaca

SEQ ID NO: 535658 - DNA, 650 bp, Homo sapiens
gactgaaagtcattttaaagtagccctctgggccgggtgcagtggctcacgcctgtaatcccagcagtttgggaggctgaggcaggtggatcatgaggtcaagagatcaagatcatcctggctaacacggtaaaaccccatctctgctaaaaatacaaaaaattagccgggcatggtggcacgtgcctgtagtcccagctactctggaggctgaggcaggagaatggtgtgaacccgggaggcggagcttgcattgagcagagatcgcgccactgcactccagcctgggtgacagagtgagactctgtctcgaaaaaaaaaaaaaaaggtacccttttggccgggcttgggggttcacacttttattcccaacatttggggaggctcaagcgggaagatcctttgaggccagagtttcaacaccagccggggcaacattagttaagaccccattcttctacaaaaaccttttacaatttaggcagggcttgggtaggcaattgcttttgagagggctcagggcaggaagatcactaatgatggtgccacttggatctcacagcctggggcgacacaagaaagaccctggtctctgaaactacaggggggcctctgtcacattttttcccttatcttcaataggtagttac

SEQ ID NO: 535659 - DNA, 348 bp, Homo sapiens
  misc_feature (42)..(42): n is a, c, g, or t
gagatggagtcagagtctcaccctgttgcccaaggtggagtntagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgacacgcatggcctggccttttggaatatttaataagctaaaaaattcttttacacaggtagattaattaggtagccagg

SEQ ID NO: 535660 - DNA, 281 bp, Homo sapiens
aattagcttgcgcacaggaattagcttgcgcacggggcagtgagccgagatcacaccatggcactccagcctgggctacagagactctgtgtccccccaaccaaaaaaaaaaaaaaaagggggggggccccccagcaaaggccggaggaaaaatggatggtttgctggggggggggggagaaatccttacacattgggttacagaggtctttggggtaatggtggcgggggggtttttccttaagggaccacgctgcccaaggggatcaacagattcattt

SEQ ID NO: 535661 - DNA, 104 bp, Homo sapiens
tgggggggcaaagcgggtgacttggggttatgtggcacaagaggggtgaggggtggggaaagtggtggtggtggtgatccaccacacacaaagtgggtctattt

SEQ ID NO: 535662 - DNA, 801 bp, Homo sapiens
gagcggtgtgggtatccggtctccacgatccatatcctaaccgtacacattatagaagtctgtgagatgtctgtggcatattcatcatctcgtgaagaactgaggagctcttaactgagttacatgagctctcagctattttccccactatagctactcagttttttctagtatatagtgtcaaataaaattttgaaaaaattaccccttcccacaatctttgcaaattaatccccaaatgaacaaggatttaatttagctattccatgataaataaacaaatatgcaattttattgaataaacttaaagtaattaataaattcaatgtactgtcagaagttttctgttttgtccagtcttttaacaaatgtcaattaacaatgctacctatgtgggttaaaaagcctataatacaatttctaacttcaggaatatgtgacaacatgtagaaagggtactattgggctgtgcaatttaaacttttcatcacctacaggttatggcataagcactgactatgaaactgacatgagaattagcgcttatatgtcagagtctatctgctcttcagtgctattactcatcaccaatatttcattctacaaacgtagggcaaacaacattcactaaggctgcgcagcaatattgccctgcattatacccaactcaagccacagtcgctccacggaaacgcttgcattggacccacctgacctcttcggctcctcttaccttaagtactccattccccacacaaacacgtcctcttactcacgaactccatcacatctcacacgctc

SEQ ID NO: 535663 - DNA, 718 bp, Homo sapiens
gcatagtggctcatgcctgtaatctcagcactttgggaagccaaagtgggaggattgcttgagcccaggagttccaaaccatcctgggcaacagagggataccctgtctctaccaagaaaaaaaaaaaaaaaaaatgttcaaaaaacaattagttggccctgggtggtgcacactcagtaggtgatgtgaaaggttctcctttgaaccggggagactgaagctggcagttgagccactgatcgtgccactgcacatccagctctgcgggacaacgggggaccctactctcaaaaaaaaaaaaaagaaagctcattcctccctccactcatacgtgattttgacagctatgtggattgtcattcacgctctacacgccctcagccgtacatacaggaacccccaaaacggggttctcacttaacatcgtttgatgacgaacgtggtggacacctttcaacaagcgacggtgtgtgttgctgtgccgacaaatgatgagatacatagcacatcaaacacacggcggtcccgacggaccctggctaaagggcctacaacaatatccataatggcaagcaccgggcggtcacacaatgggtgtgtcatcgacctgtgctacacgccacgagtgtgctgaaggatattccccattggtcactatatagggaacaccccctgccctgcgctgtagatcctactggaaatgtacccttgtgtgca

SEQ ID NO: 535664 - DNA, 224 bp, Homo sapiens
cccaaaaaaaaaaaaaaaaaaaaaaacccccccccccctttggccccccttttttttttgggtttgggggggaaaaaaccccccccttggccctttttaaaggggttttggtggggattggggttttaccccaattttaaagattaaggggtccctgaaaggggaaaaaatttttccccccttcccgtttttttaaagggcccaaaaagggtttttttttccca

SEQ ID NO: 535665 - DNA, 466 bp, Homo sapiens
cacaggtatgatatatgtcttaccgtcgatctcctaaaaggcagagtacaccagtaagccatgtatctcagagaagtgtaattcataaagtatataggctagtatgatagtaaccaagggatggaagaagtaaatatatgatcaggtagcactttatactcaggcagatctcagccctctactgagtcccttatccaagcagtttctttcaacgaagccagcaggcgaaaagcagggactgccactgcatttcatatcacactgttaaaagttgtgttttgacattttatgtttagtagcacaaatggggccaaagaaacatcgcctatgagcgaagatatgattggaaaatcaagagtgtagaagaataagtactgtttcactgtccaaacgacatgcttatagtgctctgtaaatgtacctttcctttgtagtctctggcaagatgcttgaggaagatacgagt

SEQ ID NO: 535666 - DNA, 1717 bp, Homo sapiens
ctagattctagatcgcgagggccgcccttttttttctttttttggagcttgggagtactctgattgctgacaaatgccgtactcctagagcaccacagtcagtaccatggcgactgcagattgcccacacgcgacggtcaacagcccgcatcataacaggcaagacaccatgaccaaccagggaaccgacataagaccccaatcacagcacgcgacaagacgacaggacacggggtacccggcagatgcacaccgcacaccgagacgcacacagagccagacacatcgagagcagaagcacacaggaggtgacctcagagagcaccacacagcaggtcaccaagagagtcaacacaaagcacacgacgagaacaaagagaaaacaacaactgcgagaccaaaaagaaaaacatagcgagaacagcgacaaacaagagcacaagcaggaaaccgcacaaaatacagcgagcccaatagcgagacccccaccccaaaaaagcacaccaccacacgcacccaactcaacaagcaccacaccacagcactacgccaccgacacggcgcaacaaagccgagcaccaacaaacacaaaacaccaccccagcacacacaacccaaacacgacaagataccaccaccgtcacaacaaccccacaaccacgatgaccaacagccggacacaagagagagcgcacacgacaaaacagacaaaaccaaccacagagaaaaaacacccacacaaagcacacgatgaacaaaacagcgcgaagaatcgcaaccacgcaaccgacaacagaacacaaccaaagaaacacacaaacagaaaaaacacataccagagagcaaacccaacaagaacaacacgaccccacaacaccgcaagcactagctgataaacacagcggcgaccagacaacagggagaaggagacgacaaccaacgagaaaagaacaaaacacgaaactgaaccacaccacgacgcaagtagggaagagcacacaccaagcgagaggaggcagagaccaccgcaccccagaacacaacccacaaagcaaggacgaaacgagcgcagagagcacacggagccgaccgagggtacgcgcccaagctcgccagcagagaagacagaaaccaacaaaaacaacaacaagaacagaagagaagatcaaacacagagagaaaacaacacagcaaaccaactacacggaacaacacaaacagacacagacacacacacaaagacacaacgcagcaacacgaacaccacaagaagacaaacaagacaaagacaccacgcaaaacaacagagaatacgcgcagaagcaaaaaaaacagagacatcggcaaccaacaaccaaacaaagaggcagaagaagcacagccaactacataagcaaaaacgagcacacacacacaaacggcacaacacacaagaacaacagcaagaaacaccaacagagagtaagaccgacagcaaaccaacacgacagcacacgccgacacacagacgaacagcagccaccacacgaaagaccaagaacacaatacacacgaacacacacacaaccacaaccctacagacccacaacgaaagcgacagcacagacccaccacaaccctaaccaacacacgaaaaacaccaaacaagacaccacaatacaaacaaaacgaacacaatcaaaacaaaaaacaagacaacaacaaaaccggaaaggca

SEQ ID NO: 535667 - DNA, 1013 bp, Homo sapiens
ctgtaatgccagctactccggaggctgaggcaggagaatcgcttgaacctgggaggcggaggcggaggttgtggtgagccgagattgcgccattgcactccagcctgagcaacaagagcgaaactctgtctcaaaaaaaaaaaaaactaaaatgcccgtcctgcgcggctttctgtggcctgcctgtccttgcagtggtggccctgtagccccaggtctgagtgaggctccagccgtctgcgctggggctgcacaaattccagactcctgtgggcaaaattcttttaattgtgttgcatttttgagcccttgaattaatccttggtggcttggcttttttggggtgtccctcttgatctctgggaaggacgggatctaggccatagcttaatgtcccgtgtgttttaattcacaaagtacggtgtgcacacttgccagatagctgaagctcatcaaacctgtacgtgtgaaagactgagcattgaaccaaaacctgatgggaagaaaccctttgtggaggccacatggtcaagcagagaagagggcctgaggcctccaccacactcacaggcctctcaggctcaccgtgtctgtggcatggtggggtaacgggggaggcccgttgtcctcgcgtggggttcgccactgtgaccagccaggaccacagcctcttgtgaggctgagacagcgcctccgttgtatcgaacgcgcttgtcatggtctcttgggcgaacgttgcggtcaagacctccttgtgaagctttgccgaaagccagatgttgcagcctagtggcaggtgcacaggattgctctgggccaggtgctggtgtttgccctgccccagtgtgacaacactcgggtttcacgggcgtcttttcgttgacaccggaggtcgcgcagagtgtctgtggcgtcacttgctcgtggggtgtaataacctagtgccttggcccttcgttcgtgccgtcgacccgtcacacgcggtgctccggccggctccccggtctaggccc

SEQ ID NO: 535668 - DNA, 299 bp, Homo sapiens
tcgaaatcgaattcagaagtggtgagtctggcaattccacgcaccgatcacgtctgggaaaagatctaatctgccgtgggcctgtcgtgacttggaagaaccctacagcggggtagaaatgcattttattctttaagttcacgtaagatacaagtttcaggcagggtctgaaggactggattggccaaacatcagacctgtcttccaaggagaccaagtcctggctacatcccagcctgtggttacagtgcagacaggccatgtgagccactgctgccagcacagagcgtccttccccc

SEQ ID NO: 535669 - DNA, 208 bp, Homo sapiens
cctattttggtttattacacaggaaactcaataatatactgtaaaacgtagttttttttccctcaaaaatgctttttaatgtcaactccccatggggccttggtgaaaagttagttttgcaaagaataaatcaatcacttgtttgactcctccagctaacagagagcgtgtgaccggccgaatgtccttacctgttgggaagcttggg

SEQ ID NO: 535670 - DNA, 444 bp, Homo sapiens
taatacttatccgtattgtgatggtctgcctcagtgtgtttctgccgatagggcgatgttctaatatgaagggtgttcaattcttaaagataacaagaaattgccacattaactgactcttccttcacgaaagattcagtgtccatgcgatactgttgataagcatttacccatagtataacttctttcaaaattggagttagtcttctcaaaccctgccactgttttactatgtttatcaatattctaaatcctttgttgtaggctaaacaatattctcagcattttcaccaagagtaaatttcatctcacaaaaccactttccaggttctttctggactgtagagttctttccaggctacgttgtggcagtttaagagtctggcatcattttccgctgggacctaaggatcgaggaggtgcttgtgactagactgccaatgg

SEQ ID NO: 535671 - DNA, 388 bp, Homo sapiens
tatctcacattacaaacaacaaacaaaattagctgggcgtggtagcacgtgcctgtagtcccagctactccgaaggctgaagtgggaggatcacttgagcctggcaggtcgaggctatagtgagctatgatgatgccactatactgcagcctgggtgacagagtgagaccacatctctagaaaaataaaagtaaataaaagttaaaaaaataaatcttgtaaagtgtttttggtagttataagtagggagattagtacaatgtgagctactctaccattactagaccaagtgtgggcactagggttttgcacttgctaataacatacatggttatgatgagaaggggacctggtgtttcaaattccacgttacctgttttgcatgtaa

SEQ ID NO: 535672 - DNA, 181 bp, Homo sapiens
tccctctgcgagctccattgcagttctggacttaagaaaccagtctaatctgaactgaggagagttgcgaatacatcttgtcgcaattacatcattaacatttactttgtcaaatccaatgtttgtgaagcatactattcagtataaacgatcttcttcttcaggatatcagaagatgaga

SEQ ID NO: 535673 - DNA, 818 bp, Homo sapiens
  misc_feature (9)..(9): n is a, c, g, or t
  misc_feature (63)..(63): n is a, c, g, or t
  misc_feature (65)..(66): n is a, c, g, or t
  misc_feature (68)..(68): n is a, c, g, or t
  misc_feature (283)..(283): n is a, c, g, or t
  misc_feature (302)..(302): n is a, c, g, or t
  misc_feature (305)..(305): n is a, c, g, or t
  misc_feature (314)..(314): n is a, c, g, or t
  misc_feature (346)..(346): n is a, c, g, or t
  misc_feature (365)..(365): n is a, c, g, or t
  misc_feature (393)..(393): n is a, c, g, or t
  misc_feature (396)..(396): n is a, c, g, or t
  misc_feature (402)..(403): n is a, c, g, or t
  misc_feature (406)..(407): n is a, c, g, or t
  misc_feature (409)..(409): n is a, c, g, or t
  misc_feature (423)..(423): n is a, c, g, or t
  misc_feature (432)..(432): n is a, c, g, or t
  misc_feature (519)..(519): n is a, c, g, or t
  misc_feature (521)..(521): n is a, c, g, or t
  misc_feature (533)..(533): n is a, c, g, or t
  misc_feature (552)..(552): n is a, c, g, or t
  misc_feature (563)..(563): n is a, c, g, or t
  misc_feature (566)..(566): n is a, c, g, or t
  misc_feature (573)..(573): n is a, c, g, or t
  misc_feature (577)..(577): n is a, c, g, or t
  misc_feature (586)..(586): n is a, c, g, or t
  misc_feature (588)..(588): n is a, c, g, or t
  misc_feature (605)..(605): n is a, c, g, or t
  misc_feature (746)..(746): n is a, c, g, or t
  misc_feature (813)..(813): n is a, c, g, or t
atataatgnataacattttaccttcattcttcagaagacttaattagagtagctttcttctcntnntnatctctaatctctttaatattttccgagagatcttctgacatgcattcttcatattctctatcaactttagcaatctgctcctcaagatgtttctctacacgacccaacatgtgtagcaaccatctctaacagacgttgcaagttatttcccacttttcgtctttcttcagtcggtggtttgcacaactagttggtattcccgctgaacagcatnctaattacattacatagcnttncactcgcanccccttggtctaacaagtactttctagcaggngcttgtgtttctccaaggnctcaagctcactggcacatttttgcatnccnctgccnntgnntncctaatttttttgntgggtaaangtcatccacgcttttgaccttcttctttcagagttctcacacttctcttgctttctgttatcattgcattcaattgttctgaaagtnancctccaaacccntttttttatttagggcttnatgaattgctnctncagtttncatncaggagttncnttaagaggtacataaanttgagccctgtatttgacaaggcagttggcaccagcctcgggattaaacttaatttcaaagtcataacctttggaattctcagcacctttaggaataagttttaattttctagccaatttgtgatactctgctaattgtgntttcaatcgcttctttgcctctggcatattttaactcctcattccacaacttctgttgtttcacttnccagt

SEQ ID NO: 535674 - DNA, 614 bp, Homo sapiens
cggcgcaccctccctctcgcgccgcgggcatccccggcgccgtgcacgatctcgtcccgcgcctccgcccctcgctcgttcggtccttcccggcctccccgagcgccggcgagccggttcccctcaggctctcatgaagtatagagcgtgcccttgtggtatttcccgagctccattgcggaagctgaggctcgccatattgtgcggcggcgccggcgtccggggagttgataccagagtctgtgctccggccgcggccagcggagccctgggctggggcaggagccgcaatgtctcaggctgtgcagacaaacggaactcaaccattaagcaaaacatgggaactcagttatatgagtaccaacgaaacaccttcagggaggcattaccaagagggcttcacgaaatggcggtaacacctcgaagtctacacagggaattactgtgcccaactcgggtgcggcatatgctcgaagaacaccatgactacaaaggagatgttacatcgctttagtgcagactgcatcatcacagcccttagaagtggcaaagcaagaatgtcctacctgtcgggaaaaaacgtaggtttccaaaagatcactaaggccagacca

SEQ ID NO: 535675 - DNA, 929 bp, Homo sapiens
  misc_feature (54)..(54): n is a, c, g, or t
  misc_feature (79)..(79): n is a, c, g, or t
  misc_feature (109)..(109): n is a, c, g, or t
  misc_feature (150)..(151): n is a, c, g, or t
  misc_feature (185)..(185): n is a, c, g, or t
  misc_feature (187)..(187): n is a, c, g, or t
  misc_feature (191)..(191): n is a, c, g, or t
  misc_feature (193)..(193): n is a, c, g, or t
  misc_feature (209)..(209): n is a, c, g, or t
  misc_feature (224)..(224): n is a, c, g, or t
  misc_feature (260)..(260): n is a, c, g, or t
  misc_feature (272)..(272): n is a, c, g, or t
  misc_feature (282)..(282): n is a, c, g, or t
  misc_feature (294)..(294): n is a, c, g, or t
  misc_feature (315)..(315): n is a, c, g, or t
  misc_feature (329)..(329): n is a, c, g, or t
  misc_feature (357)..(357): n is a, c, g, or t
  misc_feature (406)..(406): n is a, c, g, or t
  misc_feature (415)..(415): n is a, c, g, or t
  misc_feature (466)..(466): n is a, c, g, or t
  misc_feature (542)..(543): n is a, c, g, or t
  misc_feature (668)..(668): n is a, c, g, or t
  misc_feature (670)..(670): n is a, c, g, or t
  misc_feature (672)..(672): n is a, c, g, or t
  misc_feature (677)..(677): n is a, c, g, or t
  misc_feature (684)..(685): n is a, c, g, or t
  misc_feature (688)..(688): n is a, c, g, or t
  misc_feature (743)..(743): n is a, c, g, or t
  misc_feature (763)..(763): n is a, c, g, or t
  misc_feature (765)..(765): n is a, c, g, or t
  misc_feature (767)..(768): n is a, c, g, or t
  misc_feature (779)..(779): n is a, c, g, or t
  misc_feature (784)..(784): n is a, c, g, or t
  misc_feature (788)..(788): n is a, c, g, or t
  misc_feature (818)..(818): n is a, c, g, or t
  misc_feature (822)..(822): n is a, c, g, or t
  misc_feature (928)..(928): n is a, c, g, or t
gccccctgagtgggcctgaaccccaatttcacccttcccccgggcatagggccnaggccaggacgctcacccgaatgtngctgggactccttgtgccctaagcccaaanggaggaggcagcaccaacattggggatggtcccccaagaannaaagaggaagcccagcctccggcaggcagtatcnanatcnangcccacctgctcaagnctgcagcctccaganctctagcgacaagtctccagagccggccaccaccantatgccctcaanacagaccctnttgagcccattntcatgccttcgggtgcaaatngtccttggtgggtntgtgggcacgtgcacccggatggtcttntcagtggatgtggtgtacaaggctcccacggagtactggatcccagtgntgggaaagntgtggcccacatcaaaggaccggataagctggaagcagccgttgcggttgncgaagacgtgcagcaggccctggttgtcaccagcccagtgctggggttcttggtaggacatgcagagcaggtaggnntccagctgcagacgctgcaggacgctgttggctcggcggtccaccaccaccaggctgtggtcctcgctgcctgaaatgatgtgccggtcatccgccagcagggtcagcacgggtctggagtgtantnantggtncttcaanncgnctgggccggctctagggtcgtagatggtcaacttcttgtcataggtgccagtaancaggatgtcaggcaggtagnananncacagcacggntgagntggnctttatctcgccgaactgctgcccatccgntgcnatgtcccagagcttcactgtgctgtcccaggagccggagcacacgcggtagtcctgcgctgccactgaccacacccagccctcatgggtactatttcgcttagtgnc

SEQ ID NO: 535676 - DNA, 159 bp, Homo sapiens
gctcggtgattctagaggatccctaacagaactccatgtgtgccacgcggcctcgatcacctgggggtcacagggcttgtaaccttccccgtctgttgcgaacttccaggcagagcgggtgagaggtgtcaatgcctcctgccagaagttcgcaacaga

SEQ ID NO: 535677 - DNA, 118 bp, Homo sapiens
agatggcttgttatatttcacatgctggcagtacaggcctgaagttttattttgaccatccatctggctcagagtgtgttattaatattcctaatgtggtggcaagagttggcgggcg

SEQ ID NO: 535678 - DNA, 168 bp, Homo sapiens
  misc_feature (38)..(40): n is a, c, g, or t
  misc_feature (151)..(151): n is a, c, g, or t
taaattgtgtataagccttcccgggtaaagcctgtcannnttttaaaataatggagacagggtctcaccatactgccatactgcctcctccaaatcttggcctcaagcaatcctcctctcttagcctcccaaagtgctaagattatagctnggaggcacccaaaaccc

SEQ ID NO: 535679 - DNA, 190 bp, Homo sapiens
  misc_feature (32)..(33): n is a, c, g, or t
  misc_feature (109)..(109): n is a, c, g, or t
  misc_feature (158)..(158): n is a, c, g, or t
ctgttggggatttagtgtggagcacggctttnncaccctcagtataaaatgtcaggcctgattatctaaaagctattggaatgtaatcaactgggagaatgtaactganaaatacatggcttgcaaaaagtaaaccaccgatcgttatctgatcatanccctaatgatcccagcaagataatgtcctgtc

SEQ ID NO: 535680 - DNA, 840 bp, Homo sapiens
  misc_feature (602)..(602): n is a, c, g, or t
aggtccacggattccgtccccatctctacctgatctacactgtgcgccggtcgctcatgcctgccaataccagatgagtttgatggtgctatctatcctcaggcaatcccgagaccgtggaccttgtccccaggatgcctatagcgggggttccagcagtgctactagtacccttaagtcgaactagaaaaccgaggtcgacttccttaagaagagaacacagatgcacaagaaacccacagagaacccccccagtgcaacggagacgcacacaggagccagatgatatgagagccttgtccccccagtggggagaatctagcatctgagacgaaaacggaatctggccaagactggaaggtcctagccccagcttataggatggagacgccccttgatgcccgctgtggggcccaaagctgtctgccctctggactcagagagtgcagaaggggttgtccccccgggttcttgaggtggcatggagtgcatgaactcaccccctgtcgggcaggaaaacgctgcctcttaccattggcccggaggcagcgggaggtaaccccatcggatagcgggcggtcactgaggactctccaagcccnaaggggcttctccgtaaaggtcgtggcgagtatggactattctggagtgaccaagagtaagttagggacaaccagtgtggaaaagacccccccttcctaccaaaaaagatggcaccaagtctgttgccaaaatggccctttggaaggccagatgaaaaagacccccgtgcaaatgtgtgtcattccgtgtactccagaatcctgtgtgaccattgttcccttgccaagggtctccccg

SEQ ID NO: 535681 - DNA, 423 bp, Homo sapiens
  misc_feature (172)..(172): n is a, c, g, or t
ccccccccccccaagacggaatcaataaataagctgggagggaagggataccgaaatgcaaaacgcgcaggaaggcccaagcaaggaaagaagggaaggaccataactaggccacccagagtttacgagttaaggtgccgggccgtattttgtggggcacggttaggggaangatgggtttgcccagggggcaggcggtggtctttttttcgcctgtgtttttttgtggctcttgtttatgggtatgttgggtttctttctttgttttggtttgttttttttttggtttttttttttttttttttttttttttttttttttttttttttttttttttttttttttttttttttttttttttttttttttttttttttttttttttttttttttttttttttttgacccttctgtcgtcttctc

SEQ ID NO: 535682 - DNA, 507 bp, Homo sapiens
agctaaaattgagtgtcagaagcagttaaacataaatatgcttcactcactcattcattcattcatggttcttccattcctaatcttgtatctcctacattaaattccctgcatagttaatactctgcatttccacagtctccagttactctggtcattaccagtatgtggaagtgcatatgcttttgcctgttttgttcaactgtgtgtgtgtttttgaagaaacacatccagagactctaaggctttgttttggtaaaataaagcaactttaaattccaggtgttggcagtggcagttgtctaacatagcatgataaaattatcccccaggttcctatatgcgtggttaattacaggtgatccaactcccaaagaatacacatggcctggatctctgagctctgctgaataaaataaccaatgtataatttcattttctgtgaaaaatgttaactaaactagaaaaggtgatcaaataaactgttgctctcccaaaaaaaaaaaa

SEQ ID NO: 535683 - DNA, 141 bp, Homo sapiens
gatgggtgttgtacatacatggatggtataatatgaaagctttggggatgggtttttttcactcagcataatgcccttatccacgtgttgcatatatgggttgaattatgtcccacccaaaatatgcaagcaagtgggagg

SEQ ID NO: 535684 - DNA, 208 bp, Homo sapiens
agaacaaggaaggagaaagtaacatgtggatggtgagaaaggcatgaggcgaattctcagccatgaaaggctgaaggcagcaggaacaggctctagcgaaatgggtgctgtgtcccctaacctgcatgtggcagcaaaagttgcaaagtttcatggatttgaatgtgaaccatctgttccctgagacgcaactgccaacaacgtggtt

SEQ ID NO: 535685 - DNA, 132 bp, Homo sapiens
ccgtgctggcattgcgcttttcatgggcgtatcggacagctcggcggagcaatccgtctcaacacatatccacgccctgtgttgtcaaggccggccaccatcagccagtgccacagtgatggtccgagcgga

SEQ ID NO: 535686 - DNA, 363 bp, Homo sapiens
tctccttgcttcagcctctcgagatcgaaggtgcacacgaccacacctggctattttgttttcttgtacaaacatgaacctatgttacccgggctggtctcaaactccagagctcaagcgatccttctgcctcagcctccccagtagctaagattacaggcgcccgacaccacgcctggcaaattttcgtctttttagtagagacggggtttcgccatgttggccaggctggtcttgaactcctgtgctcaagcaatccgcccatctcagcctcccaaagtgctgggattatagtgcatgagctgtcccgtgcccggactcgtttcctgttctaaaactttttaataaactctgactcctgct

SEQ ID NO: 535687 - DNA, 434 bp, Homo sapiens
aattgtctggcaaatcctttcaaaaggatccccaacccaaaaaagaagcccaacgcaagggttcttattaggccgtgctccaaagtcatcgccgggtttctccctgtgattatgaagcatggttccattggggaatttgaaatcattgatgccccaaagctgggaaaattgttgtgaacctcacaggcaggctaaacaagtgtggggtgatcagccccagtttttacgtgcaactcaaagacctggaaaaatggcagaataatttgcttccatcccgccagtttggtttcattgtactgacaacctcagctggcatcatggcccatgaaaaagcaagacgaaaacccccaggagggaaaatcctgggattttttttttagggatgtaatacatatttttccaaataaaatgcctcatgggctttggggcttcca

SEQ ID NO: 535688 - DNA, 1121 bp, Homo sapiens
tgagcagccctagttccaactattgtggaaccaagtttccacacattgataaaggggtgttgcttgtcacactgaagaaagtcggccttctaaacagtagtttagggaatatgctccaggtaccccggtattagttctcccaagcccccttggtcatggcggaatgtccaaagtttgtacaggccagggtgtttcaaggacacctacctcttgcaaaccccattcctccatggctcctgtttaggggttattctatttgtatcacatgtacatgttttgcccgagtgttgagggggggtgtagccagaattagacttacattgctgcttctatgtttgccacttcctgatccatagaagagcatgattttcacttgtctttttcattgtattttgattggaaagcctgaaaccatatagtattttgcttgtttgcaggacttccttgggaattcagattggtgagggagaaaatacataggaacaattatcttattttgccattttgttaaaaagagaatcccaacgtagttatccttgataagattctttagtatctctacaatgcctgtggtatcttagaataaaaccagatatttttcatgacagaatgttaactgtgtatatataaaggttggcttgaccattttgattgtgaactttgatatttttgaacctttgaatgttccaccttgggtttattttaaaacttgatagatattcaaccatttgattataatcagatttttctattcttagtcattctttagagtgggaaagtttcagaagttgaggaagagatgaattgaaactttaagaatatatacaaggctgggcgcggtggcttacgcctgtaatcccagcactttggaaggccaaggcaggcagatcacttgaggtcaggagttcgagaacagcctggccaatgtgttgaaaccctgtctctgctaaaaatgcaaaaatttgccgggcttggtgctgcgtgcctgtaatcccagctgctccggaggctgaggcaggagaatcacttgaacccgcgaggtggaggttgcagtaagccaagattgtgccgctgcactccagcctgggcaacagagtgagacgatgctgtctcaaaaaaaa

SEQ ID NO: 535689 - DNA, 267 bp, Homo sapiens
accatacgggggaacagtattccatcaggaagcagacatcgccgagcaagagaagacaacgccaactgagcctcacgtgggcaataaccttggctcagtgagagttatgtagaaggtaagtgcatgacactgaacaggtcgaagctgtgggacccaaggggagaggaagattcctgagactaacagatggagtcgggttctgggaggcggtgggggtgattctgtgctgagcaaaagtatcaccccaggagtacaacctgccggtgg

SEQ ID NO: 535690 - DNA, 455 bp, Homo sapiens
aattagagaatgttttcacagctcagaagagaaagggcattttacttctcccaaccaaaaggcaactccccattatgtgcagtggccctacagagaacccccaaaaaattagtttaaaaaggcttgtccaacaaatgcatgtaagagctggtcactccacactttcagcccttctggaggtgctagatctttagaaacagaaactgacacacctaagagggcaaagatgacccagaggtgacacgctgtggcatcctgctcacaaccagcacactttgactaactacactaaagccctagaccacagctcagtttttccttttgaggaaaaaaaaattgggaaacaaataatctaagaatgaggaaaaaacaaggagaatgacccccctattgggcactccattggtttgatggtgcctctacttgcaatttttgtgtaaattggcatatattgt

SEQ ID NO: 535691 - DNA, 426 bp, Homo sapiens
attctagaggccgaggcgggtggatcaactgtggtcaggagttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaggaaagggaaaaaaaattagctttatacctcttcctgggtcttaaacggccaggaaaattctggaacacttccaaatttcagttggaattaattccaaaaacaaaattttataggttattaaaattaattttaactttcttatatgagctaatgagtatcacttttaaaa

SEQ ID NO: 535692 - DNA, 1147 bp, Homo sapiens
  misc_feature (92)..(92): n is a, c, g, or t
  misc_feature (129)..(129): n is a, c, g, or t
  misc_feature (144)..(144): n is a, c, g, or t
  misc_feature (285)..(285): n is a, c, g, or t
  misc_feature (309)..(309): n is a, c, g, or t
  misc_feature (398)..(398): n is a, c, g, or t
  misc_feature (423)..(423): n is a, c, g, or t
  misc_feature (426)..(426): n is a, c, g, or t
  misc_feature (431)..(431): n is a, c, g, or t
cttgaacgtggatcggacttcatagacagattcgttatggatgagccttttatgagcacttgcaggtggaaaagagctggatgtatgtggcnaaaggttatgcaagagagagtcacttcaggggtttgnttcagaacgtccacntagtgtttgaaaactctgtggaagatattttaagcaagaagggttgccagcaaggccagggaggtccgggtccttgtgcacgtcctgtgaggaaggagaacaaggagacatttgatcatcaatgcagggagaagggtgttntaagaccaaccctcattccagctncaactgtcacccccaccacgaccctcactgtgcctgttacctgaggggtgatttgcagcacaggcagagttatcttggctccagcactntgcgtgccagggcctcagcttcatnagncagtnctcttctgggggttcctggggtgcagttggctgtggggcttttgggtactttttgttgcaataatgttttttcagtctgatatatttatatgtatacgtgtgtgtgtgtgtgtgcgtgcgtgtgtattttcactaatatagaaaaatattgtttttataaacaaaacatatatgcaaatattctttgtatgaaagaaaatatacccttcgcggtgttcctaatcacatgtttgtactataatttcacgtgggttcagttaaactagagctaaggttgtccatggcatgttgagtcagttgtcataatggtcagtgagtaaaactaacctactatgacaaacgtgacttacacctctatgtgagcaaacaccttgtgtgtgtgtgtgtgtgtgtgtgtgtgtgtgttaccagcatacaccctagtaggtgcagcctccttcagcaggtatttcctaggctcacaggtacaagtcaataatccctggaactatcaaaagcaaacctttaaaacttatgggaaactcttagatcttccaaaaaaaaaaaaaaaaaacacagagaactctagatctggttatctccagatggtgtaaaataggtgtgggctctatatacatatatctacgggaccatatggggcaatcacccatgagtaagtctactcaacgccggggggatgcaaatgtcccattggggagatctgggccaacacaaca

SEQ ID NO: 535693 - DNA, 538 bp, Homo sapiens
ctggcttggcagtgcctcatgctcgatgtaaaaaccccacagttcacaggggaggtgtctgccgggctcctcaggatccttgctcaatattcagcattgttagagggaagttgggtagatcttgggaagtattcccaaggaaaacagtcctgggcacagtctccaaaataaattcttaattttgggaaatttacctccttggtaaatctgtaggtgtgtgtgtgtgttaccagcatacaccctagtaggtgcagcctccttcagcaggtatttcctaggctcacaggtacaagtcaataatccctggaactatcaaaagcaaacctttaaaacttatgggaaactcttagatcttccaaaaaaaaaaaaaaaaaacacagagaactctagatctggttatctccagatggtgtaaaataggtgtgggctctatatacatatatctacgggaccatatggggcaatcacccatgagtaagtctactcaacgccggggggatgcaaatgtcccattggggagatctgggccaacacaaca

SEQ ID NO: 535694 - DNA, 196 bp, Homo sapiens
gatcctgcaggatgttgcgacactactgcaatagttcatagcacggatacaaatctgggtttgtcgatatgtgctcgatgcctggggagacccaactaacgcagcgccaacttcagagagcacatacagcgccggcaccggttttcttatgacacttttgtggattatgatgttgatgaagaggacatgatgaatc

SEQ ID NO: 535695 - DNA, 510 bp, Homo sapiens
cccccctcgagagaaggaggaaaagatgatgaatttcataagacatgaggaggtattagtaagatgaaataataaaaaatagagatactacaaagaaaaaactaaaacatatgcagagagagagaagccaatttatcaaaaaggacaatataaaattagaaatatcagcctcctaaaagaatagtgtcaactttaaaatacaaccatgagcaaacctctaaaagtactttgtttactcagtaatgtgtttaaatctcatctatatgactataagaaaactgaatttatggcctagcaaattaaacaaagaactttagtgtgctagctaatctcactgacatcaaattctaaaatatgatttttttgacgtgactcagctctgtatcataacaaattttactgttttgttagcctcccatataatgtaaagatatgactgtctaaagtcattctacttcaacagacacatctgactttctgccatgaagtttgtaaaatatgttttagata

SEQ ID NO: 535696 - DNA, 192 bp, Homo sapiens
  misc_feature (119)..(119): n is a, c, g, or t
  misc_feature (147)..(147): n is a, c, g, or t
tcctgttgctccctcttcactgctcacctgctcctggtgaacccctgcaccgggggtactccatgcgctgccccaatagctctgtctccctcctaccccttcctgccaggtctatcatntcagtgacagcaccatctttaactcccncctctcccaaaccccttctcctggcccctttcaaaccgtccctcc

SEQ ID NO: 535697 - DNA, 1027 bp, Homo sapiens
ggaacatatcagagagatgatctggctgcaatatctattgtaagtcaaaagcattgatgatacctcaagactaacgatgagatttccagaatctgatattcttaagccaacagtggccacgatagtaagtcatcctgagactgactacaatgaacaaagactgggtcttcactcgaagttacacgtacaagcgctttgagggcctgactgcaagggggtgcaataccttcctacatgaaagcagtcacacagaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattgttcttccataatgcatctgaagaaactgtaaaccaaagacgaaccatatctactacgtgcggcgcataaacagctatcctgcttggaagagaagcatcatgagccaatttgataggtgtatgcacaaaataagttgagtgatcctaagttgcatcagaatgaaggggacaaaacagcagcatccaacattatggagatgtcgtgtatagtcatcgaatatcagccagtcctgtaatttgtgacacgctctctgcaagcccaccaagtattcctttatagctaaagttcatagtagctacggaaataaagcaatagagacagtctcagaagccaggattccgggtgaaggaaatgacccgccaccctgagggtggggatggtagtctaacaagaaccaagctcaagcgagaggctaagctcaatacatggggcactgtgtaggcacaaaagaacgtgagcgatggttatccgcggcgcaataaaaacccgagaggaaaggggagggggcaccgacagtggtagcacgaagtgggcagaaacggatgagacatccgggaaaacaacaacggaacgagcgagaatgaaacgagaaaaggcaaccgcacccctactccagctttg

SEQ ID NO: 535698 - DNA, 179 bp, Homo sapiens
acgatacgtgatcgtagacacaagcgtaacttcctaagtttggattccacgtattaacgctgcagcacgtatgaccggtttttcatactcaaagttgattcacggtttgccacttgctggtgttgaattgaccgtaagatgttggctgttattgctgtgcctgttttcggtacttttgc

SEQ ID NO: 535699 - DNA, 861 bp, Homo sapiens
gcacccccagagcgcaagtactcggatgtggaatcttgcggcgatccagtggagatcaccttcaactccatcatgaagtgtgactgtagcacatccgcagaagacctgtacgccaacactgcgtgctgtcaaggcggaccgatcatgtatccgggcattgccgacaggatgcgaaggagaatcactcgactctgggagactcacgaagacatcagtgcaagtatcaagatcatcgcacccccagagacgcaagtacacggtgtggatcggctggcgtccaacctggtgctcattgtccatcgttctcaggcatatgtggattagcaagcaggagtaggaggagtcggggccctccatcggccatcgaatgtgcttctagagggactcagcagatgccgtgatcatttgctgcgtgggtaaattgagcaatcagagatttgcccctggtaacgtgcgacacacctcatactaggctcgacgaaacaggaataaagccttcggaaaggaacttgtccgtgtgcaaggcttgtaatcttgatagtcaagcgagtgagatgtaggaactgtgtggagagtttctgagcatgtcattgaagtgctacgtgtaccacctttggtagtttgtgtcaaagacgccatgttacactactctttgaagctgcaacccttatcaagtaacagtgctggttgcgtcacttcgtgggcataccggtaaagaaccgtgccatgtggcaggacgaaacttggtggctagtagagatctaggtgttggcaatcaggctctgatcttgggccacggggtcttaaccgagttaaagacgtgattgacctgggcaaacacacaaagggcttggaagaaac

SEQ ID NO: 535700 - DNA, 357 bp, Homo sapiens
tgggcgaatcacctgaggtcaggagtttgagaccatcctggccaacatggtgaaacccatctctactaaaaatacaaaaaatttagccaggtgtggtggtgcctgcctgtggtcccagctactcaggaggctgaggcagaacagcccagaactcctggactcaagcgatcctccagcctcagcctcccgagtagctgggactacagcagcgagattctgtctcaaaaaaaacaaaaacaaaaaattatgttagtaagaatttcatagttgcagctgagagaaagtcatcttaacctaccttaagcaataaaagatgatttatcatagagtctgatgtactaacagaattggagaacc

SEQ ID NO: 535701 - DNA, 368 bp, Homo sapiens
cgttatcttacttttgagacaagttcagtgtaaaccactcctggagtcacaaaagccactcccagatgctgtacttgaagaactacgaataaaacagtcatgtccaacgtcaacgctcctgttccacgcttggccagtggcctggcacatgctgtatcaatcccaaggaatgatgcagcagctgcagagcatgtgttaccagcaacagcagtctacgacatctgggccattccccaaccgcgggccagatctgggacgctgcggcacagctctccacacgtcctcgtccgcagcactcagcccactcacctcttgccattctccacacacacggtcctagctcattgcgccttcacacccattatcca

SEQ ID NO: 535702 - DNA, 786 bp, Homo sapiens
gtgtgccgtggtggtagtcctgccgtcaccggggtgttgcgctgggggcctcccttgtcttcgtccgtggtgtgtgcccttgtgtgctgttggccgttgccgttgtgcctttgggacggccgcgttgacgctttggtttttcccggtgcggggggcttgcgttaagtctgtgtgggatcgtgggggccgtgtcgcgtgcgagatgtctggatgaggcggcggttgtcttcgggtagcagagcctgttgtttgttcctcttgaggcgcccgtcgacgcagaccccctctgcaaccccggcctcacgcatttcccatccttgaagggtccagctcataggccggcccatgtgttccggtttacgcgctgctttgtccctagcctggtaggggagctgtcccttctagggccggtaagtgtaggcacttcacacgacataatgtgtccctgtgcggtcgcgtactctaggagcttaccccgctgtctagctgaggggcaatagatccttactgtgtctagagcatcacatcgccgcgtccgtggagtactgcgggtctcgggctggcacagaagcatgatgacgaaagtgctctccgttacaagtgagctagcgagtgcgtgagatgcggcagagctcttccgtcggaggggcgaacgagctctcaagcccagagggatctgaccaggaaggttcaccccccctccacccaggaagccctgcagacagtatgtgtttataggctttgctggccaaatggtctctgccgcgactactcagctctgccata

SEQ ID NO: 535703 - DNA, 245 bp, Homo sapiens
  misc_feature (64)..(65): n is a, c, g, or t
tgctccgcgcccagaaccagtttcgcgaaaggggggagggctagtggtactgcccccggctcanngtctaccaacctgaaaaatgaaacttgggagcctgtttgaagcaatgaagccataagggcaaggccctgatgcatacaactgggtccttgtgagaataggaagatgccacagtgcgatcacaggagaaggaccatgcgagaatgcagcacgaaggccgccatctgcacgccaaggaaaga

SEQ ID NO: 535704 - DNA, 939 bp, Homo sapiens
ggggatgtgcccccagccctctattctgcttcgggggtcagtgatagtgggctcgggagaaaccaaataatgtggccagggtgtggtcgttacccacaacaaagtgaaaagcccacttgtgtttcatatagaggaatcaggagttgggtggggctttatgtggtgacataagtgttctgtgtcatgacagtacaactaagtgttcctggagtgtaatccatgctagatagttatgctctgtccactaatagagcctcgtgcgaatggaaagatattttcatatttgtctgcattaaaattcataatacgatggtgtgagatgtgtgtgagactgactgacgagtgtgagacgtattctacgtagaacacagtgtagctccactagacaaattctggtggacagagtcggttttcttggaggtctgaacaggttgagtcattaaggcagtagtctgacaagaacagcatggtaacatagttttaagcaaaactgatgacgtcaggaaccttcgaggaggattaggttccccacttaggattgtaaggagtaaaaaggggtgagatatggcctttaagtgccgtctagcaattcacttgggtttgggacatttgctggtgtaatgctagatgcgcacagcgagataatatcgtaccttggtcaacgcgtagcgtaaaactcgctggttatctcaagcaagcccttgccccaagagggtaggtgggcacctggactgacacatcgcgtgatgccctctgtaccgatctcagaggataccgctctgagagaacagtcaagtgcacgcaatgggcgggacgttccactcggaacacgactgagccggactgggtcacggagcaagagaaaagcagcaaagggtgaccacgacagcacaaagggggggaggaaccacatgctggcaacggaaagagagaaacacg

SEQ ID NO: 535705 - DNA, 362 bp, Homo sapiens
ggaatcgcgccctgctcttggttacggatgccccggctccctggagttacaggtgcgaggtaatacttttaagtaacactggccgggcgtggtgctcacgcctgtaatcccaggattttgggaggcccaggcgggcggattacctgataacaggagttcgagaccagcctggccaacatggcgaaaccccgtctctactaaaaatacaaaaattagccgggcgtggtggcgggcgcctctaaccccagctactcgggaggctgaggcagggagaactgcttgaacccgggaggcggaggttgcagtgagcggagatcgcgccactgcactccagcctgggtgacagagcgagactccgtccc

SEQ ID NO: 535706 - DNA, 213 bp, Homo sapiens
ggtacctgaggagtacagagaaacttctcctctgtagtgaacatgcgtggctgtgctgaggctgatggggaaatggggctggcctccccccctgtgctggcacctcccgaggcagggcagcacgcggagccgaggccgcggccgtggtgacagctgcttttaccaaatgaagcatcgaactaaggcgactggggccatttggactgaagcccg

SEQ ID NO: 535707 - DNA, 374 bp, Homo sapiens
  misc_feature (19)..(19): n is a, c, g, or t
ctccagcctggacaaccangggcaaaactctgtctcaaaaacaaaaccaaaaaacaaaaacaaaaaaatagctactataagaattcacctaaaatacagtatcacttgctgcttcctcccgtttatcagctgtacccagggtttattgaagaccagtaaatgaagtggtggatgcaataaaatacagacgcagaaaagggaaacatcgctaatcaaaggcagaaaatcagaactaaccatctttttaagatttaaaatgtttttgttttaattataactaagagttgcattaccaacccattataactgggtaggagtcactttgattatagataataaataaataaacttaatgatagccaaaagggggaggg

SEQ ID NO: 535708 - DNA, 212 bp, Homo sapiens
gtatgtgcctggatcaccgctacgtccaaatccaggtaaggacatgaccaaaccctgacgctacagaccaatatccttgatgaacatagatgctaaaatctttgtaattgacaaaatactagctaactgaatccaacaacatatcaaaaagataaaccaccatgatcaagtgggttttataccagggatgcacggatggtttaacatatgcg

SEQ ID NO: 535709 - DNA, 171 bp, Homo sapiens
tcaacgctttatacttcgaaataaagatatattcgaaacaccagaaatgcttctatacaaacgtaggtgctcaagatttgtggagagaatgtataaatgacagagtaagcattagtctgaatgatcataactttatgctgcgataggcagaaacaaaaataaatctcgaaa

SEQ ID NO: 535710 - DNA, 1317 bp, Homo sapiens
  misc_feature (772)..(772): n is a, c, g, or t
agcgggcagttgccagtcagtccgcccgtcctggagcccggctcgctgtggcagcatggcggggtcgccgctgctcggtgtgcgggcctggtgcgtgcctgggtgtgtgccgtctgggtccttttctgtagcatgctgctgatcggcgtgtttcaggacagccctcctgtgctcttgagccgctggcgttaacggagtgcctgttgcccataagcggcagagtctacaggaccctttgtgtttgaaactgggggccttcctcaggaccgggttaccgagcgcgggggcacgaatgggcgccccgaagagttgatgaggcagcaaccgcggggtgacctgcgcgtgcacatgaaggccctagatgagcctgggggccgcctgggagcggccactactagcggtggtgaagggagcccggagaccgttcacacggaaggccgcagggcaccgtgtagcccttataaggcggcaactaggagagaggtggagggcggtccacagggagggcgccgactaggttacccgttgggtgggccacctgttatggttttgaggcccgcttctttggggggggcgcacacccccgccgggtgagagggcttccttggggataccgcgggggcctatggtgggcgcctttgtcacgataatgagacgtgccccactggagagagcgctccctatggagaggcgggcagggtttctagcctataggcgggccgtaccgattgggaacacctcgggatgggcgccccgcccttattttaggccnccgtagttgcgcgagaagccacaattctgtgctaaggtgcagccacagaccaattttggttgtcgcgccgccagaagaagagaccccaccggcgttgatagagacacaaaggcatctgggggcggcatattttgttcctcacaaatgtgtcaacaagaggggagcaccgcacacgagagaagtagtataaccgccaagataggaaaaaacgggggcgccccccttggagatggtggcgacccacctgggcagcaaaccacaatgaggtaggaagaagggtgcagcaacgcgccgaaaagcaaattggaaagcgacagcaccgctgtagataacgaagcgaatgcgacgatacaacccaccacgcgaaagaggcttcggtgattagcacacactgcgggaggcctatcatcacgcgagagagacagaagacaggccgagaaaatatttgcgctttgaggacaagcgacagtatgcgccgcgccaggaaagacgaatctcacctgaagagggacgagaaaggattagtgttgtgagggcacacccca

SEQ ID NO: 535711 - DNA, 841 bp, Homo sapiens
agcggatcttggcttcccggggaaaggcggcgtgaggggaagaagttgtagggtgggggcaggagtgaggaggagggaagagagagggggaggaggccgcggcgtgggcatgggcggggcactgcctgcctgcctgggttgctgcgaagtgatagtccgccgaccgagcctgctgctttcttgctactgcttcggcttcccggctacccctccggacggtgtagaggcgagccagtctgtggatggtcagatagcccttgtttcccgccgccaatcttctggcccatgagcagctacggtagcagactggctgtgcagcatgcatgcagcaggcgaggaggaagatggcgggacggctgccggcctgtgtggtggactgtggcgcggggtatacaaagactaggcatatgcgtggaaactacagtaaccgcagtttatcatcccttgcctgtattgctagttaaggagtcagacaaaagtgggtgatcaagctcaaaggagggtgatgacaggtgttgatgacctagacttcttcattggtgatgaagcaatagaaaaaccgtacatatgcaagaaagtggccaatccgccatggtatacgttgaagattgcggacttagtggaaaggttcatggagcatgtgatctttaagatatttaaagggcagaacctgaagacccattatttgctttcgactgaagcctcccattgaatactccagaaggaccggggaatatacctgtgaaataatgtttgagtccttcaatgttccaggacttgtagcattgctggtgccagggctggttctttgccttaggctgcatcttgggagcctccagac

SEQ ID NO: 535712 - DNA, 305 bp, Homo sapiens
aagtcgactcttagagttatcccctgtccaaagcgttaccaagttactcaggaggctaaggcaggagaatcgcttgagcccaggaggtagaggttgcagtgagccaagattgttccactgttactccatgtgctgggcaccataatgaaactctgtctcaaaaaaaaaaaaaaaaataaaatatttgtgtattttgtacaccaggtgattattacaaccccataaaaaaaaacaaattcttgttctttggccgcaacatagatggttgtgtatgcaatacccctaaacaattaaccacgggaaca

SEQ ID NO: 535713 - DNA, 306 bp, Homo sapiens
atcactatcaatgaacttatacccgagggagatataggtatgtcttagactccgacgtgtgcatcggaaggagatagagctagaccgacatatggtggctacctgctcatagcttccgggtcagacccaggctagatcgagccatatgaaaacaggatcctcgattctacccgagtgtcactgataaatgaagacaggaccctatcaagtgtgaaatacgggaccgatagggtggcatccgaagtgatcgcagtcaccctgaatgtcctctatgtgcccagatctccccagaatttatcctacatt

SEQ ID NO: 535714 - DNA, 814 bp, Homo sapiens
aataggaaaggagtgcattagagcgactcccaagtatgccttcaggactcagtttactccccgattatgaagatgaggaggaggaggaagaggaggaggaaggagatggggaaaagaaaaaggggggacgccagcaagccgctctccgacgcacagggcaaggagcacttcaggtttccgtcttatcaccggtgaaggtagaccagagatagtgtgcttgctccaaactgatatattcttttagctactaatccctcctcaatggccccctataatgtcctcatttcagggtcaagttgatgaatgcagaaatacattgaaaacagtggtggacaggacgagaaaacatccgcggaagcgttaccggaacggtctctgttggatcgactccctgagtgtagcaatgcaaggacgatacgaacacggattcgactgcctccagagaaacgactcagattggacaacacgaggtgggaccgacacttgccagacaaggtccaatgagggcatggtcgacagctatattccgacaggcccaatacgttgaccgacagagcgagtgagggagcgggaccgggttggaaaccggagcaagccattggggggcagatcggaatgtagcccacgattagcagtgtgttaacccggaacggtgggtgggaaacagagcctaggagtaattcggccccaggcattgaacacattacaaaacaataatcctttaaaagaaaaatcgctgcaccccataaacaagcaacctgccagaacaaagggccgaaccgaggcaatgccggaccggcgaaccatgcaggcg

SEQ ID NO: 535715 - DNA, 422 bp, Homo sapiens
acggcacaatctcagctcactgcaatctctgcctcccaggttcaagcgattctcctgcctcagcctccagagtagctgggattacaggtgcttgccaccacgctaggctaattttgtgtatttgtagtagagttggggtttcaccatgttggccatgctggtctcaaacttctgactccaagtgatcagcccacctgggcctcccttctggaattacaggcgtgagccaccgcgcccggtgaaatatgagcagggatctttacggaactgctgaacggacttgcaattggctagcttgaataatttcagcaggcccttgtgtctagaggctatccctaggtgtctagtgcctggccctagggatgatttaggaaggaggattggcccagagcatgagtgcctggtagaggaggtgacctggc

SEQ ID NO: 535716 - DNA, 202 bp, Homo sapiens
tgtttcacgctagtgccgcgatctgactctgctgcgtgactccaccctagtgctgtgatctgactctgcccgacgtgactccacccctagtgcctgcgatctgactctgccctgcgtgacctccacccctagtgcctgtgatctgactctgcccgacgcgacctccacccctagtgcccgcgatctgactctgccctgcatg

SEQ ID NO: 535717 - DNA, 380 bp, Homo sapiens
  misc_feature (145)..(145): n is a, c, g, or t
agctcccactgggttgcagtcactgccagtcagaaaagaagctttagatgtcaactccctcaaatttggctccaggactgcacaattaacctggtactcacattcagggctttgtcactaagtggaagggcaaaccacatcccangtcccacgttggttcctttattctccgtgctctggaaccaccgtcctcctccctggctcctggaaccaccgtccttcttcctggctctggaaactggctggaaacggcaccttccttcgatctgggctttgggaaccacgctccttgcttcctggttctggcagcctggcctcctttcttcctggctcctggaacctggccttctcctaccttgccggctctggcaaatggccaa

SEQ ID NO: 535718 - DNA, 163 bp, Homo sapiens
gatttaattgttattcctaatgtatctatgaattaatgttttataaggattttctataaccatttataagtattttcaagcctggcttgttgcaaacaatgtataaagcacttaggcaataataattacattcagcaactatcatcatcggtaagctttccag

SEQ ID NO: 535719 - DNA, 868 bp, Homo sapiens
  misc_feature (22)..(22): n is a, c, g, or t
  misc_feature (101)..(101): n is a, c, g, or t
  misc_feature (105)..(105): n is a, c, g, or t
  misc_feature (113)..(113): n is a, c, g, or t
  misc_feature (141)..(141): n is a, c, g, or t
taggcttacccacagggggaanccattttattgggggcttttagtaacaccggtgttttctcctaccttacgtccttctttccttccttccttccttcctncctnccttcctncctgacttccttctttccttccctcctncctcctatttctctctaactccttctgccctctctctttcctatgccttaggtgcatcccacattctgcgtttttttggggaaatcctcgacaggtgcaggaaaattgtgttattgtaacaatttaccgttatctctctttcacggctctccatcagttgtgaacatctattggtttatcccaagtcactaagcatattttcattaggtaaacctgtttttccttctacagctgtttctggagtatagggtcgcatactcataaacccagtgtaactcagaaacgcatctaatattccagtaaacccatcataacgttgaaaaatcgtaaatcaaaccatcataagtcacggtttgtccgtggatatgggcgtcatcaattccattgtattcagtaatgctgtacaccattaacaatggcagactgattgggagtggatattgatagcattataaaagtcagttattagagggatacttctttaacctgactgaagaactgatctaatggctttagtacagtgcatgattatgtgcgatgttttgagacagagtagtacatttgtgaatgaaattttatggcttttttttcacttagtaggaaccattgtgtgtggaaaagtgagaaaatggctttctgctgtagggtctggcattcattgtagatgtaagcttatttttctgtgagcaaatcttattcaataaaatactactctttatactaaaaa

SEQ ID NO: 535720 - DNA, 1219 bp, Homo sapiens
  misc_feature (22)..(22): n is a, c, g, or t
  misc_feature (101)..(101): n is a, c, g, or t
  misc_feature (105)..(105): n is a, c, g, or t
  misc_feature (113)..(113): n is a, c, g, or t
  misc_feature (141)..(141): n is a, c, g, or t
taggcttacccacagggggaanccattttattgggggcttttagtaacaccggtgttttctcctaccttacgtccttctttccttccttccttccttcctncctnccttcctncctgacttccttctttccttccctcctncctcctatttctctctaactccttctgccctctctctttcctatgccttaggtgcatcccacattctgcgtttttttggggaaatcctcgacaggtgcaggaaaattgtgttattgtaacaatttaccgttatctctctttcacggctctccatcagttgtgaacatctattggtttatcccaagtcactaagcatattttcattaggtaaacctgtttttccttctacagctgtttctggagtatagggtcgcatactcataaacccagtgtaactcagaaacgcatctaatattccagtaaacccatcataacgttgaaaaatcgtaaatcaaaccatcataagtcacggtttgtccgtggatatgggcgtcatcaattccattgtattcagtaatgctgtacaccattaacaatggcagactgattgggagtggatattgatagcattataaaagtcagttattagagggatacttctttaacctgactgaagaactgatctaatggctttagtacagtgcatgattatgtgcgatgttttgagacagagtagtacatttgtgaatgaaattttatggcttttttttcacttagtaggaaccattgtgtgtggaaaagtgagaaaatggctttctgctgtagggtctggcattcattgtagatgtaagcttatttttctgtgagcaaatcttattcaataaaatactactctttatactaaaaaacaaaaacagtggtgatgtgtggtcattatcctcagcaaacttatccagggaaagaaaaccaaacgccacaactcacttataatgggagctgaaaaatgagatcccatggacacaggaaggggaacaacacacactggggccttccgggagacagagcgttaagaaaaacagctactgcatgctgggcttaatacctaggtgatgggttgacaggtgcagcaaaccaccatggcacacgtttaccttagtaacaaatctgcacatcctgcacatataccccagaacttaggaacgaaacgaaacaaaagacaacgaaaaagcaacagcaaaacccaaaaggggtaccgagc

SEQ ID NO: 535721 - DNA, 326 bp, Homo sapiens
ccagcaaagaggattctgtgctgtaccatattttaatattcctgttttgaaagaatagcagagagaaaatgggaggcctgctcagagattgcttagcgtggcctcggcgaatgctacaggagattgaactcatacgaaaacgcacagccatcataggttccacagtacattgcagcacatttagcttgctagcctaaaaatctgatcatgctgaggttcttttaaagaaaggtaatcttagaacttcaaactagaaccagtttgaacctcaagttgaccgttgtctgagtagtagaaatctcttcccatttgcaaagatttttcaa

SEQ ID NO: 535722 - DNA, 444 bp, Homo sapiens
  misc_feature (289)..(289): n is a, c, g, or t
  misc_feature (382)..(382): n is a, c, g, or t
  misc_feature (411)..(411): n is a, c, g, or t
ctctgtccctgtgttcctgctagtccttggaagtgtgggagtagctgctgtaacctggagaaggtatgaaccttacccatactttctcccaagacgtgcctctcacctggacttgatgtcatttttagagggaaatagtgtatctgctatggggaagacaaatcatggaaagccatttctctttaaaaaaaacatgctaagtacaagaattctctaagtacctggaaaatttaatacacctgtgacagggctcagggtttgaatgattagaacaggggattagcctgtncagggacctttgtattgccatttggctctatctgacacctggtatcttcattctaaaaggggtcatgcttttgggggtggtattgcggtatgnccatggaagttggtaatgcatgtgttgangcaagggattattccaagctaaacttgttctca

SEQ ID NO: 535723 - DNA, 112 bp, Homo sapiens
cacgagcgctgcggccgaaagtggcggatcagaccctgcacaggccaggcggcccgtcacccagagcacaaatcgtatggccttctatcttgcttgctgttctcccacagga

SEQ ID NO: 535724 - DNA, 220 bp, Homo sapiens
gcagctatacaccacactcatcctggaaatcattatcttaagtgaaacggagccaggcacagaaagacaaatatcacctgttatcactcctaagtgggtgctacaaaatgtgttcacatgtgacatagacagattaatggacatagaatagataactgtagacttcgaaagggtgagggagctgggagtagcggagacatgactgagaaattatttaagt

SEQ ID NO: 535725 - DNA, 1043 bp, Homo sapiens
  misc_feature (381)..(381): n is a, c, g, or t
cgccctcataatcatttgcctttatctgcttcctaagtccgtgtatgccctttctcctgaacactgcacaatcaaaagctaactaatactaacatcctcgagacgctcgaggaaatagaaaccagtcttgaacgtgatcctgcgcactgctcaatcatctctgagtccttgcatcagcgcttcactcgatccgctacgcatccttttgacaataacacgacgaggtgcaatcgatcccttccgcgttacgcatcaatatcgaattggcctacctagatggtacgtggaacctgacgagtgactacctgagctacgggcaggactaaatcttgcaacttcgctacataacttccgcccgattgattgcctgaggcaaccgangtgcggaatcgtggcggacgtcctatggctgtgtgacaagtcggacgtaggtacgtcccggatctcgaaagccccacaatgtgcgtcattacatacattaacgactcacgacagaccgtcttggcacctcccattgagcctgtctccgcacgattcagcgcgttcacacaagactcagatagccaacttcaccagggacggatctagaccgagaaccgacttttgcaaccggctaacgagcggatcgcgaggcgcgttaattagctaagcaggggaccgaatggcctcccttgcaaaatccgtgggttgcggaagccaaaatcacaacagagtttaccattggccctctagtacagttcccatagcaaatttaaatatcgccccgttaaaccaagagtcttctttggaaccctacagggcgcccccagttactcttaacccactaaatgaggcagcccgcgcccgttcatgaatcccccgactgcgtaaggaaaggccccgcgaatccaaaacaccagaatgcaacagcagcaggaataaggcgagaacagacgcgaggatgactcggagacaccggaacacacagcaactggaagacaccggagccgacacgggtggccgagcccacaccgcgaggaatgccctctgaagccgtgatgacc

SEQ ID NO: 535726 - DNA, 117 bp, Homo sapiens
atagaggatctgatcagtgcaattgtgctgggtgcaggaagtgatctccttctgcatctgtcggcatgcaggtacatggtggtgcgcagaagcactgtgttggcgtacaggtctttg

SEQ ID NO: 535727 - DNA, 312 bp, Homo sapiens
  misc_feature (111)..(111): n is a, c, g, or t
cccagtgaacccactggggaaacgggcttttttggaaaactcaaaggggctagccccctgattcaaaaaaaaatttttcaggttggttcattcaaggtaaaattttcattnaaaaccccttagggcaagtttaagctttttaaaagttagttttgagaattgagacccaaaactaaaacggtaggaattggggaggccttgacttaaaactttttttggactgggattccccttgggggggattttggaaagggaaacttgttaaattttttgttaactaaattttttttttaaaaaaaagactttttccca

SEQ ID NO: 535728 - DNA, 441 bp, Homo sapiens
caatgtattagaaaaaaaaagaaaaaaaaaaaagagtttctggatttgggagcatttcagaatgtcagatattgggatgggggatgctcaaagtatatagtttgggagtcctttgggccccacggaatgactccggtaaactcagatgctgtcttaccaaccggtttggcactctccggattttttagtaggctatttaaacgtgtgaattcacttaaaaagcttaaagatttccatgaagaaaatagaattggccttcattattggggtttttttccccatcttttaattccaggcttttagaacagtcaaaagaggtaccagggatctccggttatacctttcatctagagtcactattaaggtcgggccatgttgggttttctctatacacgagtgtctatgggtatgcatctgtatacgtgtacttgtatgtatgtg

SEQ ID NO: 535729 - DNA, 441 bp, Homo sapiens
  misc_feature (49)..(49): n is a, c, g, or t
  misc_feature (79)..(79): n is a, c, g, or t
  misc_feature (83)..(83): n is a, c, g, or t
gcagcatgtagcccagtgtctgagtggttgccgggtctccatggagaancggctcgccagtgtcccaggctgctgagcnctcnccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggctagcggctgcccggtataggacaacggaaccacggttcggtcgctgggaatgccgtttcctagcgatcggccggaccgtactccggtatcgaagctccggacggccttcgtgggccgctgatcactgttggactgtgtgtccctattgctctcg

SEQ ID NO: 535730 - DNA, 169 bp, Homo sapiens
accacggaattgggaccatgtgtcggcgctacacacagatcactcgatgatgccggcgggcaccagctacgatcggatccgacgggtcaaggtgtctgagttggcctgcatcaacacgcgtgcctgacgggcactgtcggcgtcatcaacgccatgggtacccacctct

SEQ ID NO: 535731 - DNA, 584 bp, Homo sapiens
cgaaattgcaccttatacgtccataggaaagattgcacctgtggaacttcaatccatggagctccagagccccaagtctccttaaggcctgatcatgagagcgttgcgtccgagtctcaataccctgtatgctcccttctgcaggcctgttaccgtccggttatatacccgaatagctacagatgcagcaatttgtgggatgagagattatgcctgatagggactcgagcttgcagcgcaggaaccgaagtttatcgaaacactgtgaggatgaagaaatacaggaaatgtaaagtggagtgcagacacgaaagctcgaagttcatgtgtgtggaaacctgactttggcttccaccagaaaagaaggctgttttggttccctgcctcaaggccggccatgtgggagttgtatctgtggagttcattgccctcagtcttggagggagacgtatacttcccattgggggtcttatctcacaaaggccagcaatttgggtctcgggtctggtgcagtatcatagtagatcctttcccctccgaagagagcctgataacattgacaagggcatgatcatgtcagcaaa

SEQ ID NO: 535732 - DNA, 839 bp, Homo sapiens
  misc_feature (711)..(711): n is a, c, g, or t
gggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaaagcattaaataatttatattacattcccaaattattattaaaaatttggagttgcctttggcagtggggagtggtttccctaaaattggcgttattagaatttagggcacagaattggtgtgttaaggtcctggaaatcgggcttaaaatacaggggatgtattgtaatgggaattatgaggcataagtagccagtatctataagttagaatctacaagggcctccttttgggcaccgggtagactagaatatacctggttatggggggccttggagtggtaatctctcagggcgctagagggtggctggtttcaacgcacaattttagactagggttggaaccactcatgggtccacctcattggggggctccatgtaaaatttcactactttcagtccacaaggccactttagggaactctagggaactggcctcgcggctcttcaagacgtaataagcgatggtcctgggggcatactggagggaaacttttttccacacccttcgacttctactggtacctttgtgggtctccttaacgcaccaccggtttggcgccatcccnctagcgtggtctaattttggcccaacgtaattatgggggggggcctctaattccccagacatatttttcctctcgcgcgtggcactcacggctcgtacctcatctaccacaaaccacggtcaagcgga

SEQ ID NO: 535733 - DNA, 127 bp, Homo sapiens
aggcgattactggaatgacgcaggcccgcgcggcaggtctggcctactggcgtgacggcgatcctgtcgaagaggtcgagcagaccggtgccgcgccgtctaacccaaacaagggccgcatctatgt

SEQ ID NO: 535734 - DNA, 381 bp, Homo sapiens
ggaaaggtcatactctgccgttttgtctcttaatgcatttgcctgggaagttgcatctccctggcatctgcattcaattaacactttagtgcaataggtgtggaccatcaggaaatggcgtctccctgaccctaggtgccaatgtatgacttttagagaggcaatgtgataactgctgagccatcacccaacattcctggtgggtgggagaagagccctttcctgccctgctcatgctgtctaatggcctgtgacagcatgactttagtaggctttgggaaatcaagagttttgaagattattggtaaaataaagacatttggttgaaattaggtcagacattaggtttgctaaatgctttaaggtaataaactgcttcta

SEQ ID NO: 535735 - DNA, 298 bp, Homo sapiens
ggtgacggtggcttcttcgtggcttgttttgtgggcatgccgcccatctttatcaccagaatgaggaactcctggaagttaactgcaccatcaggtgttgactatccaacgtctttgagaccagaggtctgctaccgctttttcctgactatactgacgtgacactcgtgtctctagcacgtttcttcaaggtctagtccctgtagacaggcacggaaattccccgtttatcgagggaagtgacttgtgcgtagacagtcagatccataggagttcacaggcattgtctcaagcccac

SEQ ID NO: 535736 - DNA, 184 bp, Homo sapiens
gacagtcgacaccaagacaatcccactatagaaaaaatcaccaagaaaaacacatggacacaagaacatcactaaaagctcaggcatgaggtaagaccaacaatagtggaaaaaaccctatgtccacaagtctgggcaaggtttacaagattttcccacgttagttctcatcaagccttcccta

SEQ ID NO: 535737 - DNA, 428 bp, Homo sapiens
gagggcagccagcatggcacctggatctgatcaagatgaagttttcatccccatctgcctgttaatgtcttctttaccagttgccaccccctaataaggggtatgccgtagactggaagtcactagggacctgcccagcatcctgttctaggcattgactaatccactctcctacatcctgcctcccatccacatggtccaatcagaggctgccatgcttgcacaatgtgacactgtctctatggacacattaattggtcctgatgtagaacttgacccaagatcagggtcaagttgagagaagacttattttctttccaggtgtttcaataacatgtaaaacttggaattcgatagcagccatcttctgccatgagaattgggaagagagaaagcctatagtgataataaagtcaaattatcctaaa

SEQ ID NO: 535738 - DNA, 953 bp, Homo sapiens
agaacaagagaggaaaaaggagaggaatcgatgtatagattatgataggaaaaagaagagacaaagatcatgggaacgtgaactaggataaagaagaaaatgaggaaagaataaaagcggaacgaaaaaggatttctaatgtgcaagtagtctgggcatgatcagattgacataaggaagatcgagtaaaggtagatagaacagtttccatagtgagctaggttctagtatcttgattgacaagagtcgaataaggacgaatgagtgtcgtagaagcaggtataagtatagtaacaagtacctatccatatgatagctagaaagagatattcacggctcttgacttgctagtgttggacaaggagcatgatatcctgagctcatcgcagaggacagttagagcataggacaaacgagtgggtgtagagaatgcgctatatagacatagggtcgagatctggagaaatccggttggatgaaacagtctcatacaggtgtactggggtagacgaaaggcgaacgcacgggaagaatctatcatatgttgctaaagtacacccgtattcaatacggtacgtatgacttgtgttgataaggtaatttcggtcatgatgtgttttaagaatacaagagttgtaactgatatttactgtcaacagattgaagaagtgtcgcttgtactactctctgctttaatataacgtacagattgtggtgagttgtataacataagtccatagtcttcactagtgttgagaaaatccctagtagtaatattgtatattattctcaaggattgtgctacgattgtgagatgtaacatataccatttccattgtatagattcaagtctttgtccctgttagatttcagatcatataatccctctcccggttcgtgctacgctgaggaatgattgtggcacgagtggccatgatggttctttctaacag

SEQ ID NO: 535739 - DNA, 611 bp, Homo sapiens
  misc_feature (490)..(490): n is a, c, g, or t
tcaggttggagggggaatgctggaaattgtaatgggtatggaaacatgtcactataagtaatgctagggtgagctggtaggaagtttttccataggaggtgtataatatggccgtagcggaatcgggggtatgctgtccaagaattcataaaaaccaccgggaggttaaaaacgtagggtcttggtgacccacactactgtcgtgtaagagtccacggggacacagtgcgtcatatgtggtccctaggaagatgtgtactggttgacggcgtgttaactcataaacaatgcgttcagcggagcgaatacccgcgctcattgaaagaactcacggcgcagacagggcgccctcgcaggacgtaatcccagcaagacgtacgagaacacgccctggacgacctaacgtcccagggagccccccgcccttacagcgccacacgggtccagcaacaccgggtgactcgcccgagtaagcgccctcactacggcnacacgtgcggcggcgagcaatcacacctacacacatcatcatggggcccaacgaggcccgcctgacaagggcacagagacgtcacacacaaacaggggtcacccactcgtaagtaatacag

SEQ ID NO: 535740 - DNA, 1087 bp, Homo sapiens
taaaaaaaaaaattaataactcttgtttcggtttagcgcaaaaaaaaaaaaaaaaaaaacaaaaaaaaaaaaaaaaaaaaaaaaaaaaaacgaacagtaagacagaaggacacagagaaatgaaaccacaaacttcgagaaccggaacaagctataacgaacaggagccagcaagtgccacagagagaagacaacgcaccacagcggcaaggcaccaaattatcccgtaagccaagtagcagcccgcccgcctgtgccagggcaacacagcggagagggccgagggcacgcccgacgaggctcccggcaggcgtcgacggtgacgaatcacgcgtcatcgagatgtacctgcgggcgaggacccgcacaggcagagcaggcagacacagaacacaacgggacagcaaagcgtggggcgcgcagcccagggcggggacgcacaccgcgctgacacaacgcagtcgggcgaggcagggcgcgaacgcctcgctgagccgcgcggcgggcactaacacgcgcgggaggacgtgaagcgttggcggagacgggagcggaacaactgaagctggcaccgagcacgcgcatgcacgccggcggcgcacaaggagcagcccggcgcgtgggagtccacacagcagagccacgcaaggatcacgtagttagcgatactaccagtgtcttcgttgcaacggctgcattgtggcggtgcacagccgaaagcatcacaagagtgtacagctcgaagcgaagcggctgacacacacctacaccgaacggccaacgacatagcaatggaccatagccgactagcacaagagcaccagcatgagtgtggacacacgtacaacacttgtatcacgtcatgaacagtcggtgccgggtcacacaattgtacaagcacagtcgcgatacgcgtcgtctcggttgcatagacgacatgagatcacgaggcgctggtccagcacaagcatgcgagcggagccgggtgacgtgcgggagtgtgcagactacgcaggctggcagtaccgctaattgagcgcggcaaaccacgaaagcacacagtacgttgtgcatgatcagctctcag

SEQ ID NO: 535741 - DNA, 308 bp, Homo sapiens
agaatgcgtaacaataataaaaaaaattatttctggtttaaaaaagatctggttccctccagggcgagcaattgcacaaatgtccactgagtctggtccagggatcaaggaagggaaggtcttaaaagataaaagggggggtggaaaacccaatatcagggccccaagttttcgacagcccaaggctactgcattttagaaaacactactcatcctgttggaatcggaggattaaaaaaagtccatgcacgggaggggagccccttggggcaaggtaggaggcgcacccaaggtcctcttgtagcagg

SEQ ID NO: 535742 - DNA, 430 bp, Homo sapiens
tcggcacgagagatatagatagttagagagagatatatagttatagatatcgtctatactgtttttcctgctcatctgtgacttatctctttgttaccaatgtaattcttcatttttctctctttttatttcttccactatattctctgattctctctatattctctcctttttaacccttttcttatggatggctgtccctccccatccatatacttttcctgtgtataccaagcggcctttgctcttctttcttcatcctccccactcttgtttcttcctgccatgtatccctgcatgatacctattcagtgccagttttgcccttacccctatactatacagttttgacctttttctccccttaactaattttttactattcttgcctctatgatcttgcttttttgcttctttcttttctttcctc

SEQ ID NO: 535743 - DNA, 399 bp, Homo sapiens
  misc_feature (304)..(304): n is a, c, g, or t
  misc_feature (320)..(320): n is a, c, g, or t
  misc_feature (325)..(325): n is a, c, g, or t
  misc_feature (352)..(352): n is a, c, g, or t
  misc_feature (354)..(354): n is a, c, g, or t
ttttttaaagtagtaagtttatagaaaatgtttttatttaatggaaggctggggaatgtttagtattaatttctatggtatgtatttccagtggcctttttatttgggtctggaacttttggttcagggcttaggggagaataggttatatggtaatagccatacagttattgcttttaacacagagctatgtgtccccaaacagcaatagtcatgcccttgtccaggctgggatctaattgatacaataggtcgttgactccctcctagtagagctatctaggtttgtctggaaagtttccgnccctggcttataggcnccacncctcatgtactcctcatggcttggatntntgtattcagcctttgttcagtccaataaactttgagtagatgatc

SEQ ID NO: 535744 - DNA, 161 bp, Homo sapiens
gtgcgctgagtggagtgctcctggggcagggacgtgtactcagaccactaggagggcccgtgtgaccacaggtattggcttggcaggtagaaccagcctgctaggcagagggctgtggagctgagccctggtagccaggtactgaggccgagaaagggaga

SEQ ID NO: 535745 - DNA, 412 bp, Homo sapiens
ccaagtagctgggattacagggcccaccaccatgcccagcgaatatttcgtatttttttttttagtagagatggagtttcaccatgtgggccaggctggtctcgaactcctgaccttgtgatttgcccacttcggcctcccaaagtgttgggactacaggtgtgatccatcacacccggccaacttttctttttttttttttttaggagacagggtcttgctctgttttccaggttggtctcaattcctgggcccaagcagttctcccacctgggcctgccaaggtgctagtattataggcgtgagccactgcgcccagccctttatagtttttttcttttttttgagatgaagtttccctctgtcaccattgcactccaacctgggtgacagagagatactccgtttaatt

SEQ ID NO: 535746 - DNA, 306 bp, Homo sapiens
aatgcaactccgactccccggttcaagcgattctcctgtctcagcctcctgtgtagctgggattacaggcacacgccaccatgcccagctaatttttttagtatttttagtagagtcggggtttcactatatgttgcccaggcaggtctcaaactgctgaactcaagtgatcctcctgcctccgactcccaaagtgctgggattaaaggcgcgagccaccatacccagtcttgcaactgctttatacataacccgtgctgccaagttaagacaagtgagatcttcattcccacacaattttgcagc

SEQ ID NO: 535747 - DNA, 378 bp, Homo sapiens
  misc_feature (18)..(20): n is a, c, g, or t
  misc_feature (22)..(22): n is a, c, g, or t
  misc_feature (308)..(308): n is a, c, g, or t
ctcatttgcagcctcagnnngntctccgactcctgggttcaaatgatcctcctgccccagcctcccaaaatgctggaattacaggcatgagtcactgcgtccggctgcttttccatttttcatcgtagctgaaaaaccaggccatacagagataggagccgaggggacacagtgaggagtgaccagaagacaagtgcgagcctcctgttatgcccggacaggcaaccagagggctcctgggtctagcggtgaagccagcgcctgggaagacgcccgttgccaagcggaccatggtctaagcggtactncaagttgcttagaaaaggcaccggttacttagcagaccgggaaagggaatctccctttccttgtggggag

SEQ ID NO: 535748 - DNA, 194 bp, Homo sapiens
agtgactcttttgtctccagtaatgctttctgctttaaagtctatttttattgatgttaacacaaacagtgctagctttttcttggttaaaatttgcctggtacatcctttttatttttattttagatcttcctggaggcggtagtaagcatggcaaggcaagaacaataaataaaagaaataatgattaaaag

SEQ ID NO: 535749 - DNA, 975 bp, Homo sapiens
  misc_feature (446)..(446): n is a, c, g, or t
  misc_feature (449)..(449): n is a, c, g, or t
  misc_feature (462)..(462): n is a, c, g, or t
  misc_feature (465)..(465): n is a, c, g, or t
  misc_feature (472)..(472): n is a, c, g, or t
  misc_feature (476)..(476): n is a, c, g, or t
  misc_feature (478)..(478): n is a, c, g, or t
  misc_feature (482)..(482): n is a, c, g, or t
  misc_feature (484)..(484): n is a, c, g, or t
  misc_feature (487)..(487): n is a, c, g, or t
  misc_feature (506)..(506): n is a, c, g, or t
  misc_feature (518)..(518): n is a, c, g, or t
  misc_feature (520)..(520): n is a, c, g, or t
  misc_feature (536)..(537): n is a, c, g, or t
  misc_feature (545)..(545): n is a, c, g, or t
  misc_feature (549)..(549): n is a, c, g, or t
  misc_feature (553)..(553): n is a, c, g, or t
  misc_feature (569)..(569): n is a, c, g, or t
  misc_feature (603)..(603): n is a, c, g, or t
  misc_feature (622)..(622): n is a, c, g, or t
  misc_feature (636)..(636): n is a, c, g, or t
  misc_feature (641)..(641): n is a, c, g, or t
  misc_feature (708)..(708): n is a, c, g, or t
  misc_feature (752)..(752): n is a, c, g, or t
  misc_feature (756)..(756): n is a, c, g, or t
tcccccaagtcaaagcagggacaaactcggctaccacttcctgatcctcctcttctccaaggtacgaggacattgtcgttgactctgaacatgaacgaggaagaagtggagaagcgctttgagggtcgggctctaccgaagtaacatgtcacggatccctctatgtagggatggtctagccgggtcatgaaacgacagctggtaaaaccgcctaagtagtcacagtgccaggcaacttccaagggcactcaggggcccagtgcattaccttgttccgtactaaggctaagctcaggactgctctacccgttggagcggtggcttcagtctacgttcacaagccacgctgtgggacatccgctttcgatgagatctcctttgtgaacgttgtgctcgtggtacctacttacctacgtcgttcctttgactttgaaattgagaccaancanggcactcagtatnccntcagcancatngngagngnggngtacgggaaactgtttgantttgtcaacgcnanaaagctcaacatcaannaccgaggnttgnaaanagggcatgaacccaanctacgatgaatatgctgactctgatgaggaccancatgatgcctacttggagnggatgaaggagganggcangatccgggaggagaatgccaatgacagcagcgatgactcaggagaagaaaccgatgagtcattcaanccaggtgaagaggaggaagatgtggcagaggagttgacagcaangccnctgccagtcctccagtaatgagggtgacagtgaccgggatgagaagaagcggagacagctcaaaaaggccaagatggccaaggaccgcaagagccgcaagaagcctgctggaggtgaagaacgggcaaagaccaccaatgcctaccaggaggcccagtgtcgtggacacagtgcgtgtggctcaatcgccagcacgagagaagatcagtcaatccggcg

SEQ ID NO: 535750 - DNA, 268 bp, Homo sapiens
agcagctgcagcctggctgttattccaagcgtgtcgtgctgagaagtaaggggagtgtgtgctcatcactgtctgtggtgtggactcaggacgcgccccctggaagcatcgattcggcccgagtcgcttgctgaaggtgtgctctgcggaggggctgcccacccagcctctctatattgaccattttcctgctttatgcaaagtaattggccaagcattgtacaaaagaaggataattaatacactggtttaacccttaaaaaaaaaa

SEQ ID NO: 535751 - DNA, 256 bp, Homo sapiens
tggccggactaagcttagtaggcagaagggggaaaaggtagagcaacttcggtgtaacctgcagaaaggcttcattattttattcaaaatccatctaggtcaggcactgtcatcccagcactttgggaggcttaagcgggcagatcacaaggtcaggagatcgagaccatcctggctaacacggtgaaactccgtctctacttaaaatacgaaaacaaaagattagctgggggtggtggcaaggcctactaagctt

SEQ ID NO: 535752 - DNA, 269 bp, Homo sapiens
ccctgctgcgctgggcctcgggttcgtcatcagcatggtgatgtgcccacgccctctgtgatcctgcccgccgtcgctcggggtcaagctcgagtacgcggtgcgtgttctacctgccgctggcgttgctgcaggtctcattggcggcgcgcttcgccgcaccgtgggcggggccggcctggcgcgcggccggcgcactcggccatgtggtggccttcgtcgtcttcgcgctgtgcctggtgcaggcgcgccggcgctggcagcgcctg

SEQ ID NO: 535753 - DNA, 493 bp, Homo sapiens
  misc_feature (68)..(68): n is a, c, g, or t
  misc_feature (169)..(169): n is a, c, g, or t
  misc_feature (226)..(226): n is a, c, g, or t
  misc_feature (322)..(322): n is a, c, g, or t
  misc_feature (353)..(353): n is a, c, g, or t
  misc_feature (426)..(426): n is a, c, g, or t
  misc_feature (490)..(490): n is a, c, g, or t
agattcggcacgaggggagaaaggacgctaaggagtggggaaatgtttcttggataatgtaactaaangattaaggcgtgtctctacatttgtaaggaaaaaattaataaacgtcttacttgctcattgtcattccagggtgggttttgttgttgttagattgcttttncccatcgacatgtcttggttcctatcttgccagcagttttttggtttgttgtttgtntttgcaggaccgtctcattgcacttgatgctgcagaagagttctttaagcttgctcgtcgaacttaccccaagaagcctggggttccatgcctggnagatggccagaaagaactgcactaccttccngtttccaagtccctaaaggagaggctcaggggcagaatgggaattcttccatgaggactcagcagtcaaccanagttggacaattacatgtagaagagagtgagcaatagagtttgcttagtggaaaatgatactgnatt

SEQ ID NO: 535754 - DNA, 460 bp, Homo sapiens
acatttaaaacgtatcgtcaagaggctgtaatacaaatttcccatctatagagttttttctaaaagctcgaatattatgtattccagccaagaaatcaagagagttctgttgggaactcggacaaaaatttcacacaattttcagtggaagtgtaacaacacgcaaaattaacaagtctctgttgcatcgttgccaggaagaccccagatacaaagcttcttctccacctctgctgaaccccaggagttcaaaaattctagactaagcagtccagcggagaacacagcagcctctcggggagagggaggtgcaaacgtctcagccggttgggcgggaaggggggctggggaacaggcaggggtttcggggcacttacaggtccgtcaacaccataagctccgagtaggcccggtgcagcagaaattcaatgagggtgctcagccggtagcccgggctagc

SEQ ID NO: 535755 - DNA, 226 bp, Homo sapiens
  misc_feature (4)..(5): n is a, c, g, or t
  misc_feature (110)..(111): n is a, c, g, or t
  misc_feature (118)..(119): n is a, c, g, or t
  misc_feature (128)..(129): n is a, c, g, or t
  misc_feature (131)..(131): n is a, c, g, or t
  misc_feature (136)..(136): n is a, c, g, or t
  misc_feature (138)..(138): n is a, c, g, or t
  misc_feature (169)..(169): n is a, c, g, or t
  misc_feature (188)..(188): n is a, c, g, or t
  misc_feature (212)..(213): n is a, c, g, or t
  misc_feature (222)..(222): n is a, c, g, or t
gtgnnctatgctttgagtttgctttctcaacattattgtattttccacttattattactgtataacatatgctagtgtttagttggattaatcttacctaaaagtactgnnaaatgcnntttagtacnntntcatntnttatacatttattttccgaatgtatcattgnataattttattgagttatnaaagtatcttattgctatttaatnnaaaattaanacat

SEQ ID NO: 535756 - DNA, 716 bp, Homo sapiens
  misc_feature (48)..(48): n is a, c, g, or t
  misc_feature (123)..(123): n is a, c, g, or t
  misc_feature (131)..(131): n is a, c, g, or t
  misc_feature (135)..(135): n is a, c, g, or t
  misc_feature (138)..(138): n is a, c, g, or t
  misc_feature (146)..(147): n is a, c, g, or t
  misc_feature (150)..(150): n is a, c, g, or t
  misc_feature (154)..(154): n is a, c, g, or t
  misc_feature (172)..(172): n is a, c, g, or t
  misc_feature (196)..(196): n is a, c, g, or t
  misc_feature (199)..(202): n is a, c, g, or t
  misc_feature (205)..(205): n is a, c, g, or t
  misc_feature (209)..(209): n is a, c, g, or t
  misc_feature (220)..(220): n is a, c, g, or t
  misc_feature (226)..(226): n is a, c, g, or t
gcggatcatggccgcagccgctctggggcagatctgggcacgaaagcntctctctgtcccttggcttctgtgtggtcccagaagatatgcctcctccagtttcaaggctgcagacctgcagcnggaaatgncacngangcctcatnngangccnggcccgggagcccctggngttgggaagacatttaccgaccanatnnnnatngtgnaatggaatganaagggntggggccagccccgaatccagcccttccagaaccctcacgactgcacccagcctcctccagacctccaatactccctgacagctgctagagggcatgaaggacgacacaaaggcaaagacacagacaggtgcgcacatcttacgaccctggctcaacatggaccggaatgctgcgctcagcacaatgcgccatgatgccagccgagtctatcgacaagcctggagctaggctggagtgcatccgacggctcatcgaagtggacaaggactgggatccccgaatgacagcggcaccagacatactatgtgcggccagcgcacatgggaacgagccctcgctggagatgtcacgcagccagggcgcgctccatgacgacaaacactgacccaagagggatgcctacaacacctggaggaatccgagacccgagaaaaccctcactggacacgacaccaaacacaaacataccggagcctggcatgagacaga

SEQ ID NO: 535757 - DNA, 190 bp, Homo sapiens
gcgtccgcatctttatatttttaaaattgtattgctgctcaagaatggtaccctcttgtcaaaaaggcatacattcataagattatttacaatgctgaatgtacaattatgaatgtaaataatcttatgaaaccttttttgattgaagctattcaaaataaaaattttaatgaatgaaataacaaaaaaa

SEQ ID NO: 535758 - DNA, 164 bp, Homo sapiens
tgtggtcgactctagcacggatccccattgcggatagtgtgcagactgtctctggcggatgacaatggtcctctgcatcttcatcttggtcaccacgcccagaggggatccgccctcgaatggacaccttaccagtgaaggggcatttcttgtcaatgtacgtg

SEQ ID NO: 535759 - DNA, 164 bp, Homo sapiens
ccggggggggttttttccccccccccccctgggggggcccaggtaaaagttcccctttggggaccggggggccccccccccccccccttgattttgggggggcccccctttggggtttcccccccccccaggggggggaaaaaaaaacccgggtgttttggcta

SEQ ID NO: 535760 - DNA, 315 bp, Homo sapiens
ctgtgctgcggtgctctgacggtcccgcgctctctcggtgggggtgggctgcggcgtcgttccatggtctgtcagaacttccttctggctgaagatgctcctcacggccactatcaccggccccgggggacacgggtagctgcagccttgccggttcaaattcacccacccatcatcgcggtagtcatgatacggcgggtatgggtatccatcaatcgccatcagggccccaggccagggggcatcaggggcagcaagtaccagcagcagcagctgtccccgatagcagcaagcgtccccacagcagcagcgtcg

SEQ ID NO: 535761 - DNA, 662 bp, Homo sapiens
cttggtttccttgctttcttgacatttgaggtgcacaagatgtggattgtgtgtgttatggtggtgagtcaaagcggagaggagagggtagtaggcgatgtaaaataatccagggcggtggctggggagcttaatacgaatttaggtaaacgaggcataaaaatgggagaaaagaaggagatcgttgacattggttagatgactcaacaggaaataagaaacaaaaatgtgacaatgtgtggtgaagaataaaatgataaaagaaaataaataattatgcattgatggaaaattaatctagaaatagaaaaaaggataaaataagaatatagaagaagaaaagaaaaataaagaaatggaaaaggatgaaacaacgtgacacaagaatgtaatagaacaaaagcaaacatccaaacatgtgactgaacaaaataaatagaacgataatgaatactacaaaatatggaaaaaagtactgtagcattggaatacaggaactaaaaactatcggattaaatatcatggtgttctattggatcatgaaaaaaattaattaatactaaggacacagtacagaacgcaaacaaaagtatataattttatagtgatagttaataacagataatagaccaaaataacaatgaacaggaaggagaaaaata

SEQ ID NO: 535762 - DNA, 750 bp, Homo sapiens
gaccctatggagcttgaactctattaatgcaaacagtacatgctaatacttcaccagtcaaagcgaactactatactcaattgatccattaacttgaccaacggaacaagttaccctagtggataacagcgcaatcctactctagagtccatatcgacaatcgggtttacgatcatcgatgttggagtcaggacatcccgagtggctgcagtccgcatattaaaacggtcacggtgatggtgcaacggatgtaagagtcctaacgttgatctagagttcagactcggagtaatccaggtcgggttctatctacttcaaattcctccctgtcacgaacaggcaaagagaaataaggcctacttctcaaagcgccttcgccccgataaagtgatatcatcgtcatacttagtattatacccacaaccgacccaagaacagggtgtgttaagatggcagagcccggataatcgcataaaacttaaaaactttacagtcagaggttcaattcctcttcttaacaacatacccatgggccaacctcctactcctcattgtacccattctaatcgcaatggcattcctaatgcttaccgaacgaaaaattctaggctatatacaactacgcaaaggacccaacgtagaaggcccctacgggctactacaagaccttcagctgacgccatagaaactcttcaccaaggagccctaaaacccgacagatctaccatcaacctctacatcaactgccga

SEQ ID NO: 535763 - DNA, 326 bp, Homo sapiens
  misc_feature (206)..(206): n is a, c, g, or t
agtatccctttcaaatgcccagaatttgataggaaatgctaacagttttaataaagaaagttgatgccgtctcttgtatatcggtgagctctggatataaagcttcccatccaccctttgcttcctatatcttttacctgtcttatgctatttagcaggctttctggatttactgtcttggaaaggcttcttgtcattgtattcanttccacacttcttacttgtgtctttttttttttgggctcctcacgttttctctcagatttcttcccattctcattttctctggagccccattatagctttttttgcaagacagtttgctc

SEQ ID NO: 535764 - DNA, 848 bp, Homo sapiens
gcagcttctctgcagctcacccaaggctgctctccgccgatgctgctgttcgtaccctcaataaggttgccatgaagcatccgtcagctgtgacagctgtgtaatcgtggatctgcgtgaacctggtcactggattcaaatcgcgcatgcattgtccgacgcatggcccgatcgacgcacgccgtcgccttgaacgacaggcgtcaagcgtatgcagtcaatggcactctgagctgcgccgttcgatgtgccacagcagcaatctgtccgtcacgtctgcagtgtgttcagagacagtgctctggaatgcaacttccataggatgggttggttggtcccaggacccatcacgttggcacctgctgtgcaagaacatgatgccctcgtccgaagacgaacgccgttccgttatgacatcttgcgctgttcagccattggctggcgggaacgatgggtggcttttgagtgataaggcgccggctatcgcgggacctgcatctagtcgagcatcatttgcaggagtaactcacgatgagccacatggatgacgtgggctagtcatcgatcgtgtgctgaggttcatcggatgtgactgctgaggtttccacaaggtgcttgggacaccccgtatttctacatctcctggggcccagagaggggcccaaagaccaccaaatccctccagcaggtacatcccgcgttcactcttataaaccagaagtggtactatgggaggcatgagcgaggtccgggccaggggctggtgagttgctccgtggcgctggtttgagagacccatgaatggaatgagctgttaacccagatagtctctggtggtgctggaagag

SEQ ID NO: 535765 - DNA, 222 bp, Homo sapiens
ggttatctaggggatcaaagcaatgagtctacttctggtgcagaagtaaatttataatgtgccttaaaactgtaatgattggtgattttctttggcttctgtattctacttcataaatactaccaaacggagcacctatcataggtcaggttagccaagacttaggtgatgcccagacattagagtagagtagtatattgcaagaggctgggcgtgcagggg

SEQ ID NO: 535766 - DNA, 219 bp, Homo sapiens
ctgtatgttgcgtgcgttgtactcgtgctgttgtgtgtatgagacactttggagactccaggagaagtcccaggcctgagctgcgagtgccaggtcacgcccttgactgcttcgcacttgctcacctgagatgatgcagcttggaggttgctgatctagtgcgaattgcttgtcgggctagtcggggggcgtacggcagctcgaattctgtaagtcatg

SEQ ID NO: 535767 - DNA, 730 bp, Homo sapiens
ggacaggttggtctgaacaagcagtactcggtcttggtttgagaaaaacaaaaagagccctctctggtgttgtcacttcaaggagagaagtggagaccaacgcccactcacttatgtggctgagactgtctcgcccgccctctggtttgaaacaagacatactctcgtggagagacaacgcaatctggtgtgacagaggagaaaacaaatgcttgatatatattccctcgggtgtaatatagcgagctgtgtgcgtgagctagttatgtgttggaactcacgcggttgcatgagcgatttcacgcgccgctcacagttgaaaagtgcgcccgcgctggaggttgtattcggaagaatatgttaaagaagttctccacagataagttttggctgaggagcgccctgcactaattgctcttccattgcggaggaacactagggcgtggggacaatttctcactgcaagggggggacagcgaagaatggtgtgtgtgtctccccgacagccctcaatatggtatacaagagtgccaaaatgtgcgggtcatatgggtgatgttttacatcgatgcagataggcattgacaaatctgctgttcatgataatcttacgtgtcatgtgaaaagcgatcgctcctcctcccagagagggtcacttctcttctggggagatgttctggaaaccggtgccctcttctgtggttaaaaacgccacaataaatagacagac

SEQ ID NO: 535768 - DNA, 230 bp, Homo sapiens
ttcatgaggatccccgtatcatccctttcccccaagagcgctcattttagctacaatacataattccccttcctttgcctgagggagaaaggaaaggaaacattacctaggttcattcccagtgtttcccttgagtaatgctagaatttactttatgtcataatgcaaaattgaaaaatacacataataccaacgaacgcgatgcgtttgggacggatgctacgttgaca

SEQ ID NO: 535769 - DNA, 436 bp, Homo sapiens
  misc_feature (38)..(38): n is a, c, g, or t
  misc_feature (44)..(44): n is a, c, g, or t
  misc_feature (369)..(369): n is a, c, g, or t
  misc_feature (412)..(412): n is a, c, g, or t
tttcttgatctgctagggctaagttattttggcttggncttggngaggaagctgtagagagaaggtatcagagctaacagcagtaatttaacagtttcccatttcatgtgttgtgacatccatttgcagagttacacccaaaacttgttggaaaagatttccctcctcccatcgtgataacgtaaattgatggaagttgtatttctctgggaggtggcagatctatggaagggtgacttgatctgttgctctagccatgagtcaggaaactccaccaccagcagatgagagatgctctgctctccacacttagtctaactttgggtttccccatgcttctgtgctactttcaagccatgatctttgggngatatttgataactctgtccatttcccttagaattccaaaggntattctcttaaaggtagaccacat

SEQ ID NO: 535770 - DNA, 119 bp, Homo sapiens
ctgattgtgctcagagagcaagtaagacccgaacagagagtactagacagtaaagagaaccgttatgtagaaatagtggaagattataggtagagctagcaactactgagctgtgatag

SEQ ID NO: 535771 - DNA, 171 bp, Homo sapiens
gctacagctgtggcttccttgctacacgacagactctgttggctcccggtgctagcctgagcccaggagtgggtagggtggggcatagctatgggccccacacacagcctgaaaccctcgaaggaacagcagataataggacactgcagagactgaagcgatacctaccca

SEQ ID NO: 535772 - DNA, 1494 bp, Homo sapiens
  misc_feature (462)..(462): n is a, c, g, or t
  misc_feature (1493)..(1494): n is a, c, g, or t
ccaacctcctactcctcattgtacccattctaatcgcaatggcattcctaatgcttaccgaatcgagaaattctaggctactagtacaacatactgcaaaggccccctaatcgcttgtagagtccccttacggggctacatactaagcccttctgctgacgacctataaaagtcttcagccagaagagccccataatacacccgcgcactatctgccagtcagcctcttaccatcagcggcccgaccttagctctcaccaatcgctcttagtactatggaaccccgcacttccgcacatacctcaaaatcgcgcgcgtgggtggatgtctcaacacgtgagtggtctgacgtattatatatcttagccgaccttcgtagccttgagcctgtgttactcaaataccatcttggatcgatggcgtgaagcatcgaagacatcattagatacagcctcgtgctcngagtgcattggcacaagcaagtatcccactacaatctcggtagtgaaccgtccaatccttagcgcatgtcagttccttattgatcgaatcagttactgcattgagaagtcgggtcgactaaaagagcgcgtgtctcccaaccgtttaacttgacaaattacagatgaacctatcgtgctgggagttgacttctctggacgattcatgtagcccctatgtgcccgatagagttctgacatgtctattccttcccatgcgaccgtgagacccttcagtagacctagagcgaaaaaaacgcccgtgtccaatgcctagggccgggataacgaggggagtctcctcgcccaaagtaactgctgccagggctttacattctcatgcggaaaatagccgcacggcagcgatatgccgtatcgagaccggaattatcctctcgataagccgggaagtaccaccggtcaacctttagcgtcggtacttatagtgggaccctgatatcccatctaaaaatttttgtgcgtatgagaaccagcggagtttgttgagggcacaactaccccccgtgagagaactataacacacaggtcttttggcttcgctaaaaacacgagttatgtaacacaaccagggggctcaatgaaacataggaagaggaaaaaccccccgaaaaagcgagagcacaccaaaatttaccacccctttggagactaaactcccgcacgcacccacagcagaatataataataaaagagtctagcgcgataagttgagataagtgccgacattatacaagaagcactcgcatggacaacaaaatcagcgggggcgtgaatacctgggacaataatgacgatgttagagaggacgtcgatgtagtaacaaggagagcctcatgtcagatgcgcgtgctactcggcttagtcagcagagaactcgctgatcctcactacctgctcgataatagatgctaaaatcaagccacgacaacgcatgtagactaggtcgtcacactacatgcagatgtaagcagnn

SEQ ID NO: 535773 - DNA, 236 bp, Homo sapiens
tcgaagatggcggttggccaggtccgtgtccgtaacccatcaccaggaagatgttctccaggtggttccccacaaccacctccttcaggctccacgatgttcggatgacgcaggggagcagcagcgtgatctcccgcaagctgctgatggggatgccatccttctccttgtccatccgcaccttcttcagggcgacaatctcatcggtctgggtgtcccgggcccgatacacaagg

SEQ ID NO: 535774 - DNA, 969 bp, Homo sapiens
aagcggctgtgcagacattcaatgttattattatgtcttacaagcataacaaaaaaaaaaaaaaaaaaaaaaaaaaaaactcaaacagacaaaaacaatcagccaactaatataatgcactaatcacaagcagcatgagaacagaaaccacaaacaagaaacatcacagatagatgttagggcggggcgggcacagacacaaaactaattaaaaaataaaggaggcgcggggtggtgcccacacgaagaatctgatgagagtccacaacacaaggtggtggtagactgagcaagaaaaacgaaaaatagcacggcccgacacggaatcgagggctggctcttctagcacaccagagaacggagaggaggcaacgagacacagctgcggaggggtccactcaacacaaaaggaaataaaaagcaaggaacagacatagctataagtaacaactaacacccaagcacaacgggtgatgaagaagcaacaaacgagacaatacaaaagaccaaagaacccaagctagcctaacaacaaaacaaaatcaagtacaacaaggtaccgacaacaacatagcatacacaacgatgactacatagcagacaaaagaaatcgaccgaagagacaacaaccaaacagaaaaagcaacaaaacaccaactaactagctatttgaaacaaacaaaaatcaagaagaaaaaagaacaaaaacaactacaacaaataatacacacatacaacctctcactcacacttccatcatatatacaatctgatacataccacattagacacaggtaaaaataaaaatacacaaaaaagaataaagaaatctactacataaactcctactagaaaaacataacacacagcaaacacagacaaactaaaaatattcaaaaactacacacacaaaacaatcaaacatcaataagctacataacacaaacaaataacaacaaataaacaaaa

SEQ ID NO: 535775 - DNA, 278 bp, Homo sapiens
cgctcgacggtacgataagcttgattaaccatgccctgtagtctccacacaacacacttccctgccagctccacaacttcgggccacagtgagaaatcaacaatatacaaaagcagcccagatgcaagtggaacaacaccctcatctgcccactccacaacctcaggtcgtggagaatctgcaacctcacgcatcagtccaggctcaactgaaataacaacgttacctggcagtaccacaacaccaggcctcagtgaggtatctaaccaccttctaca

SEQ ID NO: 535776 - DNA, 917 bp, Homo sapiens
aattcgatgcaggggctgcgtttcgattggctatttgctggtgccctgttggccgtccgatattaccaactccagctccactgtatcatgcctcatgtgaacacagagatactgagcaactgaagggagcagataaggtggccgagctggtgcacatcctcaagcatcgtgacagagcaaaaggactggtccctcaggaactgtctggtgtactgtaatagcatccagcactgagaactgggctgagatatagtactggatgaccacaaaatccaacacactaaggttgcaggggcaaaagccagccttgaatgagggtaggaatcttccagatccttccagaagagcacacgagacatacttctctgacacagaacagtaagcacatcatcagagggcctggacaagaacatagagtagataggaagcataggattgacaactaatgaatatatacccacaccaaaagctagcacagaacttacatacaacaagacgacacgaggaagaagtagaggaccagaagtagagcaggaaagcagaggatagccaagagcaaccagtccaaacaaagtaagagtagaaccacagtcccatgagaatgtagagaacctggaatcagaaagattgagctggccgagatccggccgaaaagaagaagcagtcataccaagggacatagcgaatccaacgagatagaaaagcagaccttgtggcccgacaaagacaaccctgaatcataggacacagatactagcattacaaaactgtggaatgcaaaagaagcaggcggaatcctaaaccagaaaatcattgaagctagggctgacacaccacaaggatcacaagaggaagaacaccggactgaccctgaacgagctcaatcgaaggcgcgaatgacaagatatggaaataga

SEQ ID NO: 535777 - DNA, 141 bp, Homo sapiens
caaagaatactccactcatcacttcgggctctaagttttacaagttgatagttatttgtgtcatctctgatgtctaggaatgtaaaagtgattctcaactcagatgtgtaataaaaatcaatcagatttgttctaccgaca

SEQ ID NO: 535778 - DNA, 267 bp, Homo sapiens
attcggacagattcaaaggcaattccgcagtcatggatggactacagaacatccggagtcctgccagttgggcatgtgcaggtggcacaggtccagccagggagccacagccgaagtgatttcctattgttcactgtgaagataaggtcaaaggttgtgggtagccagtaagggcttagtggtcgttatctggataggggccccaaggtggccagtgagggccgcccccccacggcctccagcaggagtgcatccttctcttgctta

SEQ ID NO: 535779 - DNA, 294 bp, Homo sapiens
ccccttatgcgccgacccaccactgagtattaactgctcggcaggaattatctgataccattcatttagccttctgagctttctgggcaggcttggtgaccttgccagctccagcagccttcttgtccactgctttgatgacacccaccgcaactgtctgtctcatatcacgaacagcaaagcgacccaaaggtggatagactgagaagctctcaacacacatgggcttgccaggaaccatatcaacagtggcagcatcaccaggtgggtcagaacataaggggtaccgagctc

SEQ ID NO: 535780 - DNA, 373 bp, Homo sapiens
cccgctcgtccagtatcaacagagtaacagttgtcttaagaagaaccttcctgttaatgtacgtaggctactttgtggctgccttggttgctgctgcacattaggttgcagtatgtgtgccagttatgtgcctcagataaaagaacacgaagatcgattgagaagttattagaatgggaaaacaataggttataccacaagctgtgctggcatgggagactgagcaaaaggaaatgtgaaacgagataacatgatggaatatgtcatcctcatagaatctttaccaaagacagccgatttttcgaccagattagcatttactttatcgtatagagacttttcacgtactgtggtctttccaatggtgccttgc

SEQ ID NO: 535781 - DNA, 238 bp, Homo sapiens
ggatacaggcactgccacatgcccagctaattttgtgtttttagtagagatggggtttcatcatgttggccaggctggtctcgaactcctgacctcaggtgatccacccgccttggctcccaaattgctgggattacaggtgtgagccaccatgcctggccactaccctgtcttgtggctgggtatgactccactaccctgctgcctctctccccgtacagcagcataatttaggaat

SEQ ID NO: 535782 - DNA, 913 bp, Homo sapiens
acattaagagggatgcaaagttactgtctatttaaaactgcaagtcagttaactctcttaattcccttattacctaaacttgtctggctcccaggaacagccttatagagagagggagtatgtatgtgggcaagaaaatgttcacctggaactattgtattgataagtaaatttaggatctacgatacagcttgttttccttatgggcattcgtttgggtgctcaagtcgatcgataaaactaggttattgctatggctatccgtggattcagacgcttaggttctgaaaagatttattcttttatgtaaagtgttgaatattggataatagtccatcttcaccttgaatgggtctctgtcatatctcacatttagtcttcaaggaaaaaccatttgctaccaaagtaaatcagtatttcgaatgtgcttctctgtgttgtgggtacacttagctagtacctgtcaaggcttttccagccagaatttggaggcaaactcagctaaggaagctgttcttttaaaacaaaaacctatcacaaaaatttataatggtccattatgggcttaaggtattgaggccgcccacatctttcacaaaggtataaccctcataaacaagaagtttaccatcgtcttgatgatggaccattatgaccgatgctctttcctgtacctgggccagagaataaaaactcaggaaatttctgagactccaacttggaattgcacttactattggctttgtaacgctcacatatatggctaatcttcaacggtactttggccacggtcttgacaaccatttagtctgcttcgaggacacgaaaggcttcacctttttggactcaccacctgcttgccacatgctatgacgcgcaggcgactgtcacgataacacactggcgacattcc

SEQ ID NO: 535783 - DNA, 234 bp, Homo sapiens
taacaatacctgctagaacctaccagtatgacagaacagacccaaaccactgtacccatatcgaacaataggtagtgtaacaaccataagatgttcctgggaaatcgtcaaccctctgctgcagtagaaacctgatgtataagatatgaagcgataaatccaaatggaaacccatgagtgaggacgcaattaaatctgtgtgtgctcctggagctacaacatcccttcctccct

SEQ ID NO: 535784 - DNA, 205 bp, Homo sapiens
cgctcaaacagtagcttgctttgtatgatttaaatgaaacattgagatggttcagttatgcagcttgaagactacaaatgattttgaggcttttctctagtaaaaagagttctatttgggaacaaagtgatttcatctttgctcagatcaaaactatctcatgaatctttgtggtttagataaatgtgccctcatttactcctaa

SEQ ID NO: 535785 - DNA, 302 bp, Homo sapiens
acacttaatcctggtcaacacagttacaccctttttcaaaaacaaccaaaataaaaccaccccttgggcgtgttttcactaagaggggatgacatcctcctgtcttaactatttccagctcttggcaaaatattaactctgtactctgatagtacagtaagtgatagttaataattaaggtcctatacactgaaacgatagtgaaaggttacttatcagtcctgttattgagactggtcactgtctgattcttctccaggagctttgactattatctcttcaggctttttcatcatctgtaa

SEQ ID NO: 535786 - DNA, 460 bp, Homo sapiens
ggacatggtggcgcatgtctgtaatccagcttactgtaatctcagctactcgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccgggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaaggaaa

SEQ ID NO: 535787 - DNA, 123 bp, Homo sapiens
acccggcgccctttttttgtaaatagagggaggagacatgagacgactggacgttgcgaacgcctggtgcatggcgcttagtgggaaggctctgtgccactgcaggcccctgacacccctggc

SEQ ID NO: 535788 - DNA, 190 bp, Homo sapiens
attctgccaacaacctgaaagagcttggaagtagattcttccccagaggctccagatgagaacgcagcccagctgacatcttgatttttgcattgtgagatcctaagaagagaaccaagccatgtggcccctggacttctgccctacagaactatgagctattaaatggctgttattttaagctgttaaa

SEQ ID NO: 535789 - DNA, 369 bp, Homo sapiens
ggtcgactaaatattttataaactcatggtggcacgggcaacatcattgcagtcaagaacaaattcatatctagaatccattcctccagtgaggacacgcagtgccccttcatgatggaaagggttcagtgtggtcagcctgctggcaggtggctgagcccctggaagtggagccatgctgggggctcagtgtccatctctgctgctggaaggttcagcattcagtggtggcagccttggggggaggaagatctaatctatgttgtagagcccatgcaaagcccccatctctgctgctgctcattgataaagcatgaaggtggctggaaagcatgactgccatccacagtgcatggtttcaacctcctg

SEQ ID NO: 535790 - DNA, 185 bp, Homo sapiens
ggggggggggggggccccccccccccccccccccattttttttttcccccttttttttgggggggcgggggtttttttaaaaaaggggggcccccggggctgggggggggcccccccccttggggttttcccccccccccccccccccttttttttttttttaaacgggttttttttttttggga

SEQ ID NO: 535791 - DNA, 102 bp, Homo sapiens
tgtgcactgtcgccctcctcatcagcactgcatctgccaatgtggaggcgtgagcacatctatgactgaactccatcagcgagtcccgcatgagcgttgccc

SEQ ID NO: 535792 - DNA, 392 bp, Homo sapiens
ccatggcagacagaccagaaagtctggcacctgctgactccggccctccctgtcacttcgtcacacagcaaactcttaaaactttggtttagctcaacgaccattgaggtccatgttcactgttcctgctccagggaggatggtagcaaagttgacagccgaatcccttcctatatacgcacctccacgtatcctggatgactataggggcgaggggctacactgagaatgagcagtgatgcactctaggtcattgtggccaggcacggagctcttgagacgcatgctcccacggacagagggactctctatctggcatgttggcctgcacactaaataatgactaatgccaggacaagccccgtaaccctggggtgggtatggatggcctg

SEQ ID NO: 535793 - DNA, 253 bp, Homo sapiens
gcgtcgaactaaccggaaggttgtgagttcaaacccctgagctgacaaggtacaaatctgtcgttctgcccctgaacaggcagttaacccactgttcccaggccgtcattgaaaataagaatttgttcctaactgacttgcctggttaaataaaggtacaaataaataaatacacacatctcttagttgtccccttttctgaatccatgcccattcctcaccctgtcactggctgcaaatgccaagtcgacgc

SEQ ID NO: 535794 - DNA, 824 bp, Homo sapiens
  misc_feature (70)..(71): n is a, c, g, or t
gataagacctatataagaaaggcttttgtgacttatatccttataaagtatattttctccaagacgatgnnacattaatttcttccacactccgcgccttttataactaccacatagatttcgcccgataataagggaaaatattaccccatttgcacaacacatgtggagccctcgcttagcccgcttcacttttaatagggtagccgcgcccgcttcatttttccacagggcgccgccgcctctgcctatatacaccgggggccccactcctcccctcccccacttgggagaacacccttttctaccaagaaaattgggaaatttctccaccggacaaccccactggttttgggccccacatccatattttcatataacaatttataatcgtcttaacccaccagtacccctctctacagtaccactatcgtatcattaccactactcatactgtctaacccacaggaaatacctgtcaaattctaccccaagatcacgcttttttagtatagcaccacgaccccccctcgtcttcttatccacagtcgtggtaacccacgattgtcccaggtcattagagaacacttcttcgccccacatgtcaaacacgatatcccggcgactaccccaatcttgtcgtgaattgtctcagtgcttgttaatttctagcttacttagcactgggcaccggcaggtgcacacacccttgtatcccaccccccttggggcagcaaacagtagggtgacttcacaccaaagtccaggcgaacagtgacccctccttctttaaggtgcggaaacccccttttctcctcataaca

SEQ ID NO: 535795 - DNA, 692 bp, Homo sapiens
ggtcaaggtcccatacaggcctctgcctcggccgcgggcccttcagttcaccgtcgtctcgtctccctgtactgtccgcaggcctgggcagacatggccgttattccggtcgggtctcctggtgctgacgacgccgttggcctcgcctagcctcgctctccgtggcctgccatcctggagcctcgggcggcgccggatgtgtgtagatcacacatctctagtaggttcacctgacaggcctgggacatgagacctggcagggcgcgcggactcagtcgccgcagatactagaacgccggtgacgaggctcacgatgttgaggcttcttgattttcagtcacggacactctctatggctggcgctcgatcgtcctatcaggtggacttgagaacggtcagaagtcctacgtgagccaaatagtccgaaaccaagtaggcacctgtatctcgcctcccctgctccgcgctcgagtctcatgaaatcgtcgtctccatctccgtgcagaaatgtcgatgcttgaccaggcattccacaggaagcacccctgcggcatttggaacgcccagttcaccagacacgcggttcacagtcgagcagtctagtgcgtaactccaccaggtgttgcaggctttggtccgcactggactcggggtgctatgctcgtttgggtaggcgatgtgccgtgggagcc

SEQ ID NO: 535796 - DNA, 783 bp, Homo sapiens
  misc_feature (5)..(5): n is a, c, g, or t
  misc_feature (68)..(68): n is a, c, g, or t
  misc_feature (79)..(79): n is a, c, g, or t
  misc_feature (102)..(102): n is a, c, g, or t
  misc_feature (105)..(105): n is a, c, g, or t
  misc_feature (107)..(108): n is a, c, g, or t
  misc_feature (111)..(111): n is a, c, g, or t
  misc_feature (140)..(140): n is a, c, g, or t
  misc_feature (149)..(149): n is a, c, g, or t
  misc_feature (190)..(190): n is a, c, g, or t
  misc_feature (193)..(193): n is a, c, g, or t
  misc_feature (195)..(195): n is a, c, g, or t
  misc_feature (225)..(225): n is a, c, g, or t
  misc_feature (234)..(235): n is a, c, g, or t
  misc_feature (258)..(258): n is a, c, g, or t
  misc_feature (418)..(418): n is a, c, g, or t
  misc_feature (474)..(474): n is a, c, g, or t
  misc_feature (481)..(481): n is a, c, g, or t
  misc_feature (484)..(484): n is a, c, g, or t
  misc_feature (499)..(499): n is a, c, g, or t
  misc_feature (536)..(536): n is a, c, g, or t
  misc_feature (584)..(584): n is a, c, g, or t
  misc_feature (588)..(588): n is a, c, g, or t
  misc_feature (607)..(607): n is a, c, g, or t
  misc_feature (625)..(625): n is a, c, g, or t
  misc_feature (633)..(633): n is a, c, g, or t
  misc_feature (639)..(639): n is a, c, g, or t
  misc_feature (668)..(668): n is a, c, g, or t
  misc_feature (742)..(742): n is a, c, g, or t
gatgntatacacaaaggctgttcactcatttccataatttcttgatggacattgtttttctcattgtncttctgcatgnttttggctactgccatctcaaantcntnntgngtgacatggactcgccgttctcggagggnataaatgcnagcatctgtgcacacgcccttcacttcagcccctgatgctnctntnatgagctcagcaatttttctcaggttgatnccccgggtnnggttcatcttccgagaatgaatnttcaaaatgtccagccgggcctcctcattggggggtgggaattcaatttttctgtcaatgcgccctgggcgaagagtgccgagtccaggatatcaatcctattagtagccatgataaccttgatgttcttggtggcctcaaagccgttaagctggttgancaactccagcatcgtgcgcggcacttcactgttccctccagaacccccctccagcngcgaggngcngatggagtggatttngtccatgaggatgatagatggagcatgtgcccgtgcnatgagaaacagctccctcaccatttttgccccttcccctatgaatttntgtnccaattcagagccagaganacgaataaaggtacagtncgtatgangagccncagcccgggccaacagtgtcttcccagtncctggaggtccatacagcagcactcccttgggctgagcaatgcccagtgcttcgaagagctcaggatgcttaanaggcagctcgatcacttctttgatctccttgatctgtttgt

SEQ ID NO: 535797 - DNA, 139 bp, Homo sapiens
tcgaggagagcgggccagtgtcttcaacacggacacgctctgttgacaccagagctgggccagggaggacagctccactgaccacccagagctgggccagggactcaacaatggggacagaagtcccccaagctgcctg

SEQ ID NO: 535798 - DNA, 412 bp, Homo sapiens
  misc_feature (2)..(2): n is a, c, g, or t
  misc_feature (6)..(6): n is a, c, g, or t
  misc_feature (13)..(13): n is a, c, g, or t
  misc_feature (196)..(196): n is a, c, g, or t
  misc_feature (215)..(215): n is a, c, g, or t
  misc_feature (266)..(266): n is a, c, g, or t
  misc_feature (320)..(320): n is a, c, g, or t
  misc_feature (323)..(323): n is a, c, g, or t
  misc_feature (351)..(351): n is a, c, g, or t
  misc_feature (396)..(396): n is a, c, g, or t
  misc_feature (405)..(405): n is a, c, g, or t
tncctngtgccanctgaatgagatatctttaagagatacgggtatcatcatggacactgtatgcggatgagtgatcccagcagttccctgggcacgctctacatggccggtgcactgttgactgtccaccatcatttctgcctgcagcttactaaaacgggagttaggcacgtgcccccttggtgctatatttcgnctgaaggactagttcctgnaggttccgggtgctactctcatctctccccagggtgggttcttaatccttnggggggaaaattgtttcccgggtgggggacggacactggaagttggggtccagnccnccaccagggttgtgggtgcgtcccctgntcttgtcctttcttaaagttaagtaaacttgggggctgggtaagnctggggtgnaattgtg

SEQ ID NO: 535799 - DNA, 136 bp, Homo sapiens
  misc_feature (125)..(125): n is a, c, g, or t
agtgggcatcataatatgtaccgcaatgtaattacaatgttttagcaactttgtacttgttattttcacagcttgtcaggcaagacctcagaataaaagtgtcatgcgacacaaggtcgacgcgnccgcgaattta

SEQ ID NO: 535800 - DNA, 385 bp, Homo sapiens
gcttgatacagcttagacacacacacatattatacacacacacacacacacacacacacaaacacagttatcaccaggcaatacttaccccttagcgacaatgccctctgacattttcttttctattatatcctatttcatttttataaaaacccacccgattggttatataatcctattaatgggctacaaacctacagtataaaaaatactaacatacacataatcgtttgagcctgatgtctctttctggttaagcacactatttccaaacttaactaagtgtttatggatccaaattcggctaattgatacttaggttcttccacccctgtaacaatccctgcagaatttgtttttcttttccaaagtctaaatgcactca

SEQ ID NO: 535801 - DNA, 241 bp, Homo sapiens
tcattgggctctaagggcggcttctgggggtcgtaactctgcacccgatccatctgacccatgcacaccttggccgcatctatgtcggtgtggaccacaagctcttactgtacaatgcagtactactggacagtggttttcaccaggactggtgaggcgggatcggccagaactgctctcgccaggtgatgaagtcctcctgcaagttcctatcgtctgcgcccaaccccgaacacggttt

SEQ ID NO: 535802 - DNA, 308 bp, Homo sapiens
gcttacagcaatgaagaaactgcaataaaagtatattcaatacttcagcactctttttagtttgtagctacttatattgtgccaaatgtagacagaccaaatgaaggaataagaaaaaattcacttcagtcaacacaacaaatatattcaacagtatgaattccaatgaataatgaactatggcaggttagataatagtgctatatattgtgaaggctaattgcttgtgttgtttcagccttttttaccctacgcagagaaagttgtctactactctggcacctattccactctttcttcttcttttc

SEQ ID NO: 535803 - DNA, 1321 bp, Homo sapiens
  misc_feature (271)..(271): n is a, c, g, or t
  misc_feature (273)..(273): n is a, c, g, or t
  misc_feature (282)..(282): n is a, c, g, or t
  misc_feature (652)..(652): n is a, c, g, or t
  misc_feature (702)..(702): n is a, c, g, or t
  misc_feature (727)..(727): n is a, c, g, or t
  misc_feature (747)..(747): n is a, c, g, or t
  misc_feature (754)..(754): n is a, c, g, or t
  misc_feature (759)..(759): n is a, c, g, or t
  misc_feature (761)..(761): n is a, c, g, or t
  misc_feature (788)..(788): n is a, c, g, or t
  misc_feature (801)..(801): n is a, c, g, or t
gggagtccggggacccgcgatcagccccggaggacggggtggggtcgccccaaacaggagcgccgggaccgctgggaccccgcactcggctgtcctgcctgccgcctgtggtagcctgggcagtgtgatggtccctggatgatggctgacaatttttcctggccccccctcccagtccctgccccacttcctggggccgccactttcactttctcttcctgcctgaagcctgatccccttgcgaagaactgtgggcctcccgggaggaganangggctttgnctttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgctggacctgtctcggcgcccgctgccctctcaccgccccacgcaggatcccggcctggtcaccgggcagtgtgatgcttccctgactgccgctggggacagcgaggcacacacagggcttgggcctgctgccggaggccacacggcctggctgagttgctcctggtctcccgcctctcccaggcgacccggaggtagcatttcccaggaggcacggtcccccccaggggngatgggcacagccacgccagatggacgagaagaccaagaaagcagagganatggcctgagcctcacccgagcagntggcgggcggggatgaacanggtggcnaatgnangtgtgccatctggctggcagagcaacngggtgcccctgangtgtgcaatgttgaagcctgatggtctccccaagcgctagggaacaattcagattcctcatggttgcaaaaattggggcatttccagctccattccagccatcaacatcacacggacggacatgggaagaaagacgacccctccagacttctttcctaaagagcataagctcaaaaaattgtacacagcttccttccgtaagttccttgttgaccaggaaacttgatttccccaacaagcttaccagttcaagtttgaagggggaaaactggttatatgcccaatgattattcaggtacaaaatccaggggtccgttggtaaaggcaagtgcgacgagcaatgggtcactggcgggctaggcccaggggatttaattccaatgcttgaacactttggccatgcctggggtgtattgccccaaaaactagtgtcttcgttacaaaaaaaaaatccgcgcctattcgggggacaagaataaaggccagtctactctgccgttttaaagaaaccgccaaggaa

SEQ ID NO: 535804 - DNA, 168 bp, Homo sapiens
ctctctaggttctccacgtcgaatattatcaggggttatcctgaggagatcgcaagagctttccatattacaaatgactttactgaataagaggaagcccggtacgccaagagaaccagtggtgtgaagagaagtgaaatgttgtgtctgacactgtaacactgtaaa

SEQ ID NO: 535805 - DNA, 1240 bp, Homo sapiens
  misc_feature (271)..(271): n is a, c, g, or t
  misc_feature (273)..(273): n is a, c, g, or t
  misc_feature (282)..(282): n is a, c, g, or t
  misc_feature (652)..(652): n is a, c, g, or t
gggagtccggggacccgcgatcagccccggaggacggggtggggtcgccccaaacaggagcgccgggaccgctgggaccccgcactcggctgtcctgcctgccgcctgtggtagcctgggcagtgtgatggtccctggatgatggctgacaatttttcctggccccccctcccagtccctgccccacttcctggggccgccactttcactttctcttcctgcctgaagcctgatccccttgcgaagaactgtgggcctcccgggaggaganangggctttgnctttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgctggacctgtctcggcgcccgctgccctctcaccgccccacgcaggatcccggcctggtcaccgggcagtgtgatgcttccctgactgccgctggggacagcgaggcacacacagggcttgggcctgctgccggaggccacacggcctggctgagttgctcctggtctcccgcctctcccaggcgacccggaggtagcatttcccaggaggcacggtcccccccaggggngatgggcacagccacgccagatggacgagaagaccaagaagggctgtgggtgagcgtggaggatgctcagattgcacagcggtcaccatcgtggctcacagtgcgccctgatatgacagtggcgtctctcagggacatggtttgcctggactatggcttcccaccagtcttgcagccagtggcgttgattggcgcagccggttggcacgagaccaggagaccctgtgttcccatggggttgcggcagcattccggacagttgcctaactctaatctgggtgtcagcccgaaacacttccttcaacctcaggagcttgcactgggaagcggaatagcggatgttggcaccatctgggcgttcacgggcctctacgctgagaccgcgtgagcccctgtggagccagtggcacccaaaaggccggggggtcccccggaacccgggagggggacgcccaagattgagtcgcgtagtccccaccctgtggctggaagaacccccgggtgacgctctatacacagcacagcgcgcgtcgataaaaatgtagtccgtgcacccgcggctacatgagtgccgcatacatcagcacg

SEQ ID NO: 535806 - DNA, 104 bp, Homo sapiens
acctgggtgtgatacggcttagaactgggcatctagatcgggatctgatcacttgactgagctaacttgctctttccttttatttaaaacacaaaacaaaactt

SEQ ID NO: 535807 - DNA, 105 bp, Homo sapiens
tgcttgtccagattgagcgaggagggcaaagctatgacccccgaaaccagactgagctcctagaacatgctaaagagcacacccgtctatgtatgtgtgtggatc

SEQ ID NO: 535808 - DNA, 223 bp, Homo sapiens
ctatattctattctattctattctgttctgttctacactattctattctattctattctattcttttctattctattctattttattctgttctattttgttctattctcttctattctgttctattctgttgtattctattctattctattttattctgttctattctattctattctattctgttctattctattctattctgttctgttctgttgtattc

SEQ ID NO: 535809 - DNA, 383 bp, Homo sapiens
  misc_feature (21)..(21): n is a, c, g, or t
  misc_feature (158)..(158): n is a, c, g, or t
  misc_feature (210)..(210): n is a, c, g, or t
  misc_feature (248)..(248): n is a, c, g, or t
  misc_feature (307)..(307): n is a, c, g, or t
  misc_feature (376)..(376): n is a, c, g, or t
gactgcatagggctcggcgtngtgactcacacctgtaatcccagcactttgggaggccaaggcgggcagatcacaaactcaggagatcgagaccatcctgtctaacatggtgaaaccccgtctctactaaaaatacaaaaaattagctgcgcatggtngcaggtgcctgtagtcccagccactcaggaggctgagacaacagatgcacgncaccacacccggctaatttttacagggtcctgctacgnaccattttatgtccctacctacagtgcacaaggggttaaaatgggctccccaaaaaggnatactgcctttgaccatccctgggttcacacttcataatcccacttcaattttaactaactttggttgngtaaagt

SEQ ID NO: 535810 - DNA, 871 bp, Homo sapiens
tacagcaaaccaccatgggcacatgtatacctatgtaacaaaactgcacgttctgcatatgtatcccagaacttaaagtataaaaaaaaaaattcttttagaaaagtattttttatttttatagagttagggagtacagttgcagttttggttttgttggttgggttttttcttgaggagtctcactctgtcgcccaggctggagtgcagtcgtgtgatctcggttcactgcaacctccgcctcctgggttcaagtgattctcttgcctcagcctcccgagtagctgggattacacggtgcttgccaccatggctggctaattttgtattttagtagagacggggtttgccatgttggccaggctggtctcgaactcctgacctcaggtgatctgcccaccttggcgctggggttgcaggtgtgagccaccacacctggtcacaggtgcagtttcgttacatggatatattgtgtagtggggaaatctgggctttggtgtaaccatcaccaaaatactgtacattgtacccaaaaggtaattgctcatccctcaacccctcccacctttccaagcctcccgctgtctataattcccacagcgaatgacccctgtatacaaccctgttttaactccccaattataaagtgaaaaacctgtggcattttaatcaaggcacctgaaggttctatacacagatcttaattcctctattccgtccacgacgttgttgcactcagcaaaatcagctcacagttcaaaccacagtcggctgacagggcacgatacatacagattcattcacttgggtgagaaaattacccagggatacactttcacacgttcttattccaacatcggatcgctatagg

SEQ ID NO: 535811 - DNA, 375 bp, Homo sapiens
tttttcccctgaccaagttacctgtaaactggaatttgcaaggggatgctgtgatagtaacccctttctattgctgtaatgttcatataacctgggaaactgagagaaggggatgtgtaaataaaagcttaaacattttagtaatgtgttaaaatgtcactctctcttaccctgtttcccttttttgccagatgaggagttttttatatttatattgtacactacacgggaagcctgaaacgacaagaatatggggttggggataggtgtttatattagagtgcacttaaaaaatctgaggggaaacatttgaggagtttaaagaccctcccgcgaaaatcttgtgtttgccacaataaaattttcgggggttta

SEQ ID NO: 535812 - DNA, 1127 bp, Homo sapiens
ggagagagagaactagtctcgagttttttttgtttttttatatacgtttggatttttttttaaatcctgaaaagtaaactttaaaaaagttctgtgggagaaatttataaaaccaagtggcatgtgagggtctggtgggaaagctgaggggctggacgcagggttgtgggagagttgaacaggagggagattctccaccttcagttccatgtgatagcctcacgtggtagtgactaccagggaaggtgtggggaataaatttacgctccaacacaacggaccaacgcggctaacgcgcaacaacaccggcacggtgtggcaacggcgtggcgcgacgggtggcgcgcacccactacaacgacacacttaacacaggcgctccaagcgctaccgccgtgattacgaacctcacaggacacaacaactgtgctccgtggcccccaattagcgaacgcgaagcgacgaacgccccccatccagagaggggggaacagtgccaaaacgatgagccacagtgacgccagccggtacagggctaagactccccgagagcagatcatacacaccccacaatcatcaccccacaaagaaacacccacgagaggcacaaaatacatggcgacagtagagcgcatcaagaaacagaacgatgaggcacctaaaatggctacacccgacgggcactttgcgtgccgcgacgaccgcaacaccctccgcgaaacatacagtaggcgagcccaaccaacgtggggaagaacacgcccatcagtagaaggcaccacaaaacaacgaactgggagaccaactctgagctatagaactaccatataatgagtggctccacaccacctccactgatgtgaatgattgtttgcaccccaccgcgggggtaattactaatcagacactccccagaggaatacaacctgcaacgcgacatgtcttccacccgatgcaacgataccaagtagagacgcgcgtccccacaacttcgtgccgctcttttgggagatactcgtatgcaattaaagaatcaccatgggagcagacactccacgaacgtcagttcttgagtggagtccaacaactattgggtcaggtgaataaacacttgtcgggtacttaat

SEQ ID NO: 535813 - DNA, 376 bp, Homo sapiens
  misc_feature (190)..(190): n is a, c, g, or t
gtcgtctctcacgatccccggcacgatctttgccttctggagtaccagcagagatcacattccatgtcagcatgatgggctgcccgatagcccctcaccctgagatgggacgccatcttcccagctccaccatccccatcgtgggcattgttgctggcctggctgtcctagcagtcgtggtcatcggtangctgtgcgttcgctactgtcatgtgctcggacgaagagctctggtggaaaaggagggagctactctcagactgcgtccagcgacagtgcccagggctctgatgtgctctctcacagcttgaaaagcctgagacagctgtcttgtgagggactgagatccacgatttcttcacgcctccccctttgt

SEQ ID NO: 535814 - DNA, 81 bp, Homo sapiens
  misc_feature (46)..(46): n is a, c, g, or t
  misc_feature (48)..(48): n is a, c, g, or t
ccaaatggcggatgacgccggtgcagcgggggggcccggggcttgngntggccatgggatggggaaccgcggtggcttccg

SEQ ID NO: 535815 - DNA, 113 bp, Homo sapiens
tatagtgtatacctatacaaatgttcggtcaatttgacgcatttataatgttaatgttagatagatagaatagagagcccagagctgccgatctaagtgtagtctgtagtgat

SEQ ID NO: 535816 - DNA, 333 bp, Homo sapiens
accagcacacatcttagaagggaacagagatatttcagaggtcacactagacttagaaactgcttacagatgtatctccggagagagaggaaggagtcaacgatgccttccagatcactgctatgagcccaatgggtcgctggtgacgcttcatcacttacatcagcatcctgagagcaggacaggttctatgtgagggcaggtagcatggagagttccactttggacatattgaatcaaagcatgcctgtgcaaatcatcccagctagtgatgtctcacatgggctgtaggacaaaagtaggaccaagaacgcacaactagtcgagaaacga

SEQ ID NO: 535817 - DNA, 636 bp, Homo sapiens
gcagatcacctaaggtcaggagttcaagaccagcctggccagcatgtgaaaccccatctctactaaaaatgcaaaacttagccgggcatggtggcatgcacctgtaatcgcagctactcaggaggctgaggcaggaaaatcgcttgaacctgggaggcggaggttgcagtgagctgagatcacaccactactccagcctgggcaacagagtgagactccatcttaaaaaaagaaaaaagaaagaaaatgctttgaagaaaatgaaaataaaaatacaacatatcaacatttgcaggatgcagctaaataatgcttagagggaaattttatagtatttaattgtatttaagaaaagaagggccagatgatggtcgtcacgcctgtgatctcagcacttcgagaggccaaggcaggaatatttcctttttttttttttttgagatggaatctcactctgtcacccaggctggagtgcaatggcatggtctcagctcactgcaacctctgcctctcgggttcaacgattctcgcgcctcagcctcctgagtagctgggactacagcgcctgccaccacacccagctaatttttgtatttttagtagagacggggtttcactatgttggccaggctagtc

SEQ ID NO: 535818 - DNA, 570 bp, Homo sapiens
  misc_feature (34)..(34): n is a, c, g, or t
tttttttgtaactgtaaaaatttagctcattttnccattcatgtacagtgggtcataaaatcaccataaagcagtcctgttccaatttttttttaacgtgccctggagaattttaaaaaaaatgatcctaggtttgttttttcatgcgggaagcagaagggggctatcaaagcctcttccccccccctataagggaataaaggtattatttctttcccccgaaacggattcaaaggtagaaaatattttagcctccggtggtttttaaagggcttccaaagggcccaagaaactgttttttgccccgaaaaaaaaaacccccccccggggttttatttgggaaaaattggaagagaaaaaaatttgttaaaaaagaaggccgggtctatttttttttttttttaaaacggggcccctaaaatcttttgaggaagggaaggattttttttgctggtcaggggcttttcccttttatttggtggtttggggggccaggggccctaagtaaaaaacagacttttcccaaaggattggtttcaaaaaaacaggtggtttttagccaggcctgta

SEQ ID NO: 535819 - DNA, 395 bp, Homo sapiens
  misc_feature (234)..(234): n is a, c, g, or t
ctggtgagtgtgagaaggagaggagccaagttggaatccaaggtttcagtctgagcaaatggacaaatgcatttgccaagtcctatttatgttaacttgcagataagtatcatctgacatatctactcccttagccctagttcacagtgtcatcaccacttacctgagtaattataccaatgtagatgccctgcctgttgtctttcgtcagtttaggatgccatgaagaacctntaagaactatttagtaaggcataactcttacatgctagttgttgcccctttccaactcacttgctctcggaaaaaaaggactggcatcgcagagctaagctacaaagcaaagacttgagccccaagcctcagttcttgagtcctacattaaactttcacac

SEQ ID NO: 535820 - DNA, 288 bp, Homo sapiens
atggtcatatcgggtagaacggacaatattcataataataaaacacctccataagaatcaaatgaaatgaaagtagaagtgcttggtagaagatagaacaagtcaataactgtacaattcagtaactgcaaggaggtatgatataagcatagattgtttttttttaaactagggagtggtcaacccaaattgtccatcaagggagtaggacagggaaaaaggacaaccggggagggcattgctggccatagggggtacgggacgcttcgaaatccagtaactcatggg

SEQ ID NO: 535821 - DNA, 125 bp, Homo sapiens
ttatcattagtctcatctatctctctatccttactttctctatcctctctatccttaatctcttcctgcaacagcttcccttttcttagatttcaccttaggttcaacatccacaagtagtgtat

SEQ ID NO: 535822 - DNA, 394 bp, Homo sapiens
  misc_feature (365)..(365): n is a, c, g, or t
aaaagccaaaaaaggccacaaaaaacaaatttattaaaacataaaaattgcatatgtgccacatgtgttgtttagtacacctgtactttgtagaatattcaaatcagggcatcatagctgctgcctgaaggaaacatttttaatttctttatgttgagaataaaatccttttctaccttttgtgacattgtatagttagtttcttaacaatgcctagccttggatctgatgcttctccaatgataatttagtatacttgttcaaacttgaccatatcccagataacctcccagactctcaattttatcttttacatcaaccagagcaagagaagggggggaaaatatttattcattggtatatcnttaattttttactttatggactccactaa

SEQ ID NO: 535823 - DNA, 557 bp, Homo sapiens
gtttttttattgtgtttgtttgggaataataaggcatccttttattggctggacgccattaacaaagaaccgattacattagcaacaaaaaagtgtttcctggagtgagaagtcacaaggcagttatttcccaaaaggttaagtaaaacaggtggtaccaacatcatgtaattaaagatggttaaatttctactattggtcttataccatcttggattcttctggaagcaattttgattggagcaaaataagataaaaagattacttggtttatcttcaggaatggtaagggtctaatttattcaaacaggtttattatatttattaaaatctaaaatctcctggaagaggggttctaacgaggagtggggtctttttttttttctcgctttctcttgtataaaaatctcgagtgatgagtctctataaacgaggggattttagaaagaagagaacagaacacttctgtgtttacagtgtggtgttcgtgacagagagttaaaagagggggtgaaagaccattaaatataagaggctttaaatttgggcaaaaatat

SEQ ID NO: 535824 - DNA, 539 bp, Homo sapiens
atatatgaaagggagttgattaagggaaaattaactcacatgatcaccaagacagaagtcccacttgctgtctgctaacctgaggagtcaaggaagccagtagtggtctcacatctgagtcccaaaagcctcagaagtagggaagctgacaggtgccaccttcgaatctgtggctgaaggcccgagagcccctggcaatagcacttggtcattagagtccaagaggccaaagaactcagagtctgatgttcaagggcaggaggcatccatggcacgggagaaagacgaaagtcctgacaactcagcaagccagtttatttcacctgtccttctgcctgctttgtgtctagtgtgcactggtcagctgatggaaaggtacccacccacagctgacagatgagtgttccttatcccagatccactgactcaaagtgttaacttcctctggcaacatccttaccgatcacacccagaaacaatacttggcatccttcaatcaaatcaagttgacagcttaatattaaccatcacagaataga

SEQ ID NO: 535825 - DNA, 366 bp, Homo sapiens
  misc_feature (7)..(9): n is a, c, g, or t
  misc_feature (49)..(49): n is a, c, g, or t
  misc_feature (52)..(52): n is a, c, g, or t
  misc_feature (54)..(54): n is a, c, g, or t
  misc_feature (57)..(57): n is a, c, g, or t
  misc_feature (260)..(260): n is a, c, g, or t
agaattnnngggatggggagaggactctaaacagacagctccttagccnctnanagnccctgggaagagccacaggataggcaagggtcaagggaataatagcttttccttcttcctgagaagccttctagaattcccctaaagaactaggggacgcaatgtgaatcaaatagagaagccttcctgacttcaggatgttagggatacacattttttgagggcggagactctcattgttcatttttttttttcctgtccangcaggttctcggtgtggtggttaaaatgacttccaagcttgggccccagacaatttctttggaagaatcttgctttaaaacctaaatttaaagctaaagccccata

SEQ ID NO: 535826 - DNA, 276 bp, Homo sapiens
tgaaccacttagttgttacgattctgcccacacgattgccaatacaacgttatgtgctttctttagctctgttggctctgcaaacattgcccggtgtgtttcatctatgcccttctaagaacatcagatgcagtcacatcctggaagatcctatcttttgtaagcttctaagaagcagcctcttgtcatagctttttcctgttgttaaagtgcctagtgaccaagagggctgctaagaaagctttctgaccacttgtggctgtcattggacagata

SEQ ID NO: 535827 - DNA, 283 bp, Homo sapiens
attaaaggaaggaaatttgaaatagggaaaacctgttaaaacataaatcccaaggaaggtttaaattctttttaggccgttcaaataaaaaattgggccctcctcattagtttaggggggggtttttaaaaactaaacggggccagcaattttttgcaaaggaatttgtgagccgcaaagcaatatacaattcactttctttcccagaatagctaagcatttgccattagaactgaaaattttttttttaggggcactttttttggggtatgggatttccagg

SEQ ID NO: 535828 - DNA, 101 bp, Homo sapiens
accggcacgaggcgagatctaagcaaactaacacagaaacagaaaaccaaacactgcatgttcttactgctgaaaaccaggagaaaaataattcatcaatg

SEQ ID NO: 535829 - DNA, 319 bp, Homo sapiens
gcaacctgtaagccatgcaaagagtaactccatatccaacaaaaaacctctaagctctatttggctggggcaggggtgtcaaatatgccatggtgtgttttatccgtgctccgacccatagtctgaagtgcagcatggctgtagacgggtcgggaccactcaagccttacaggaggccgattccaagaaatgcactaatactttcaaggtcattcaggtgggctccgcgtacactttctaccctgtcatctgctcgaagatacttcttgaccttttctcctttgcccaatgctacaccgtcttctggattggcaaaaac

SEQ ID NO: 535830 - DNA, 421 bp, Homo sapiens
  misc_feature (26)..(26): n is a, c, g, or t
  misc_feature (406)..(406): n is a, c, g, or t
  misc_feature (408)..(408): n is a, c, g, or t
  misc_feature (412)..(412): n is a, c, g, or t
ctgcccctgtctttcccctcctgggnataaagacagacatccctgcctctgctccccctacccacttagtgtacaccttgttacagagctcagaacactgaattatggcccatttatttgaaaatcttccctggccgggcatggtggctcatgcctgtattccccagtactttgggaggccgaggtgggctgatcacttgaggtcaggagttcaagaccagcttggccaacatggtgaaatcccgtctatactaaagatagaaaaattagccggtcatggtgttgtgcatctgtagtcctaggtactctactcgagaggctgaggcaggagaatctcttgaacccaggaggtggaggttgcagtgagctgagattgcgccactgcacttcagcctgggcgacagananaaanctctatctc

SEQ ID NO: 535831 - DNA, 447 bp, Homo sapiens
gcgggcgcctcccccagcctcgctgccgccttgcagtttgatctcagactgctgtgctagcaatcagcgagactctgtgggtgtaggaccctccgagccagtgagatgaacccggtacctcagatggaaatgcagaaatcacccgtcttctgcgttgctcacgctgggagctgtggaccagagctgttcctattcggccatcttggctcctcccccgggtgttggtgtccctctgttgcccaggctggagtgcagtggcaagactggctcactgcaacctccacctcctgggatcaagcgatcctcccatctcatcctccaggagctgggactaaagacagttgaccattaaacaacacaggtttgaactgagtggatccacttatatgcatacgtgcattttctcctgactcggccacccctgagacagcaagaccaatcactcct

SEQ ID NO: 535832 - DNA, 586 bp, Homo sapiens
  misc_feature (47)..(47): n is a, c, g, or t
gggtttggttggagaaaatggcctgatcttaaaactattcagtcttnctgggatttttatgcatagaacccccaaataaccatgaaataaccagtgccagtattcataggaaagtgagaaactgtaatatttggcccttattctattcaacaggttttagaggcacgccccccttttttccttaaattttggcttaatttttttaaatgggcctttaattcttaaacggtcctttatttgagatggaaataagatctaaagttagttgcccttgcctgtaaaacaagtgatttgcaaattattattttccctttttttaacaaaaggaaggaaatttggttcccggaaatcttaattttcaccccttcgggaaaccttaattggaactggcagtttgccctgggcgggatatggaaacccattgctctcccctgctacttagttgattttaaagggaatttccagggatgagaaatttgtgaaaaaaaaattggatttcttttgatgtttcaaaagggggcctatgaaaaactgatttgttaaaacatgctagggggccaaaaataaaggcccgaatgccctttta

SEQ ID NO: 535833 - DNA, 230 bp, Homo sapiens
cccacgtgtactgggtggcgctacttgtatccggttgggcgaaccttgacagtgatgtggtaccgctccgggagcggcactggaggatattcagtctctactggcacctttggagacagtgctgaggccgatgggtgtagtgggcagggaaccagttgtaatccaaggaagcagcctggcgtaccagctatagcagccacgtctcactggcaggcttccagtggggcaca

SEQ ID NO: 535834 - DNA, 497 bp, Homo sapiens
agctttgcagtttgtttgccgttttgtcagattctgagacttccatttatataacagtgttgccgcagtaacctctgagaaggtttaacctcctttaaaccaaggattttctgacacgaatgacttttgaatgacagagagtgacaaactgtggtatttgctcaaagctacctaccaaggcatttcctcatcttcttgctttcatgttatttttaatggctctttttcctcagcagtatttagccagcttgccagtttgaaaggaaagacaaatgatcttcatgcggctggcttccttaacgcgatattgaatgagatttaatgagagatgtttgtttaaagtgtgattgctttcctttcacagcagaaatgagcactttttttctgatctctgcctcagtggacattattcacttcaatttgtttgtccttaagtagaaaaaaggatgttttttcagtttgttagaccatttactgtaataaaaagctgagtgtga

SEQ ID NO: 535835 - DNA, 397 bp, Homo sapiens
  misc_feature (267)..(267): n is a, c, g, or t
ctaatcgagtctcggtacctggggtggcacaacccagaacgacaccagcatggtcgctattgagacactgtcaagattcacgttataccatccatagtgcattattgtcgcttttcttctgtctagtaatgtagagacttctacagcatgttcgtccttttcttcaataaagaatttcttaaaagatggattagactcatctcacacgttttaatctcttctcctgtctagatcatgtatttggctgacaattactgcactttggtntgtttcagggtttgtttgctgcttttgattgctacgttttggagagagcaatcctgctgtgaaaccgtgtggctgtgtatcgtattcggcttactcttactagccatcattttccccttttttaggttta

SEQ ID NO: 535836 - DNA, 973 bp, Homo sapiens
ggcggacgcggaggccagttccccagctccagaccgccgtcgatgctgcctgtgtagttgcagccgcggactgctcccgaccagactcgcctcggggaacaggacgcgcgtgagctcaggcgtccccgacccagcttattctcggaaccatgaacccctaacttgcgcccggtgcggcaagatcgtgtatcccacggagcaaggtgaacgtgtcgtggataagttctggcataacagcatgcattccattgcgagacctgcaagatgcacactgcaacatgacagaactacaagggctacgagaagaagccctacatgcaactgcagactacacccaagcagtccttcaccatggtggcggacaccccggaaaaccattcgactcaagcaaacagagtgagctccagagtcaggtgcgctacaaggaggagtagagaagaacaagggcaaaggcttcagcgtagtggcagacacgcccagagctccagagaatcacgaagacccaggagcagatcagtaatataacataccatgaggagtatgagaagagaccgcaaatgggcccatagacggagggcgaagggcaatggagccagaaagacagatagaagaataacgaagagcaggccagcagctaaccggcaaggacacaatgaacacacgcagcacgactcaacacaatcacacagacacagaagacccaggaaaaaccaagagcaaggaccaagacagaaaggacgacgaggaaccaagtacctactagggacgaaaaccaaggaagccctgcaaggcaccaaagatacataccatcaccagccggcaaagacgccacaaagagagcaagaaggaaaaaaagggagaccggagcacgggagtcaatggacctaacaagggacaagacaaaaaacacgcaaaagacacaaccagacaaagaccagagggacaacaacgaccacacgtagagaaaagaaag

SEQ ID NO: 535837 - DNA, 406 bp, Homo sapiens
cttcttcacctcaataggttatcttatgcactgcctgagtgtacacataccaatttgaataccttattctaatttataacaccatattgcctctcagagaacattgaatttaagactttacactcagctaaaatactttctgtcatcttgtaataaaatatttttatatgtagagggaaactaaggaggaataattgttgacctcttagttattagtacattcacaactacaaagatttcccattggagaaatcctactaaaaactcaagtggagaattctatatggagtacttatttaaatatggaccttttaaaagtaaaatgaatgtttcaaatgcttctcaaaacattaggttcatgcttgaatgcaatattctaaattttaccccattttttcttaattat

SEQ ID NO: 535838 - DNA, 193 bp, Homo sapiens
  misc_feature (33)..(33): n is a, c, g, or t
tcctagagcgctagcactcaacgattgggaatnttcaaaatactgtatcatttacaaaactaacaacaatcacaaaatacttagatataattctaacaattaagtccaagatctacatgctgaaatcacaaaatgctaatgaaagtgatagaaaaagagctaaataaatggtatatacacacatacacataca

SEQ ID NO: 535839 - DNA, 489 bp, Homo sapiens
gcttccatcattagtacatcgcatataggcatctccactgcctacatatccaccatcatcacgagctagtcagcaagagccatcatgatcactgaagtttcctccaagaccgaagttgtcattcccaccgaaaccactcgtccaggagcatcaccaaattttccagaaccacttcgacctctttggctggatgaagcactagccatctcttgctttgacagggcttttctaacttcacagttgtggccattcacagtatggtatttctgaatgacaatcttatccacggagtcatggtcgtcaaaggttacaaaggcaaagccccttttcttgccactgcctcggtcagtcatgatttcaatcacttcaatttttccatactgttcaaaataatctcttaggtgatgttcttcagtgtcttctttaatgccaccaacaaatatctttttcacagttacgtgggcacctggtctttgagaatcttctctg

SEQ ID NO: 535840 - DNA, 1016 bp, Homo sapiens
tttctttcttgttcccttctctttttcttatttttgttttttcgaggctttttatggtcttcccttgcaaaaattttgttgcatggcaatcattgcattgtcgtttgtgaccatttctcttcttacctgagcccgttcacctggttgagtcattggagtatcaaatgagggcctgcaggttggctgtactcatcgttgcctgctgctttcggacccgcttccacatgctccggttacaatggtgcgagcacattctactaccaggtttctagagcactgccctatgcccaccttgtacccagtccagaggtccgtccaccacagcagccacaggtggagggctcgtctccctgggggctcaccccaggtggctctgccatgctgtcagggaaggagggacttgccaggagaacccgcgcagtcccaggcaccctctagcgtccactcagcgggaacagcaccctgcatctgggggagttgaagcagtcgctgacccccgtccccagcgggcccgggccctcactccatgaaccacacggggtttatttgcggatgttcctggagagctcgctttgtgaagaaaccatcagcaggctgtagagcatcgccaggctcgattgtgggggcagggaggcagcctcagtgtctagggcccgcccactgacaccagccgtacctagtgtcgtgccacggtgccccgtagcagcaggtcctgcggccaaatctgtctcccgttcatgggcctcaccagggaaggaggaagccctgctgttgcagacacctctgtggccccccaggagtgtgagtggcattggggagggggccgtggcactgaggccgaaagtgcctgccagacggcacggtctgggtgcgggtgttccctgtgagcccgagtccgcttcaggaggggagcctgcaggtgccggctggtgaggggatgacagcgactgtgggtgggaggaggcagcgcccatctcagcaagcaccaggactgcctaaaactccggcaacccagc

SEQ ID NO: 535841 - DNA, 321 bp, Homo sapiens
ctcgccccccttacccctaaaatcctcacatctactttgtatttttcaaattttcctctttgaaaataaatttctgctcaaaggaacaatattcttgctgaatgctttctctgtaaatgcttcacagttttgaaaacaaaggattgcaactccccaaattgtccccaagttgaaattactccctgcctagtcggtgtaacctttgcaaaaccagtctgtggtctctaaaaccataattgcgggcattgctgtggggatggagacccttgcgtgtgccttgtccctgggttactcgaaagagctctgaatttttagggggaa

SEQ ID NO: 535842 - DNA, 317 bp, Homo sapiens
cgagctcttaccgggtgcggcgtcggaataggcaccggatgcagctgcagtaaggtgggtcatgcaggaagctgagggaggtggaaggccgtggctcgtggcattgccgcctagtcggggaagagcaggaagccggagaagacgctgtcagagccctggatgcccaccatgtcgtagtagacattgacagccagaccagctcctcgccacctgcaacctcagcagcacaccggccgagtagacctgattggttttggacgtgtggacaccagaaggtgaccactttgacgccgctgcggaacagcagcacgcacagg

SEQ ID NO: 535843 - DNA, 279 bp, Homo sapiens
agactctaccttagcacaatgacgtcagaagtaaaaaccatggtgaaacagttgaaagcagtacgaaagcacaccaactgagagcaacaaacaaatggacgaaaatgaacaaggagatagcagcatgtgagctacgtcatctctcaacatgaagccaaaatcaagtcattgactgaataccttccaaatgtggaacaaaagaaaagacagaaggaggactctgtcgatgccctcagagaagaactagtccagcttcgagcacaagagcaagtccatgaa

SEQ ID NO: 535844 - DNA, 471 bp, Homo sapiens
gtttgggcagacacgagactacaagacagatggcttgcttcttaatccaaggttcttcttataccaaaagaacaaagaacgaaaaaagccacaaaagactcaaagagaagcagatttcccaccacagcacaacctcagaacaattctgagttgctcattttaagatcaacgaggcatttatagtgcatgtatgcctgatagaggaaatcaatgtgaacggcaaacttccctctaaaacagcctaatacaacactggtccaggaggaacaaggcaaggaaaccccctggtgaatgactcatctcaggaagaggcagggcagggtcaggagagtctatggaggagaagacctggaacaagacctctctctcttgctctcttacacacacacacacacaaacacagacacacacacacactcacacctctatgagcacaaatctatgaatagagagcctcattctctgacctca

SEQ ID NO: 535845 - DNA, 152 bp, Homo sapiens
gatctcagaggttaccaggtagactaacccacgttgacgtaaccaggtagactaacgtctttacgtgtgtacttgcgcttactttgtagccttcatcagagtttgctgaagataggcggatataggctgagcaagaggtggtgaggttgatc

SEQ ID NO: 535846 - DNA, 1914 bp, Homo sapiens
  misc_feature (180)..(180): n is a, c, g, or t
  misc_feature (426)..(426): n is a, c, g, or t
  misc_feature (1006)..(1006): n is a, c, g, or t
  misc_feature (1471)..(1471): n is a, c, g, or t
attcctttaaacttgtcggtggacagaacgcggctgcaccacagccttgtctgtctccatgttcggccctatctggtcacatgctcttaagttcacctaagacacgaacttagtggtctgatagtagatgacaactacattcgccaattccgatcagatataggctctacgaggcatagngtagaatacgcgaagatatggtctaagtggcgtagccaggtgtagcgtctatctgtcctgtgcaatagtgggcatctcatgcaccttattagggaccctgtatttgtccaacgttcgaagctaaaccgatctcatatagtggggagaagcgaagatttgagactcactatacaattcagttctcatcttgacagtttgaggaagcaggcgcagtctagagacaaaagcttcaatagtcgcccgcanagagactagtagatatatagatacagagcgtctggggacaccccctcaactcaggaatcaaatttgaccctgacaaaggtgtcgggcccccatagtgccaatactcatagctctgtccacagaacgtccttctcaatgtcgctatgcaagacaggtgcgttcctctcatacatgggcagacggctacacgacatgtacatgaccacaatatagagcactaatttggcccccagtagcgggtgcctctatcacaagcccgaacttggcggcccccgcgggcagaaataccacctgtgggaacaccttttgggtgggttataggtagaactccgtggaaagtaataacgggacaacacgccccttaggagcctttagcaaacgcgagggttggctaagccccgtgtattctttttgcgagcggcgacctatcccttaaggcgtttcatcttagaccacgagacactagggcctacataagggcggctcggtgaaggaggggacaacaaccatacgtggttttacctaggggtaggatttaccaaaacgccttgcaccccttgaaaccttgcgtctgtgtggnacacaccggtttacgttccttgccaccattaatgggcacttttcagttgcgcgcccctaggggaaaagattacctcaatagggccttgtgcacgacttgggcacgtacccccacgtatttacctccccgggggaccaaaacctctccttagagggtattatcccccgacgaagccatgactagagtgtctatgatattaaaggagagccctcgcttataaccgacagtttccccaatatttccctttcaatcccagagccgccaactgaaaccgcagccccctgggtgaggtgcaccaatccttgggcatttgtgctatgagcccattatcccaattgggtgtttagacaccacaccctggaaacgggggcccataccttaatatgtgaacccaaattcctgggtctgggggttgagaaacaggccccttgccgctaatctaatctcacaggcgggccgccgcanaagcctagatcgcatcgtaacagcacgttatatagccggcccttaattagatggccggacagcaaagtagggtgtactccatcaccgatatcaacatgggggctaccaccctacagcgaacaattgcgactaggttgggcccccgctagaagtgtttgtgtcactgctgaccgatacgaaatgctcgaaaccacacaccggtggtgtatcgccctaacaccctcggtaattatccagttgctcccctaaggcgggccccaaatatgtccccggctaagacccttcgcaggcaacaaccgctcacactgcagacacgccgttgtcctgcgacagagaacgcccgagccttggtttagtaacgccgcaccccccagcgactactgacaccatcccggcgacacaacatactgatagcctagcagaacataagagagcacggcaac

SEQ ID NO: 535847 - DNA, 310 bp, Homo sapiens
gtggaagagggtgtgtctccgagccagcccagcatggacggggattttagacggccatcgcgaaggaagggcttccagccggttttcttgaaggagtctttcctggaccctggggccaccacttaattaatttattaccggaggagttgcttataaggtcaaacacgttgagagacattctctgtcaccccgtggaagtcttttcaaaccgattttcccaaataaaaagccctttataagaggaggatcccgcccgcgcgcaccgccgctgggttgagacacctcgggcctgatatgcagagcaccatct

SEQ ID NO: 535848 - DNA, 231 bp, Homo sapiens
atggtggcgcatacatcctcatgcaatgggtttttgatttctctccattccaggggacatgggtggcagaatgctcattaagatatgtcgttagcggttaaccctgtgagcccctcatagagtccgtcccctgaggtggcacaggagggcagcacataccagttcctgtcccgaatccgggtcaaggaccagtttctcatcctatgggacgcagtttctcatccatgggag

SEQ ID NO: 535849 - DNA, 388 bp, Homo sapiens
ggccccccccccttttaaaaaaaatttgcccccccctttggggggggaaaatggggggcccttttcttttttgcccaattttttgccccccctttggggaaaaaaagtttttttttttttttttcaccccccggggggggggggggccaaaactttttgttttggttttggcctttttaaaaaaattttaaattttacccccggccccaggaaaaattcccttggggtttttggtttagggggccccctttcccgggggggaaccaaaaaattttttttttcccccccctgggggggtggggttttttttttgggaaagtttttttttttgggagacccccttttgttttgggggttttttccaataaaaggggccccttttgcccca

SEQ ID NO: 535850 - DNA, 1006 bp, Homo sapiens
agcggggttggcggcgggtgccgcgcgcccgagcgggccggtggtggcggggcctcccgcctcggtccggtggtgtgggcagccgtggcggtcgccggtggaccgcgaggggcgtgatgaatagggagtggggtccgtgctcccggtcagctgcagaggagcagacgaccatgccctcgagataaaattggtctcgcattgaatctcgagcggtatcagcccagatcagtgcattgccttcactctttgcgggggcatgctgggggtgctggatcgtttgagcttcaccgatctgccgaatgctgggcgtaacttgtgcccacgggaaggtctgcaccgatttgcacgcacgggtgacttacacccagacgagatcccatgagggcaatgacgtagataacgaagacactcacttgaggcccaggctgccaggaggcgagaagggaaccttaagaagtcattcagggcacgcgccgccaagagggggcctagcaacatgacaatgagcggacttgacgcagagcacagagacattgacctgacgccaggatgcaacgcgtacactatttggcaaacaagtggatatcaggaagaaagcgggggaacatggactttcacagttcaatgggacacagaaggttatgccggtggcgtgacaaggagaaggcttagaggataccagttgtcaaaaaatatcgcgggcgtagacagcttggaaagcaagaccaagggtggcgaatgttagccagccttgggacgactcgacattcatagacgggatttgctcattggttggaccagcgggatccacagataggctgaccacatacaggagctagcgagagttggttggaccaatagaggcggaaggaacaggcaggcgggcggggctggaggggaacccagtggccaccggggtggcggccccctttggagccgggcgcagagggcaatcgcaatgggagcaagacggctcctgcacggacgttggcacacacaccctggg

SEQ ID NO: 535851 - DNA, 615 bp, Homo sapiens
tggggcccagtctctactaaaaatacaaaaaaaaaaattaggcaggcgtgatgctgcatgcctgtagtcccagctacttaggatgctgaggcaggagaatcacttgaacccgggaggcagaggttgcagtgagccgagatcgcgtcactgcactccagcctaggcaacagagcgagactccatctcaaaaaaaaaaaaaaaaaaaaaaaaaacggggggggggggcccggcgggggcccaccttgggggggcccgggggggaagaacaaataggaggcgccgaggagacgtctcagagaacccggtctggggggcaacggtgggagttagaacccccacttgttctactagtaaaaatctacaacaattatccgcccgcgcgctgggtgtggggcaccgccgtcttgggggcccccacgagccaattttggggagcggcggcgagaaggcgggaagagcaccgcgggaacgcccggggggaggcgcggcagcgcgtcgggggcaagcgcagaggaggagatgatccacagggtgggacgcccgcccaggcggggggggaccacacaagcgagtgaaggacctcccggggccctaaaaaaaaaaaacactcacaaa

SEQ ID NO: 535852 - DNA, 808 bp, Homo sapiens
taaaaggcataggtagctgaggcatgggagttagaagagctgaagcaggcgctcttgggtctggagcggcccaggtgcagtccagtggaggaacgcgcctgcgagaccaccatcatgccatgggcacttaggggaaggcttcggctgcgtggtcaccaaccgattcgaccagttattatgacgacgaatcggaccccttcagaggtgctgaaggcagcagagaacaagaaaaaagaagccggagggggcggcgttgggggcccatggggccaaagagcgcagcatcaggccgcggaccagacacaactccaacgcggcaggcaaaacagctgcgcaaggagtcccagaaagaccgcaagaacccgctgacccccagcgtaggcgtggttgacaagcaacagaggagacgcagccgcccgtggcgcttcagacagaaggaataagacgcagtggaagaagacctgatcaacaacttcagggtgcaagggcacacgtcaatgatcagaagacagaaaggcgaccacctcgtgaacgaacattcgagaagccacattgacagaacacgggtgcaggcggcgaataacaacaagatcgaccgattatggcaccggacctcaatcacagcgacgcggcaggtctggcaacagggacgcagggggccggagcacgtggcaaaggggccgaggacatggcacacgaaccacgagggcaacagtggaacttgcacagcactcgaggcactgacacacatacccaccactcaccgcggcctgcgacacagacacaccagcagcgcaaagacacacag

SEQ ID NO: 535853 - DNA, 114 bp, Homo sapiens
ttagaggatctttacagcatcctaaccagaggcaccgcattcccgaacagaggcaccgcatcccccgtggttgcgcctggactgctgacgcacagaggcagaggtgtgtttact

SEQ ID NO: 535854 - DNA, 882 bp, Homo sapiens
tgtcgttacgtccttggcttggcgtatgagtacctgcggccccgcctggaatggagtcgggctgcgacagagacgccctgagtgggccgggatgggcgggcgtgcccgggctgcgccagaagctcgcgccgttagggactgagagcacaagtgcgccagcgcgggcttaggggcctgtgggccaagtgcggcacttggggcgagcgcagagaggcggggcgaggaggccacgtggccggcttgtgagaggctgtccgctgtggacgaggggcgccgggagcactgtctcacggcgcatcccggtacgtggaagcccctcggccaggctgctggggcctaagggccgtgtgtatgctgccgtctccgtgaggaaaccaaaacattctgaccaagacagataactctggacctgaaagacctacgtaacaccacgataatttgtcaagacacacagttactgcacacaatcagcttaagacaacggaggagataggcacaaaacgcaacaacttaatggaacattaagacgctaagatgaagcacgtgaaagggaataaagccataaaaaaattggatacgaaaaatattcctaaagcacatgagaagatctgggatctcgacagaagattcaaaaattattaacgaacggcagaaaaagggaggattctacgaaagacagaattaacggggcccatataggcaaggttgactccgcggcacaggaggagagtgaccaggataatcctccgggaacatatgcaaggaggccagagaagaacaatccagaaaataccgtggttggaagactcaggcccggagccaccaaggacaaggaaaaccaggtaaacaacgacagacggaataccacttgaagtggaaacc

SEQ ID NO: 535855 - DNA, 1474 bp, Homo sapiens
gagacagagaactgagtctcgagtttcccggctggccacaggtcgtccgctccttacccggtcggctcacacaccggccctcgagtgccgcaccgtggagtccaagatgtgctgcaaagaacaccaagcttactcacgagtggtcctggcccgtcaacacctctacatgctactcagggacagacattgagaaacacggcttatacgacaacctgggccttagaagtaccactcctgccatctggaaccccaaattgcacggtacgaggacagatgttgcacccccatgactattgcgtccgaagaccttaccgtatacgctctcgtcgtcctgcattgtcaacacgcacaccccgtggtgaccttcattgcttgagccaaggaggcgtcagtggacgccaccccaggggcgcgacccgaaactctagggtctcgccgcaaacaagagaggattgatcgaggatgccaaataagcgggcattcaaacacccactagtgaggaaagcccttacctaacgtgcaacttaagttgataaccccttcccacggagccattgcacccgaggaaggtggcgaccatcgacacttagccctagcgaaactcaatccagacgaatgcgtcatgacacactccctctttcttgaacaaacagcgtgtgtgtcataccaccccagaccagggacgatactcattttagtagctgtgcccacaccgagtgacgcgcacgccacaaagcatatgtcggctgctgtgagagaccacccgcagaacgactcatttctctcttgcgttcgtgagaggtaagcttacagtacacgcccgcctctaattatttagtagatagcacaccagtcccagcaatatgttcatcgcggcaacaggttaggcctcgcaccaccccgacgcggcggcgtgtaaatctcacggccgcaccccacagtatggagaactcggcgctacgagtgcacaaaccaactaccacatggtcgcagttgcgcaacacaaccacaataccatagagtttccactcaccgcaacaccaattctagactcctccacagctccgatcatcaccttctccgtcccactatactaggacccacagacactagtcaaacccacaaacaacgaccacgcaacctcctaccgcgccaggccacagcctagcaccaacccaccgatcgacaggcaacagataggcatttagtcagtcagtcaagatacactacaacttcaagctcaagcccgcgctactagagctgtagtactgagactacctgtgcgcgctagacaacagtgaccacacaacacaaaacaccaaacagaagctgaacgagccagcaccactgcccgcgtggcactaatcttcatgcgtactccaccggcagcgtcgtgtatgacactctgtaaaccacacactaggatcgtgccctcgatcatacgccaagtcagggcgagcccaccactttctgt

SEQ ID NO: 535856 - DNA, 334 bp, Homo sapiens
  misc_feature (314)..(314): n is a, c, g, or t
gcatgggcttcagcacgctcgccacctccacaacagaagtcccaggagcagagatggaacggtctgagcacacagcgtttacatgcgtgcacgtcgctggccgcctcacgtcccggacagcgggaccggccatcgccgcccactcccaccgtcctaccccggcaggggcttaccggggccgtttcaggctggagaaacattcccactcccctttggcctacgctgtactctgagctgtgaatatttataacctgtaaatacggccagctcttgtgacacagagactattttatcaattgtcagtcccgttccantaccagaggattctccacat

SEQ ID NO: 535857 - DNA, 200 bp, Homo sapiens
gtcctgccctcctgctgactctgctctcagatgtggagacgctcctgctctcatgcttggcctcatggctgtgattctgccttggcttggaccagggcctgggaatgttgaaagaaaacgttcttctcaagaatacaaagccagtgatattttcagcaactttcctgtataattctttggatgaataaagcctatttact

SEQ ID NO: 535858 - DNA, 208 bp, Homo sapiens
ttgatatggctgtctcatcacgaaggtgccaatcagccactaccagttagtaggaatgggtactgggagtgagatttactggtatctcagaaatagaccatcatagagctgcatacttgaatcatatggtctgggtggcctcatagaatggtttacattcaatcaggcatcgggtttggtccaaccagctttaacattaaacaaaaaa

SEQ ID NO: 535859 - DNA, 1351 bp, Homo sapiens
ggcgcggagcctgggcggagctggcttgctggctccgtgggccggctctccggccggagacatggccctgttgtgccctgtgccctgctagtgcaaggcctcgccccgatacggtcgccatgcccacagagaggaaagctgactcaatgttccggtgcccacgactgcctgctccgcgcgagtgaccgtggcggattacgccaactcggatccggcggtcgtgaggtctggacctgagtcaaggaaagccgtagccaacgctgttcagcgagggaagtaaaatctcttatgtggccttggaaggcctctcagtgttcctgcagaggaagctctttctggggctaggtgagccctgtgacatcatcgacagcagtgatgagattggatgcccagtgaggaaatgcatccatgaggagaacctgtctccagaaaacaacacacgacaaagcaagaaggacacaaagaagaacctggacgtgggctggacggatgaacgacgtatcccatggatactatagggctattgcttggcgctcctaatattccggtccttgaggaccattgtgcactttttaccctgaatatgtaaagacttgccttggactggccacttgcactggttgccttatgtgggagccagggttgtacctgcaatgtgcacctaacaaggcttgggcatgcttacccttggcgttatgccgtcttgcgaccaaggcatgtccaatggcagaaatgcttggggcatgtcactcccggcgcctagtcaggtagaatcccgcatcttcttgttaccatagtggtatgacgcccaatatgcatggctacgaaagcttctcccccgaggaaaattccagggcgcttttacgccagaacataggcgaccactctaagtgcaccatatttcaaacgggaaactttgcccacgaagtgtgccgtaccctatcatcacttgtgttggccagaacacgcgcaattggatggggagaaacacgaacacttgcgtacactcacaatgttgggacacagttcacgacgtactccaaagggtattccggagaagcacgtgctaggactccgcccactagggtgttacatactagagtcagcaaggttgtgtacacgggggtgaggcaatgtcgacggccgacccaaggtttcactgcgaacccactagcgaaatggctgtcaatagccgcaacttcgcagagtaagtacagtggaacacggcttggcgtcgcaagttggaggtttacagcaacccgtctaacttatatctaattcaataccgggatcgttggactggggcaagtagtcacacatagccacagcagtcgttataggaatccatatt

SEQ ID NO: 535860 - DNA, 801 bp, Homo sapiens
ggctggtactggcccgggagtttgggatgcacagaggaaataatgtgtcattcaaagctcagcttacagacacagccttcataacatagtaagcaaccatgggctgttctgtgctcctgacaacttcaactgttaccttgaagttgggtgaaatagcagaaacaggctgcactgaggtcttactcttcaatagcttttattgttatgcctgtcagaagtcaaaccacaacccccgagccttcacccaccttaccccgcgagaccgtcccacgatgctcacgacttagaaagctttcaggtaatggccgaacagtcaaggcactgtgataactgagaagctgctaacagagaaatggtacactccataagaatgaagagcatcctcataatcaaacatgactgacccttggaagccattccgtgaacacaccaggctctgagtaaccagcaaggactacatctgggccatccaataagcagatcagcagataccatttagaaagtgaagcactcaccagatagtgatcagcgatggcgaacgtacagtcactaaaggaagggcaatacatcacaaaagtcacaccccagtaggggatacaggtggacacggtaggctcatgcatacaagggcataccagataaagatagagagaaaacacgaacatagaacagaaaggacaacaaccggcacagcaaagaattagaagacaggggatacgggcgcagcaaatgtaccgaaaggagaatgcatgaagcgatatgtaaaaggcgataggcgtgacattagcagaaagcgagaga

SEQ ID NO: 535861 - DNA, 208 bp, Homo sapiens
actggctgtcactacgtgggctatgtggctgattgaagagtatgcactgagcgatctcacggtctgttgcgtcatccgcactatgtagcttgtcataacttatgcctcatagggatagtacaatgaaagtgtacgctatgtgtttagtcaggcagttgacaatgagtgtgaggcgtattataccaagcgccgtcgcctacgcacggca

SEQ ID NO: 535862 - DNA, 586 bp, Homo sapiens
tttaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattatacatttcaggggggaaaggtgtaatatggatgtgagtttaaaactttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatgtgtgtatttcggttatttgttattaaaacatgtacatcagtaaagagtgtttacaaaaataatacatatacccatactacacaacaagaga

SEQ ID NO: 535863 - DNA, 253 bp, Homo sapiens
ccttcctcgggtaaggcagtgcgtgcctcgtctgaatattgatcgtggctgttgggttgatctttgtgtgtctggcacatggccctgcgatgttttaagtcagggaaattactgccgtggtgtctgcttgagcaaatgggcagctgtcgtactcccaacttctttactcaattgcggaatgaggtggtgatgcgagaggcagtgtctttctgggtctgtaagtccctggaaaatggcaatgtctgataagata

SEQ ID NO: 535864 - DNA, 320 bp, Homo sapiens
gtcgacatttcttacctctatttctttgcgtgtcagtgtgtgcactcatgcactcacacataggtgccacacataggtcccacacatatggaggtcagaagataactgtcagcagaaggcccccctctctctaccatgtaggctctgggaatcaaacgcagctcatcatgtttggcagtagggaccctatggagtcatctcactggctccagaactctgtgtttgaaataagcttttcaggtgattttcccccctagctaggcaggcctctcgtcttagcaccaatagtcgacgcggccgcgaatttagtagtagtaggc

SEQ ID NO: 535865 - DNA, 145 bp, Homo sapiens
gattcctatccgacagttgaccgagtcagaacagaaaaagaaaaacaaatttaaaaaatgagaatattttaagggatttctgggacatcaagtataccaacattcacattatatgcatcccagaaggagattaataagaggtttt

SEQ ID NO: 535866 - DNA, 289 bp, Homo sapiens
aagaaataaaacagactgataggaagctctcagatcacgccacgaaccagaccccacgtgataaacctcttccctcctaggcttaagatatcagctggttgagaagagctcttcggacctgttactaccccaagctgtgtgatatacttgtctaacagaaataccttctataccaacctttttttctactattagatagaaaagtctacttttacagcagttctgtgaattacagagcagagtgactgtgggtctggaatggctggtgtacttcggaatgtactatcaa

SEQ ID NO: 535867 - DNA, 177 bp, Homo sapiens
taaaaggtttttttggcccccggtttttggaaacccccccccccctttttttttttggttttggggaaaaatttttttttgggggggaaattttgggggggggggggaaaaggggggggttttttttttttttttttttttttggggccgggcccaaaaaaggccccccccttttta

SEQ ID NO: 535868 - DNA, 97 bp, Homo sapiens
tgttctagaggatcccggtgtgtcctttgtctttttttaatggagtgttagttaccccagttacagagctgaatatcatttagagcattatgctacc

SEQ ID NO: 535869 - DNA, 211 bp, Homo sapiens
ccctatcacaccctggctatttttttttgtatttagtagagatggggtttcgccatgttggccaggtgtggtgatgggcgcctgtaatctcagcctctcaaagtgctgggatcataggcatgagtcaccacacctggccaaacgtggggatttattgtgcctattttacagtttggcgaactgaggtctaagcagctgcaaacacacaatg

SEQ ID NO: 535870 - DNA, 190 bp, Homo sapiens
aaagagacgagatgttgtggatccatctgaaatcagccgctggtgtgcgtgcttggacgggtggtagtggacagggtggtgcctgggaggatcttgagcgttctaaatgctaattacacagtgagctttgggctatttattccatgagcttctcgtctcttctcttgtacatctcgtctcttctcttgta

SEQ ID NO: 535871 - DNA, 232 bp, Homo sapiens
acctgaggtggctcttgctctcctggggtgaaagtgcctaacagtcaccatgcagtcgttcaggtgggcaagacatttggtaggagggctgaatgaatgcagagtctcgtctttttgtgtacataggaagcctagcactctgaggagtgacgagaacaagctcctggattgagtatggggactgagcccacttgcgggacctgaagcaggtcacgaggagaataattggggc

SEQ ID NO: 535872 - DNA, 202 bp, Homo sapiens
  misc_feature (12)..(12): n is a, c, g, or t
  misc_feature (92)..(92): n is a, c, g, or t
  misc_feature (94)..(94): n is a, c, g, or t
  misc_feature (107)..(107): n is a, c, g, or t
  misc_feature (115)..(115): n is a, c, g, or t
  misc_feature (120)..(120): n is a, c, g, or t
  misc_feature (192)..(192): n is a, c, g, or t
agacctactctnccctcaacttccgagaaaccagccctgagcaaaggggttctaaggtccataccaagatgacggtaatgatcagaccatcntnacacggaatgggnaggtcgtnagtanggccacacagcagcagcatgaagtgctctaaagcagagccctctgccaccagagaccgtcctcacccctganctcccggaat

SEQ ID NO: 535873 - DNA, 631 bp, Homo sapiens
  misc_feature (1)..(1): n is a, c, g, or t
  misc_feature (8)..(8): n is a, c, g, or t
  misc_feature (19)..(20): n is a, c, g, or t
  misc_feature (24)..(24): n is a, c, g, or t
  misc_feature (29)..(29): n is a, c, g, or t
  misc_feature (32)..(32): n is a, c, g, or t
  misc_feature (44)..(44): n is a, c, g, or t
  misc_feature (51)..(51): n is a, c, g, or t
  misc_feature (60)..(60): n is a, c, g, or t
  misc_feature (62)..(62): n is a, c, g, or t
  misc_feature (85)..(85): n is a, c, g, or t
  misc_feature (111)..(111): n is a, c, g, or t
  misc_feature (118)..(119): n is a, c, g, or t
  misc_feature (130)..(130): n is a, c, g, or t
  misc_feature (145)..(145): n is a, c, g, or t
  misc_feature (154)..(154): n is a, c, g, or t
  misc_feature (158)..(158): n is a, c, g, or t
  misc_feature (161)..(161): n is a, c, g, or t
  misc_feature (184)..(184): n is a, c, g, or t
  misc_feature (201)..(201): n is a, c, g, or t
  misc_feature (206)..(206): n is a, c, g, or t
  misc_feature (215)..(215): n is a, c, g, or t
  misc_feature (224)..(224): n is a, c, g, or t
  misc_feature (233)..(233): n is a, c, g, or t
  misc_feature (239)..(239): n is a, c, g, or t
  misc_feature (243)..(243): n is a, c, g, or t
  misc_feature (248)..(248): n is a, c, g, or t
  misc_feature (251)..(251): n is a, c, g, or t
  misc_feature (273)..(273): n is a, c, g, or t
  misc_feature (280)..(280): n is a, c, g, or t
  misc_feature (282)..(282): n is a, c, g, or t
  misc_feature (293)..(293): n is a, c, g, or t
  misc_feature (302)..(303): n is a, c, g, or t
  misc_feature (309)..(309): n is a, c, g, or t
  misc_feature (311)..(311): n is a, c, g, or t
  misc_feature (330)..(330): n is a, c, g, or t
  misc_feature (333)..(333): n is a, c, g, or t
  misc_feature (338)..(338): n is a, c, g, or t
  misc_feature (344)..(344): n is a, c, g, or t
  misc_feature (346)..(346): n is a, c, g, or t
  misc_feature (354)..(354): n is a, c, g, or t
  misc_feature (381)..(381): n is a, c, g, or t
  misc_feature (406)..(406): n is a, c, g, or t
  misc_feature (408)..(408): n is a, c, g, or t
  misc_feature (422)..(422): n is a, c, g, or t
  misc_feature (429)..(429): n is a, c, g, or t
  misc_feature (432)..(432): n is a, c, g, or t
  misc_feature (447)..(447): n is a, c, g, or t
  misc_feature (456)..(456): n is a, c, g, or t
  misc_feature (458)..(458): n is a, c, g, or t
  misc_feature (484)..(484): n is a, c, g, or t
  misc_feature (495)..(496): n is a, c, g, or t
  misc_feature (518)..(518): n is a, c, g, or t
  misc_feature (535)..(535): n is a, c, g, or t
  misc_feature (541)..(541): n is a, c, g, or t
  misc_feature (546)..(546): n is a, c, g, or t
  misc_feature (570)..(570): n is a, c, g, or t
  misc_feature (617)..(617): n is a, c, g, or t
ngccaaantttttatttannattntttanttntttaaaaaaaanttaaatngtcttattngnggaagggaaaggggaggttcttncaaattcccaaggaaatttcaaaaangcaaaanngccaacattanccattttcttttttnggtttactnggtnaanaacactttccttaaaaaggcatnttatttcaggtttttcntactnaaaaaattnaaatttcanttggaaaanaccctnaaancttangantagcaaaccccaaccacccccnaaaaacnancttttttttanaggtaaaannattcancnctccattttaaatggctanatnttttntggaanancttaaaantgcctgcctcatttgctgggaaaaaanaaaaaggaagtggcctttaggggananttttacttggaaanttacaanacnagtacaagtcttaanacatttaananttgctttttgaaaaacaatgcgaaantcaaaaaaaannaaacatgttttacttttttccncacaaaaacaaaaaaantatggnggggnacttaacagggaatttaaaaaaantaacacaatttttccttttagtagtccttgggtagttatgaaaaaanagtttccacttttt

SEQ ID NO: 535874 - DNA, 198 bp, Homo sapiens
ctagaggaccccccatcagcagttgcatgaataacaggcaatgtggtcatcatcctcgtgtacatcattacacagtgcataaaaaagaatgaaataatgtcttttgcaacaacatggatgcagctggatgcttttatccataagcaaattcaggaacagaaaactaaatacatatactcacttactgatgggagaaga

SEQ ID NO: 535875 - DNA, 407 bp, Homo sapiens
  misc_feature (195)..(195): n is a, c, g, or t
  misc_feature (252)..(252): n is a, c, g, or t
  misc_feature (356)..(356): n is a, c, g, or t
ttctactgaaccctcaaccacaaccagccagcagtgcaactgaacagtctgccaccacaactgcaggcacttccactgagacaacaaccacaacagccaccactgccacttctgctgaacccacaacgacaaccacagcaagcactgcgactgaacagtctgccaccacaactgcagccactgctactgaggcancaaccacagcaggcaccactgccacctatactgaacccacaaccacaaccatccagnacttacaactgaacagtctgccaccaaaacagtaggcatttccactggggctacatccacagcagtcaccactgccacttctaccaagacacccaccatgaccnacccagcaagcactgcaagtgaagagtctgctaccacaactgcagccactg

SEQ ID NO: 535876 - DNA, 693 bp, Homo sapiens
tgggcgggaggagtggcagcgtgcaaggcagcccagtttcgcgaagggctgtcgtgcgctgccgatgggccctgcaggcacccgggcacgcgcctttccccgcaaggcaacccgggaacgcggctttccctcggcgggccaaggaatgctccaaagaaggcacgggtcagcttcccgacacgaaaagggcgccgcccaaacggaaagaagccccaaggaagcgacagacatcgggcggcgaggtatggttcaggttaaatctcttcttgtgcaacggtgtttgggcccaatgcggtaaagcccccgaaaaaaagaaggggcccacaccagccgaagcgggtatttaacccacttccttgacacgaggcaacccaacaagatgtgtttgccaaaagccccactacggcgcgccacagagcgcggtcgacgcccaaaccgggggcccccacatgcgaggaccgcgaagtgtggacctccaccccacaccgacacaccactacagcgagaaaggaatttacaccgttgtgcgggaaaccacagcgggggggaaaaagcaggaacagacacttttggagtgccgagactgttccccacggccccctctgtgtattgagacaagcgcatggtgcaatcaaccagcgcgccaagtgcccacagaggttgcagtggctttataatttacaacccgatata

SEQ ID NO: 535877 - DNA, 174 bp, Homo sapiens
tgccgtccaggctgacctcgacaccttgggctcaaaccatctgcccacactggcctcccaaggtgctgtagcatctcttcctcaaagatgagccagccgtcattcgaagaggaggaaaaactggactggggaagaatctggggcaaaatgaagccaaaccgagaacgaggagaa

SEQ ID NO: 535878 - DNA, 314 bp, Homo sapiens
cctggagatgatgagtatgtgtatcataagatctgcgaatgaagcataaaaggatgatgactgaatgcagggatagactgtgctggtataatatgcatgggaaagggggagagtgtcatatggcagttaatcaaatgtgaatcacaggatggtgagagaaaaatattctcaataaaccctttaggaattggcaggttcacagtaaagcaaatttggaatattggtagaaatgcggaatcgtgggatcatcagagcgatgaaaagttagttgtcagaaaagggtaaaaggtgacatatccatatacagtcacgta

SEQ ID NO: 535879 - DNA, 677 bp, Homo sapiens
ccagggttatatatataaaagtcaaatccactaccatacaggttgacatgtcatgacaacattttcagttgcctatctacattagctaatgtgtgacatgtaatgggacaagcgtgttcacatttgattgaaataagcataaagaaaagctgcctccaaaaaagagaaaagctgtcttaaatcatgggttttatagctccagaaatatacaaagtaaggaatctcttatgacttgaacttggagggatacctgtataactgatacataacacacgggcaaactgggggagtaaccaggttgagttaatcttttctcctcagtttcgaccaggtaacagtaatgggtaccgtgagtcgtttgaaaaagaacttaaccttaaaaactagcaaaataacattctcaaataattaataaagaatcccagtagcagaaatgttttaactggcatgtttcttctttgtccgctaaaatgtattgacaccacacatggaataatgcattatgacaataattaactttttgaagttaggtgtattgagagtatgaaatgaatgaataagataaaatatccttgcatatgcatgtaagacctataaggaacgcagtattgaaaataaaggaatcaaattttacccatggaatttaggggtgggtcatcatcattatcttaatctat

SEQ ID NO: 535880 - DNA, 357 bp, Homo sapiens
ccccccccttaaaagaaaggtttaaggtggccggggcaaggtttttttttttccgaaagggcccccccctttccccaggggtcccttgggcctttttggggcccaaaaaggaagggttggggggtggggggagttttccccccccccggtgaaaaaacccttttttaaagttttaaaaggggtcctttggggggacgggttcccccgggcccccccttttttttttcccccctttttggtagggcccccgtaagaacccgtttgaaagggccccccccccctttccccctcccgggggttgggggggaaaaaaaggggttccccccccccccccggtggtggccgggtggggctcca

SEQ ID NO: 535881 - DNA, 1104 bp, Homo sapiens
  misc_feature (344)..(344): n is a, c, g, or t
cgttgagagaagtacgaggaagtgaggggactagcaagacagttcctcgagagtaggccgatggacgaggcatcggggttgaggctatttgaacagctcacatctgggccaggggctgctggggatgctcggatcagtaggatctgctggtagccaaccgaggacgaagcgtgaaagcagcagtcagaaggggaacggcatctgtgtggcccaacagacttcctgtggagtccctcatgcatgtgagcagcgttgaagttgcctctgcattacgttcaggccctgatcctaaagcccaggcgcgtctagcacccagatgagtcccatgcctttgggaatcccanggattgcgtagctccaagcgggagaagagtttgtacagttggggtgcgtagtcgaatgccatcagtcacaagggaccatgccagtcactagagcaggatgtgacgcgtccactgatcatgaactgctagggggtcgatcgaggagctggatccgcagtcattgggctgttctttttgggccgctcgatgcaccacttgccggtcagtgtcgttccctttctccgttgggcctggcgtatcctcgccacgtgagggaacgcgggtttgtacccatgggggaacattgactttccttccggagtccttgagcaccttcagctaaggaccgcagtgccctgtaagagttcctagattacctcactgggaatagcattgtgcgttgtccggcaaagggctccatttgggttccagcccaatccctctgcaaagtgcggagattcctcagagcatactctccagtggatccaagtactctctctctaaaagagaccacctttctgcaaggtgtttggccttagggcagtacacgaattacagtggggaagatggcagaaggcttcctgggactgtcccagaaatgtgattctcctgaaagccttaatgggccataaacacataaagaggggtcccatccaacaaaaaaaagacagggggcgcgccgaggattccccgagggcacaataacgacccgatatgacaaagagcccaaggagcgatatcaaacaggcgcgaaacagcgagggaagacaacgaaatgtga

SEQ ID NO: 535882 - DNA, 407 bp, Homo sapiens
  misc_feature (266)..(266): n is a, c, g, or t
cagtggtgcaatcacagctcactgcagccttgtcctcccaggctcaagctatccttgcacctcagcctcccaagtagttgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattntttaagagacagtttcgctccatcgcccaggcctgggatgcagtgatgtgatcatagctcactgtaacctcctctggggctcgcagttctcccaccagcctcctttttatttttttgtacagatggggtcttgcttgttgc

SEQ ID NO: 535883 - DNA, 387 bp, Homo sapiens
aggagcagatagcccagcagatggttatgtctgtaaactagagtatgaagtcaggaagccctgtggctctgaggccacttgtggtatcattcttttcccatatcattgactatttagaaatggttaccttcaggacagtgcagctgcatttatcagagcactattgctaagttattcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcacggatcacacaaacagtcataaccg

SEQ ID NO: 535884 - DNA, 118 bp, Homo sapiens
tggagatgaagtctcactcggtggcccaggcggtagtgcagtagcacgatctcggctcacggcagcctccgcctccttcaattctccggcctcagcctccggagtagcgggggatacc

SEQ ID NO: 535885 - DNA, 205 bp, Homo sapiens
ctattaatttccatcctttagcagggtgggccctaggcaggaagctggcttttgggaaaggagtgagaacgtgcagggcctgcctagcttgggtgctttaggaaggtggcattccgtgcttgcctccttgaggaggggggcattttgtgttttttgcttatgaagcgccttttttaaagtttggcaataaatccatttttatgga

SEQ ID NO: 535886 - DNA, 265 bp, Homo sapiens
aacaccagcgcatcttctaggtgactctagagtatccccttgcagtacggattgcacttactgcacttccccattattgtcttcaaaggatcggagctccaactccctttccaggcgtgtctcaagagttggcctatttcgaggatctcatccttaaagccactgagccccatatggttctcttcaacctctatgatgactggctcaagactatttcatcttacacgggcctctcccgtctcatcctgcattctagtcgctgccc

SEQ ID NO: 535887 - DNA, 650 bp, Homo sapiens
aaggttgaataatagtccattgtatgtatataccatattttctttatctgttcatctgcagatagaatttgggttgttcccacatttggctattgtgaatagtgctgcaatgaacacaagagtgcaaatatctcttctatatcctgatttcaattcttttggataaattcccagaagtagaattgctgggtgatatagttctatatttaatttggtgaggaatctccatattgttttccatagcagctataccattttacattcccactgacagtgtacaagggttccaattcttccacatccttgccaacacttgttttcatttttttaatgtcatcctaacaggggttaggtgatagctcattgtggttttaatttgcatttcctggattagtgatgttgagcatcttttcatatacctgctggccatctgtacattttctttggagaaatgtctattcaaatccttttttcgttttttaaccaggttatgtgttgttctgcttttgagttatagaaattccttatatgtattttggatattatttatcaaatacatggcttggaaaaatttttttccattctgtaagattggctttttactccattaaacatttcctgggctgtgcaaaaacctttttaatttgaag

SEQ ID NO: 535888 - DNA, 95 bp, Homo sapiens
gatatcgggatattattgtgtgaaaatgctgctttttctttgatgtgatctcattgatgtccacatccaagttccaataaagtgctagaatgtgc

SEQ ID NO: 535889 - DNA, 260 bp, Homo sapiens
taaaaaaggaatgaagaggctgaacgttgtgacagtgcgcctgtatcccagtctactttggaggctgaggtgggaggatcatttgagcctgggaggtagaacttgcagtgagccgagatcacatcactgccttccagtctgggtgatggagtgagaccctgtctcaaaaaaaaaagaatgtacattaaatgctatagcttagttctcccatgtggacttttaatacaggcttatgattgtccataggaattccatcattt

SEQ ID NO: 535890 - DNA, 187 bp, Homo sapiens
gccagcgggggccaatggatccgctgttccagagcaccactccactggtgtatctgtcccaacgcataacctgaacgtaatcacgaaggaacctcagacaaagcaaaactgagtgacagtctagctaaggaactggtgtgtgacctctcgcagagtatcgagatcataagaggccagggacattccg

SEQ ID NO: 535891 - DNA, 150 bp, Homo sapiens
cagccggtaccgttctttagacaaagttgtgacccattttactctggtataagggcagaaacggtcacattccattatttgtaaatgttacctgtctgttagctgtcattatttgtgctaactcatgtaatagaaatgaatgaggtgtag

SEQ ID NO: 535892 - DNA, 141 bp, Homo sapiens
gctaattgaacttgacttagtaggaccattgtgccaactcaaaacctggattagtaaaatctcaatgtttaggaacctttgttccatgggtggggttaacaggggaatgtaatccaacttgccccaggaaacccaaagggg

SEQ ID NO: 535893 - DNA, 113 bp, Homo sapiens
acagcaaggcccgtgtgagcttacagcgacgtaagcccaggagcaatggtttgggtactcactttcccctctaggtgtgccaggcgctggaggcccctagaggaaagatcagt

SEQ ID NO: 535894 - DNA, 224 bp, Homo sapiens
caactcccacatacaatcctatgctgtatcctactgccatgtgcttcagggagtaggtgtgcaagggacatatttcctccctccttccccaaatattttatctacttggagattctcaaggtttaagaaagtgctttgtgagaccgctccccacaagctttgcaactaggtatgaaacagggttatttcagacatgaaataggggggtggggtagttttgctct

SEQ ID NO: 535895 - DNA, 261 bp, Homo sapiens
ccacgacgcagttctctcgcatggtcgtcaaatacagcaacacaattttctataagtgtggttcggggggttgggaaaatcaacctcactggggtatagggggtggtttggggttgggtttttaatatttttttctgaaacagagtatggctcttgtttgcccaggctggtgtctcggctcacagcaacctcgggccactagattcaagcaattctcctggcccagactcccgagtagctgggataacaggcttgcacaag

SEQ ID NO: 535896 - DNA, 264 bp, Homo sapiens
  misc_feature (238)..(238): n is a, c, g, or t
  misc_feature (240)..(240): n is a, c, g, or t
catcagctcgctacctgttaggctgcagtgcattccagcctgcggtaacaaagtgaacctgtctcaaaaggaaaaaaaaaaaacaagaacacacagatgttcctggaaaaggaatgttccttgaggacccctggtggcattcaacacctggtggaaaaaggggaagggaacccggggtatgactggagagggacaaacctgggactggggatttatagcgcacaaacagggcattcancntgattggataaagggagattctga

SEQ ID NO: 535897 - DNA, 192 bp, Homo sapiens
acatagtattgatagtctgcctatctgccaggctatgtcggacatacttctggtgggcactgtgcggaaacttgaggatgaaatcagtgagctgcatgtcacttgacaaggcatggccgtgtctcctacacttcgagtgcaaggctccatacgcccaaatgccctgttgctgatcaattactcattgttaca

SEQ ID NO: 535898 - DNA, 326 bp, Homo sapiens
ccccatttttacaaaaaatttgtaaaattagccaggcatggtggcgcacgcctgtagtcccaactgcttgggaggctgaggtgggagaatcacttgagcccaggagttcgaggctgcagtgagccaggatcatgccactgcactccagcctggtccacaaaaagacactgtcaccccctttcccccacaagactggcaaaggctgggcagcctggggctgatgaaacaaaaatgttcgctggatcccaggccctggcacccctcaggaaatacaaaaaaaagaatattcacatttgtttaatgtgcataaagccaaggaaaggcca

SEQ ID NO: 535899 - DNA, 125 bp, Homo sapiens
aggccggtccagatcattctctcgccattcttatcttttggtttatccacatcatatagggcaccagtaacatccggtattgcagtgatgtgcatcctcctcttcccattatcctcgagcaccag

SEQ ID NO: 535900 - DNA, 878 bp, Homo sapiens
gcctaccagagccactagcgcacgaacagctcgaggggagaagcccttcctgtgcccgcgctgaggccgtatgttctccgagccttcgagccttccgtcggcagcagagcgcccatgaaggggtgaagccatagccactcgcgtagaagtgctggcttgaggacttcaacgtgcagtctcggaggtacctggcacatgcaccaggtgatgtgcaccatcaggcgactcggccgttctgaggtgcctgctaatggtgacaagtacgttacgttgtgcgttccttgtgtgatcctcaagacggactacagcggcttggtgcaacctcgtgtgctcagacggggccattcacggctgctgagtgaagtgcagggccgagaaccttcgcctgagcagttcgccagcacgtcaacgaacgcatagtccgaggtgcacgtctgcggcgtgagcgccccatttacgcgacctgtaatcagcattgtgcggaaatcctcttgtggtagtcagtctggagcctgaaggaagacacgatgcgagacctagtcgacagcctacgtgacggccagcgcaggttgtgcacccacatggcatcaagagaagcttgggtggacaggggggtttgggttgctttacccctttggtgagccgcgagttggaatatgccgtgaccgaaggtttcgaaaaatcgggcgctcccgggacgcacgacaggcgggagcggtagagggcatttgtgatggagaagccactaacccaaccaggggcgaatcgacgtaagagggggcatctctcccgcccggcgacgctcaagaggtaagagtgatttgacatcgggccacacagccatgtgaacccacagttgcgttgggcctaattaacac

SEQ ID NO: 535901 - DNA, 412 bp, Homo sapiens
ataagcttgcggccgccctgggtctgtgacgccggcgccagcgccacggtcggtggagcctcctaagcggcgcgatcctgcacgccctccgcgaccggcttctcccgcacccgcttctgaccgtcgcccaggcctgtcccttccccgctgactgccgccttttctttctgcaccctggatccccagggcgggactctgcgctggacccgggatcccacgagggccaccagcccaggggctcctgcccacccgcccttgggactaaaattcggctttgtaggagcgggtttggggaagtctggatagagactggacaaaggagtgtggccacagtgagaagtggatagcgccacagctgcggcgatggactcgttcataggaataaaatcttgctaacagcaaatgagcaaaa

SEQ ID NO: 535902 - DNA, 95 bp, Homo sapiens
ctaccccacggaggactacaaggtatacggctacgtcaccaactccaaggtgaagtttgtcatggtggtagattcctccaacacagcccttcgag

SEQ ID NO: 535903 - DNA, 481 bp, Homo sapiens
  misc_feature (108)..(108): n is a, c, g, or t
  misc_feature (124)..(124): n is a, c, g, or t
  misc_feature (476)..(476): n is a, c, g, or t
tgatgcctgtgcttccatctcaaaaaaaatcattgtaagtaattggatttttgtgtgtgtgtgatgttctgaagataggctttctaggccaaatcgtcactcaaggcnaattcgaacacaattnagtttaaatcagaatacattcgagtgataattccttacctttttaaatagttcatagaaaactttttgtagacattatctggtttaattctgattgtaatccacatgaattctcttatccacagtaaggaacagtaatttagaagactaataaactgttccaagatcacacagctagtaaaagtggaactcaacctaaaactccagagtcaagcttttccatcatgtagactcagtttaatagtaatagttaattaaaaattctagagaaaaatgtgggaaacaatttcctcacaagtgaccagctgcaaatgttatttggtattcccattaaccaaccattttattggggngcctt

SEQ ID NO: 535904 - DNA, 316 bp, Homo sapiens
tgagcagagagaatcagtgagatactgtgtacaaacgtagcttatgtaaatggtaacatgtgcagaaatataagattatatgacttaagtccctgctataactaaccattacttctcaattataaatgtaaacatttatagcatatttataaaacaaattattctatttatcataattatcttaaattcttttattagtttcagcatgacttgaaacattacttaatattcttagatatattcttgattggtgctataattgtgtcgttcattggttaaaacctatccaaggccggtaaatgattaaattatatga

SEQ ID NO: 535905 - DNA, 1167 bp, Homo sapiens
tcgttgcgctctgtcctcttgtcttcctggcgtgtttttcgttctcttttttctctcttgtcgtttctcctctctccttgtctcgtcttcgtttggtctttgttccttttccgtccttttctctcctcttcctctgtcctgctcttccttcgctctcttctcctctctcttccctcgtcttcttcctcctctgtcttccttgtctttctctccttctgttccttgcgctgaccctttctgctgtcacctttttcttttgtttctcctcgctgcttcttctctcctctctcttttctcttcctctcctctctctctcccctcgttctctctcgttcttctcttcttctcttcctctcctcctcctctttcttcttctctttctcttctctcttccttccttccttctctcccttttttctcctttctttcttcttctctctttcttttctcttcttttcttttcttccttcttttttttctttcttctctctttctttctccttcttttctttctttcttccttttctccctactctttttctcttgtttcttctccctctacttctttctttatcttcttctgtctcttgttttttcttttctttctctcttctttcttttctttcttcttctcttccttctgtctctttctttttcgttcctttttctctcgttctctttctctctctctctttatcctcttctcttctctctcctgtctccttctcctctcccactctctaccctctctccttttttcctctctctttcctttgtccctcttcctctctctctcctctcgttgcttttatttcttgcctctatcctttcttctctttcatctttttctttgctcacttctgttctcgtctttcctctcttcttactcgctccattttgttcatgtgcctctgcaataacctgcttctctaacctcttcgagtctacgttgtcttgctgcgacttgttatgtgagtgcctattctatatttagcaagagacactattactcaaagtattgttcggttaggccagattgacaccgtattgataaaccatatgcgtatattctttctgtgctatatatgaaaaataacttgcatgattatttcattccggacgtcatttctcagagattgcctacggaatcgctgcctatggtaccac

SEQ ID NO: 535906 - DNA, 676 bp, Homo sapiens
ggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaacttaattcagctgaagtactttatatttcaaaagaatgaataaccattgataataaaatcgtactttaagggggtttgtccaaaataaattttgtgggctttatatatcacactattgttg

SEQ ID NO: 535907 - DNA, 361 bp, Homo sapiens
  misc_feature (306)..(306): n is a, c, g, or t
ggatccacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactncccacactgtggagtgtactttcattttcaataaatccccttattccttccttgc

SEQ ID NO: 535908 - DNA, 195 bp, Homo sapiens
ctccttgctcatctccccgtcacacgcctcatctccccgtcaaacgcatcactccccgtctaagcatcactccccgtcgtagcatcactccccgtctaagcatcactcctcggcccgtggactgtgtgaggcctgtagcggcccccggcgcgccgggcccgggtcttcccggatttccggttgcttgcgcgaact

SEQ ID NO: 535909 - DNA, 559 bp, Homo sapiens
tcagtcggtaccgacgctctctctgtggggactacagtgatgagcgcgactgcagtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtcccgaactgg

SEQ ID NO: 535910 - DNA, 153 bp, Homo sapiens
cgccacagcttctcgagtagctgggactacgggcactatggctccccatcctgggttcaagcgattctcctgcctcagcctcccgagtagctgggactacaggcatatggcaccacgcatggctaattttcttatttttagtacagataactc

SEQ ID NO: 535911 - DNA, 738 bp, Homo sapiens
  misc_feature (47)..(47): n is a, c, g, or t
  misc_feature (75)..(77): n is a, c, g, or t
ggacgagctggccagcactaagcaaaaactagagaaagctgaaaacnaggttctggccatgcggaaggtctgagnnnctcaccaaggagtacgaccgcttgctggaggagcacgcaaagctgcaggctgcagtatgatggtcccagtggacaagaaggaagagtaagggcctcctttcctcccctgcctgcagcgtggcgttccagcctggtcacgtgcctgcttgcttcctgagagcccggtccgtctccctccagtacttcgtgtttgtgccctgtctgcttcccccattcccgttccactaggcgtcagttagctcgtctatctcgtgcccttgctccatcactctccatgacacattatccaggggcacctgattgctacatcgtttcccgtaatgcgtttgtctgtcattcctgtcttggcctggccaggcctggcacatgccttggcttccacgcctgaaggcgctggggagcacgagttaggttgtaggtccggcttgcggtcggggctgacttcctgtcgtgtttgagccccttttgttgttggcctctgggctgttgttcttgtggtcccgcagcgagaggtgggtggcagcacgtggtactggagtctcgtcttgagggcaatagaagtcgtctatggtggggctgggattcctgttccctgggtgcggcgcctactcccggcgtgaggaaccgggggtaatggagggggcgggagggccaatgccag

SEQ ID NO: 535912 - DNA, 313 bp, Homo sapiens
  misc_feature (43)..(43): n is a, c, g, or t
gcttttcgaccacgcgtcggcgagtgagggcagcgggaacctnaggagggcaagatggatacgatgacccctcgtgctggcagggacgtgggcaggagctacgagtggtgctcaaagtgctggacctagtcaccatgaccatcgccctggcttctacgagacagcagcctcatgagccaggtctcccacagcacctggcttcgtgcatgggtctgtgtgcgcggcctgaaagtagctcaaaactccttgtaataggctacggtgtggtgggtcacacctaatccccaaatgtcagaacgagcagtacgcgacg

SEQ ID NO: 535913 - DNA, 117 bp, Homo sapiens
cagagtccaaacagtgccccgagtccatacagtgcccagagtccaaacagtgcccagagtccaaacagtgccttgtggtaatgaagtgggctagggcatatataattttaagagcga

SEQ ID NO: 535914 - DNA, 183 bp, Homo sapiens
tcgaactcgagctgtataccagcacgccaggtctttgagttaagctgtggtcgtagtgtctgggcgagcagttttgttgattaactgttgaggttcagggctaagcatagtggggtatctaatcccagtcggggtcttagctattgtgtgtcagatatgttacagccacttccgtagtcaatg

SEQ ID NO: 535915 - DNA, 309 bp, Homo sapiens
gcgcgaattcatcatcctgctgcgcgaattcatcatcctgctgcgcgaattcatcatcctgctgcgcgaatacatcattctgctgagtagatcatccgttgtgcaaactcatcatcctcctatcatgtgcgggcagacgcgcctgctacctggatgccagcctgtcactgactgctgtgcttttggcgaggccagatagtgcctgacccgtgacctagcttgcttagaagcgtggagccatggccccagtgaaaccagctttctccaaggagatgacctttctgccgccaaggaaacccttttcagctg

SEQ ID NO: 535916 - DNA, 117 bp, Homo sapiens
ctggtttatgactcttaacgtgtacataggaatatgtatttgtcaattttagttcacaaacatatccataagaatgtttacacacggctgtctcctcttgcaatctgtcaatcataa

SEQ ID NO: 535917 - DNA, 799 bp, Homo sapiens
gcctctttccttgacctaacgcatccatggcctcgtgtgtcccatagaagcatctgaatgactgggtggcagctccaaagcattggatgctggaataaattgagccggtgtgtatttgctcctcgtccatccaccggatccccacaagtttgagatggagtgtctccccctcatcattttcctgaggaacagacttaagtatgccctgatcaggatgatgaacgtaccaagacagattttgcatgctgcgggtttcattaagaatcgtatggtcaagagtcctgaaatcctgatatataccatactccatgtctggcatttcataggagtgttacatgcagctattgagccaactgacagggtgagcagaagttgtccgatctgaatcttatgacgaccaaggtggtcgtctatagctgatagcatctgtgattactactcctgagcgagtgccaatgtacagagtgagtgcacatagtgaagaaatgcatcttgtgtcgggctcgagaacggaatccgctcatcttggtgactcatgtatgccctgctacacatctctgttaggcccagatccccgtcatcaaggtgaatgatgccattcagatggatttagagacttggtaagattactgattttcatcaatgttcgagcactggtaacctgtgtactggtgactggaggtgctaacctacggaagacttggtgtgatcaccaacagagagaggcaccctggatcttttgacgtggttcacgtgaaagatgccaatggcaaccagctttgccactcgactttccaac

SEQ ID NO: 535918 - DNA, 185 bp, Homo sapiens
ccggcgtggcgagcggtggggggcttcctttcctcctgggcccgtgtgctgagctctcctgggctttacggcttgacactgctggtctggggacgacgacacgtggcctcgtgctgccgctgttcttcacccctcacacgtgactaccctcctattccttggtgtcgtcttgtgcctgccacaac

SEQ ID NO: 535919 - DNA, 418 bp, Homo sapiens
tgtaaaaacgaacagtcgtattctagaaactgtatatcccgtgtgtaaacttagtggcactgcacgcctgatgcaggtgctgagatggggacctgtaaaacggcacaggcattttgagtcagaaacacatgtgactttcctgctccaaaatgtgctattcaaaagtctttcttagttgtgactaaaacaaactttgaacttactatttcaacagtattataaggggaagacccaaggaatgggactggcactgggaaaacagctaggaagctgctctgaaaagccagggagtctggaagcatcctggtactccagagcgaacaaggctgagcgcttgatgtggggcttagaggcttaaccaacttggttcgaatctagccactgacacttattagtgaccagtgacgaaaggctcagt

SEQ ID NO: 535920 - DNA, 537 bp, Homo sapiens
ggatctagaggatccctagggacgacgagtctcacgacggagagtctttaaaattaacggccggtttttcccgcgggtggctagtgagccttatctctccacttcccaggcatggtgaagacccggtttctctagcggtgcagctgcaaggtcactagacagataatctcaagtcgtaaagcatgtggttccttaaaaagtaagaaatgatgtaatgcatgtcttaactgaataacggtcttggtttctggcttctgtaatacgcttcccccggcacggatctacccccagcccaggaaatgcttaaaaggtagctggacttttggctcaaggctcagtccttgggatgttaatcggacggggttgatgcacctaaacaattaaataattccacctcaacccctcgggtctctctgattccttaattatcccgctgcagtgtctctactaaaaatgcaaaaaattagacaggcatgggggcacgtgctgtagtcccagccacttgggaggctgaggcaggggaatagttcgaaccca

SEQ ID NO: 535921 - DNA, 1051 bp, Homo sapiens
ggagagaactagtctcgagttttgaggttttttttcggaaggaaaattggtataattccaattattttaatgtacagaaaactcaacagtgtacatttaacccagttatagtgggcaagtcctttagccttggcctttacagagctgggcgatacgagccacagacttaggacccaggacatggccaccccagtgacggggggatctcatcgtatctagtcatggtaatgggtccgtgatagcttcacaccagtttagccaaagggccttgggtcttccgagattcacctggtgtgaaggcgacaggggtgcaggtcttcctgttggacatagagcgtcccagtctggcctttcccttgataatgcacgtaagggacccccatttaacgacacagggcaggcaacaagacacaccgagctcgaaggggatccagcgctcgtggtgcaaatcaccaccagcttgaagcttagcgtgggactccaccaagggggtgacggtgtatacacctccagtgctcagaaaggcacaggggggctacacctaacagtagggagaactgtcaccacttgggcacagacacagccctaatatatctggagccccggtacacacaaaaagtactcggcagtaaaattactccttgacttgggcacatacagggcctagataccaagatgatgaggcccagccttacacagccagcctgccaagatacgcagtgatcagggggcgcgccccaaggggccccttgagaatacaagcgggtgacaaaaaatcccgacaggggaaggcacacatataacagacacggattactacagaaggacagggctccttcaataccacgtttgacaaacccgtgaattatacgcaggggaccaatttttgaccaaaaaaacgggggtagaaggacacaattatggggaacataacgtgttcctgtgtccatatgtccccaaaattatactatataaggacctttttctccaaactacgtgggaaattccacacaatttacttatagccatccatgcattcattcaacgacag

SEQ ID NO: 535922 - DNA, 244 bp, Homo sapiens
gatgtagcatcgtgggacggggatatgggagaaaaatcaaatatcggccgcatcgttgtttattttacctgggtgcaggcgggctgtccgaaaaaagagtcagcaaaaggtggtgagattactagttcttataggtttgggataggcatacaaagtacattcttaagggcgggggagaatatatagtattaattagggtggggcaggaacaaatcacaatggtggaatgtcatcagttaaggct

SEQ ID NO: 535923 - DNA, 903 bp, Homo sapiens
gcaagctttccaagggagtggtagtgtgatcgccatcttagggaccaagatgtttctcggtccgtggcgcacctggcgcgggcgagaccccttcaagacgccacatgctgctgttggtgctacgaatggtctcggggacctccgcgagaagatccccagggggccacgagagaccaggccctcgtgcgtgcgctcgcaaggcgtgggcagtgctgccgaccgtgagaacgagtacagttgggaaattttgagtctccgtgaaagtattatgcacttgtgtgggatttggtgagggatcttacagtggtggatctgagacagactgctgtggattggccctggatttaagtgaaagtagccgtatgtcgtggtggaggccccaaaaaagtgagcccaggggcatgacttttgaacgggactatcttcagatttgaccaccttgtacttagcacggatgggtgagatccggtcggttccggcgtcgtaactgggagtggggctccgaactttttacctaggggcttaacatactcaatgactagggggaacttcagcctcatgtattgcgtcctatggtactcgaaggtgcgtttctcgaacgtcttttgctgataaggcaaaagtatggctgtggactcaaggggcgaaccttagatgtagtgtttgctatgggaggaaatgtactattgattattaaagggggtgcccttcattagtcaggttgctgaatacgtatggggggacaattgagcttctgggtagcgttaatgggaaagctgatttaaagtgttccggaactttgaatggtctagggcagggaaaaagccaaacattgtttgaggggaagtgcaagttcccgaatatggataaagggcaataaggggttaaaagggtgttctagca

SEQ ID NO: 535924 - DNA, 1023 bp, Homo sapiens
  misc_feature (37)..(37): n is a, c, g, or t
aagacgccccttttgttggcctgttggtttttgtacntctactgctttggtttgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggagga

SEQ ID NO: 535925 - DNA, 143 bp, Homo sapiens
ctggtggggggaaagtgaacagttcttgatgcccacgttgcatgcctcgtagcagcttgtgaattcgtgctgggatcatctggcacaatgggcccgagcaggttggggccagaccctgtatctgctgtagagatattatatgg

SEQ ID NO: 535926 - DNA, 139 bp, Homo sapiens
atacttcaactattgtgcccggcgcaagctttgctttatcatcaaaaacctcctgccagacaatggatccctgtttatggttgcaataatatccaaaaccttttgaatgtagaaagattctagtttcttaaaatctgtg

SEQ ID NO: 535927 - DNA, 459 bp, Homo sapiens
tgtggtgtcatcggatgtgtccccctcgctccaactgagctgtacagcgagtgacccaggctgggactgacccctgctgagaagtaccaggcggtcttgtccctctgcctgaagcccagacagtgctctcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtcagcacttctgcatttggctttggggtgcatgctggagttggaggtgtgaagctatggcaccaggcaggggcttggggcatgcctggcttgtcctacagaatgggagggcctgtcctcacagacctgcacgtctctgcccccgtggctgaagaggtagattggtacagc

SEQ ID NO: 535928 - DNA, 2101 bp, Homo sapiens
  misc_feature (62)..(62): n is a, c, g, or t
  misc_feature (68)..(68): n is a, c, g, or t
  misc_feature (73)..(73): n is a, c, g, or t
  misc_feature (1928)..(1928): n is a, c, g, or t
  misc_feature (1936)..(1936): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 535929 - DNA, 1954 bp, Homo sapiens
  misc_feature (62)..(62): n is a, c, g, or t
  misc_feature (68)..(68): n is a, c, g, or t
  misc_feature (73)..(73): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggaggctgaggcaggagaatctcttgaacctgggaggcagaggttgcagtgagctgacatcacgccagtgcactccagcctggctacagagcaagactctgtctc

SEQ ID NO: 535930 - DNA, 231 bp, Homo sapiens
gggacaaagcgccggtgcagcccagcagtctccagtcggggccccggggcacggacgagaagccgagcggcaaggagcggcgggagtgccggggacagggacaaagaacaggagctgtctgaagaggataaagcagcttcgaagatgaacgtggagatgcgtcgtggaacgactaggggacgaaggatacatcccgtgtatcgaccagcgctggaggaattgcgaaggcag

SEQ ID NO: 535931 - DNA, 1359 bp, Homo sapiens
  misc_feature (62)..(62): n is a, c, g, or t
  misc_feature (68)..(68): n is a, c, g, or t
  misc_feature (73)..(73): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggagga

SEQ ID NO: 535932 - DNA, 153 bp, Homo sapiens
catgacataggacgtgtgttgctaacactgtaggaccagcacctgataaatgtcgcatctctgatgagagcttaataaatagaaaacacttaaggaagaaagactcgaacccattctcggattcccacggagaagacagccctcattactgca

SEQ ID NO: 535933 - DNA, 794 bp, Homo sapiens
ggctctgcactgccccgcaggtagcgcccccgccctgcgtgtccatatgtgctgctcgctgccggcaccatgtctccctggattaaactgtgcgcgcctgcgctggaggatatcagccgatggagatgaaggcgaccgaagagcggggcgcagtcgtgcgccgctgcccatgggagggatgtggacatcagccccaaacaggacgaaggcttgctgaagggtcgtcaagagagagggctacaggtacatgagatgcccatgattggggaccgagtctttgtccactacactggctggctattagatggcacaaatgtttgactccagtctggatcgcaaggacaaatttctcctttgacctggtgaaactggggaggtcatcaaggcttggtgacattgccatagccaccattgaaggtgggggaggtgtgccacactcacctgcaaaccagaatatgcctacggttcagcagtgcatgtcctccaaagattccccccaattgtccagcgcttgtatttgacggtggagttgtttgagtttaagggagaagatctgacggaagaggaagatggccgggacatcatttcgccagaatacagactcgcggtggcggctattgctaagcccaagtgagggtgctactcggtggcgggttgccctggaggggtactaccagggcgcgagttttttgccggcggggcccggtttgacattgcgcgggggcgccggtgttgcctatggctggggggcctggcctgggcagggggttccccgttccagcccgtttttggtt

SEQ ID NO: 535934 - DNA, 1822 bp, Homo sapiens
  misc_feature (62)..(62): n is a, c, g, or t
  misc_feature (68)..(68): n is a, c, g, or t
  misc_feature (73)..(73): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcacagattacaggctcatgcctgtaatctcagcactttgggaggccaaggcaggtggatcacctgaggttgcgagttcgagtctagcctaacatggagaaaccctgtctctactaaaaacacaaaatcagcctggcgtggtggcgtatgcctgtaatcccagctactcaggaggctgaggcaggagaatctcttgaacctgggaggcagaggttgcagtgagctgacatcacgccagtgcactccagcctggctacagagcaagactctgtctc

SEQ ID NO: 535935 - DNA, 475 bp, Homo sapiens
  misc_feature (163)..(163): n is a, c, g, or t
tttagaaaacctgaaagctaatcgaacatcttgaaagacaagctagtcactctggtaaacagctagaaaaaaatcagtttggagaaaattgagaaagagaccagactttctccaggagctgcaacataggaattgtgtatttaaagcattacggacagcaatntgatgaccagaaataagtgcaaaaacatatgatgtaataccataggatacaaagaaatgagtatgaccacacttaatgacaatctataattttaaccatttattcaagattctactaagtgtaaaattatttaataatgtctattaaattgatatttatatcttgcatcctatatcatgtcaatatgtgatatagaaaagagaatacgtgaattttttagctaagcttgacagattgaaagacaagtgtcatttttttttgtagagggtgatatataccaggaaatgaataaagacattttaaatttaacac

SEQ ID NO: 535936 - DNA, 2490 bp, Homo sapiens
  misc_feature (2317)..(2317): n is a, c, g, or t
  misc_feature (2325)..(2325): n is a, c, g, or t
tgacatctggtcggaccatgtctaaagagttgaactgtgtgcaggtatgagcccttggttctgccagtgtctggggagttgagcctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 535937 - DNA, 563 bp, Homo sapiens
gcgggcgggacatcggcccgggtcctcgccgcgccgcgccgcgccgcttcggcgccgcagcccgggagccggccacccctacacgcgccaggactgtcccctgcgctcacaatacacaaagctagtaagcagcgatcacgagaaattgaccagagcatgactagagaccgagaacatcgagtacgtgaaacaatcgaacgaaggacaaggaagactacgcagaaaccaagagcaccatcaacgggaaacacgaaaagcagaacagacggaagacagcaaaaagcaaaaagcaccagcgcagacaagagcaaggaagaacacacaagaaacgagagaagaaaaagaaaaaaaaaacgaaacaaagagacaacagaggaagacaaaacacacagagacgaagcaacacacgcacaaaagcggcaccacagcacagcagccagcgacgagaacaaacacagcaacaaaaccagaagcacgagccgaccaacagcgcaggaggagcacaccacaacagaagaagcaccacacgggcaccgcggaaccgacggcgaccgggaccaccg

SEQ ID NO: 535938 - DNA, 1919 bp, Homo sapiens
  misc_feature (41)..(41): n is a, c, g, or t
  misc_feature (1746)..(1746): n is a, c, g, or t
  misc_feature (1754)..(1754): n is a, c, g, or t
ggggaacacaacttaggctaggtacgaggcctgggtggtcnggctatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 535939 - DNA, 2309 bp, Homo sapiens
tgacatctggtcggaccatgtctaaagagttgaactgtgtgcaggtatgagcccttggttctgccagtgtctggggagttgagcctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggtgagtgtgtttctgtgtcttgcagcccctgtgggagacagtgttgcagtctaaggtcggggtagggggcttgtgtccctgaacatcatgctgtcctcacaggctgctggcctctctgcagctggctgggatatttatttcatgtccagaaggaaggtctgggtttttttgcgtgtgcaagttggcccccgtctttgcccctcacaactgcagtcctgtttctctcctatcctaggcagagtcagatccctgcactcagggccacctctcactggaggggctttgtctaggtccgagtcctcccatgtcgtatcttctggctctccatgcagccttccttcgttgcagaaggagctgtgcccactgcccacaggacgcagggtgtggccacttctgttgactctgcttttgtgtcacaggttttgacaacttcgagcagctgctctcgggggctcactggatggtgagtgctgaggctggttctctgccaagtgctggccagaggcgcgtgtgttggtcctggtcccccgctttctcccccactgtcctgtccctcccctccccgtgcagctgctcagctcccactcatcctgctcctgtttcaggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggagga

SEQ ID NO: 535940 - DNA, 231 bp, Homo sapiens
ccggagtgcaatggttgatcactgctcactgtagcctctaccttctacctcaactgtcctgagtagctaggactacagattgtgtaccaccatgcccagcttatttttgtatttttgtagagatggggtttcaccatgttgcccatgctggtctcatacccctgagctcaagcaactccaacctgcctcgtgcctcccaaagtgctgggattatcagtgtgagccattgca

SEQ ID NO: 535941 - DNA, 1875 bp, Homo sapiens
  misc_feature (33)..(33): n is a, c, g, or t
  misc_feature (64)..(64): n is a, c, g, or t
  misc_feature (114)..(115): n is a, c, g, or t
  misc_feature (1702)..(1702): n is a, c, g, or t
  misc_feature (1710)..(1710): n is a, c, g, or t
ggttattggggtttaatccccaagtcctaaccnttaccctgctttcaggctatggctgtctccntcttgggaaggaaaggagaagtgttccgccgccgtggcttgggctggganncctggttgggtgatgatgtgggtacattcgactgctttgcccgcctgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 535942 - DNA, 923 bp, Homo sapiens
ggaaaaaaagaaccattggatacataggtatggtctgagctatgatatcaattggcttcctagcggttatcgtgtgagcacaccatatatttacagtaggaatagacgtaaacacacgatcgatatttcacctccgctaccataatcatcgtatatccccagtcggcgtcaaagatatttagctgactcgccacacatccaaggaagcaatattgaaatgatctgctgcagtgctctgagaccctaggattcatctttcttttcaccgtaggtggcctgattggcgatgtataagcaaactcatcactagacatcgtactacacagacacgtactacgtggtatgggtcacttccactatgtcctatcaatagagagctcgtatttgccatcatagcgaggcttcattcactgatttcccctattctcaggctacatcctagaccaaacctacgccaaaatccgatttcactatcagtattcatcggggtaaatctaacttcttcccacaacactttctcggctatccggaatgccccgaagtaagtcggagtacctcgaatgcttacgccacatgaaacgtctatcatctgtaggctcattcatttctctaacagcaggaatatagagtaatgctcatgattgagaagccttcgcttcgatgggaaaagtcctatagtagagaaccttccataaagctggagtgctatatggatgcccgccaacctacaggaatggagacccggatacgtaattgtgaaaaggaggatctgagccccaagctgtttaagcaacccaggggccgagagttttcacaggcaaaaacaacaaaaacgttgggggcccacaaatttaaatggggcgggcaaagatattgacgcgcagaacgtgtaagtggtttcaacaccggcagataccaggttt

SEQ ID NO: 535943 - DNA, 751 bp, Homo sapiens
  misc_feature (48)..(48): n is a, c, g, or t
  misc_feature (54)..(54): n is a, c, g, or t
  misc_feature (152)..(152): n is a, c, g, or t
  misc_feature (279)..(279): n is a, c, g, or t
  misc_feature (299)..(299): n is a, c, g, or t
  misc_feature (383)..(383): n is a, c, g, or t
  misc_feature (456)..(456): n is a, c, g, or t
  misc_feature (503)..(503): n is a, c, g, or t
  misc_feature (547)..(547): n is a, c, g, or t
  misc_feature (561)..(561): n is a, c, g, or t
  misc_feature (563)..(563): n is a, c, g, or t
  misc_feature (575)..(575): n is a, c, g, or t
  misc_feature (620)..(620): n is a, c, g, or t
  misc_feature (741)..(741): n is a, c, g, or t
cggctccacgcaccagcaggcgacgcgagaatggcggcagcttcagcngcggcnatctcacgagcatggtcgctgtcggctaagcaagattggagctcactcgtcgtccacctccagctcgacgtaagcggtggctgtgcgactgcggccantttgtggaatggaacaagcagggatcatatgtgaatcccccctgtgtagcggggcatggacagctcgctctctagagattgcctaactggaggaaccaccaggagactctcaaatacctagtttgantgcctttctatgcgggggangaagtactcagcaggacatactatgcaggttacagtgcagcccatcctaagcgcacttgctggaaggcgcagaatgccagtttncttgcctatgaacccacaggagctgggcacacgacgcacacaatgctggagcagcccagagcaacctggggtnatcccgcgggctctcatggacctccatgcagctctacaacggagganggtgccgagcggccggccatgggaccctcttacagttcaccatntgttaacctaagananctaacctagganaaaggtcattagacctcctggtaccctggcttcggggagacctgngtaatccgagaagactgccggggggaatatcctgattccgggtctctcccagaagcccatcagtagctttgctgattttgagcggcacttcctgccagccagtcgaaatcggactgtaggngccacccggt

SEQ ID NO: 535944 - DNA, 474 bp, Homo sapiens
tttccctatgctggcaggctggtctagaactcctgagctcaagcgatcctcttaccatggcctcccaaagtgctgggattacaggcgtgagccatcacgccgggcctcagggaccctttttaaagcactttatattcattaggtggagtcacatgtagctgtcattcttataacaggaaaactgtcaaatactagcaaaagtttatatggggtggcctaatacctggttaaaccttaataaaaggttatgaggtgataagaaaaagctcagaaaggttatgttggcttaaagtacctggttaataatcgggctccagatacctgttttaagcactaagctataacacgtgccctttctttcttttttttggttttttggagacagagtctcactctgtcagcacacgggagtgcaagggtgtgctctgggcttaccgcaacctcggcctcccgagtagctgggactacgggcgc

SEQ ID NO: 535945 - DNA, 575 bp, Homo sapiens
actcagtgaggtgaatactattactatctcaattttacagatgcaacaactgaggcatagagaagtcacttgcccaaggtcacccagcaggtaggtgagctgggcttcagtgcggccctgcctctgaggtggagtccctgcctccactgttgctggatcctcctttagctccccgtggctctgtttccggtagaaggtagaaggctgcagggaaggaggctggggccaggggtggtgtttgcgcctcggggacgcctgcagctggcactgccctccacccagctgataactacagccgggtctggcacgaagccctgcctggaggtgggcggcctgcggcggcggggggtctggctctgcgttcgcccctctcagccccgcctcgccccctgcggggtcagtgcgggtcccgcccgcccgggcaggcgccggcctctcaggcggtaaccgggtaaccgtgggcaggggcggtgccgcgccgggccgcggcctcccggggaggcgggcgggtggggaggtcgagctggagcgatgtgagaatgcggaggagaggcccgggaaacaggctgcggccg

SEQ ID NO: 535946 - DNA, 212 bp, Homo sapiens
  misc_feature (27)..(27): n is a, c, g, or t
  misc_feature (35)..(35): n is a, c, g, or t
ctcattacttatacttcctctcacgcntatacgtnttctcacgtttatacttctctacgctttatacttctcaacgctttatacttcctcaacgctttatacttctcaacgctttatacttcctcaacgctttatacttcctcaaagcttcatactcctcaacgctttatacttcctaccgggaaatgaaatgagaagtataaagcgttgag

SEQ ID NO: 535947 - DNA, 102 bp, Homo sapiens
atcacgccattcttcagccagagctggaagcccaagcgcccacggtctgggcggccacatcaggccacactgactatgatccatccagcaacgatcaccgtt

SEQ ID NO: 535948 - DNA, 159 bp, Homo sapiens
aaaaaaagggggggtttatttgggatttatttgggttttgaggtcctcccaaggttttgtgtttttgatgctaaaaactaaagtttgtaaaactgtagaaagccaaacccggggatggttaactgtttttttaaagggaaataaatctggttttgggga

SEQ ID NO: 535949 - DNA, 227 bp, Homo sapiens
ttctagaggatcccttcgattggcgggcaacttagcagggacccatctctacaaagtatttaaaaaataaaaaattagctgggtgtggtggcacacaagctgtagtccttgtagctacttagggatgctgagactagaagatcacttgagcataggagttcatggttgcagtgagttagatcacaccactgcactccagccttggaaacagagcaagaccatgtctc

SEQ ID NO: 535950 - DNA, 493 bp, Homo sapiens
cacattacactggttctttatcatactaataactctaattaattttcctttccctaccaaaaaatgaggttcattaaggtaggaactcattccatctttatcccagctacttccctgaatttaggacaatgccctgcatataaacaggcaatacctttttagcatttccttcaccaaaaggatagaaaaaatttatattcttccaacaaaataccttgagagggaaaaaatgacaactgtttaccatggataaagctccaaacaccctgttaattaaaaccattcaaacaaaaaagggacctaaatttaaaaatgccaagttttataaaggccaacaaaaaaactaacgtttttttttagaatgtccaaaataatggctacttttgggttcggacaaaacttttttttaatgggaaaggggggaaaaaaaggtcctcctgggaatttcccccccgtttcccaccctccttgggccctaatttggggtgggttc

SEQ ID NO: 535951 - DNA, 416 bp, Homo sapiens
  misc_feature (403)..(403): n is a, c, g, or t
tttttttgagatggagtactcgctctcttgcccgggctggagtgcagtggcgcgatctcggctcacctgcaacccctgcctccccagttcaagaggttctcctgcctcagcctcccgggtggctggaattgcaggcacacaccaccatgcccagctgctttcttgtatttttagtggagacgtggtttcaccatgttggccaggctggtcttgagctcctgaccttaagtgatccgccagccttggcctcccaaagtgctgggattacaggcgtgagcaccgtgcccaggctgttttttaactgactttggattttactccctttctatgcaaatttattttagaatctgttccttaaccttagggggttgggttagacaagtttcaagggagcctcaagtgnaaattgcttaagg

SEQ ID NO: 535952 - DNA, 645 bp, Homo sapiens
ggagcactgggactttttattctctttttccttgagtggtaccaacagatgcaaatgcaatctcgccatttaactttacaggtcgatttcctttcctgatgcagacatctgtggtgcccccttctaggaaggaaaagaatacagctacgatgtgccaggcactgtgttaggcgcttttatatagatcctcgttaggatgagactaagggatgaggacatctctttataaaaggtcccctaagtaatggataagcagaaacacttagaggtgagaaggtctgtcttgcaatgatccaaggataagattgccttacagatctgatgtttgtgtctcaaggacttatttccctatcaagattctcccactccatacttgctccttctaccccaacatgtgctcccgtgcactcctcagatggtcagaggggtaactccaagtccttagagaaatttggggaccaatagaatatgtgaatgtgtgaatattctttaatcaaatcttaaggagtctttgcgaccttctggtaggagagttgtttggcattcatattagaagccagatctcactatgtatcgacaggttgggctgtgtgtgtgggcctgtgtgtatacaatttccagggtgtctgtgtctgtagcttttga

SEQ ID NO: 535953 - DNA, 289 bp, Homo sapiens
  misc_feature (10)..(10): n is a, c, g, or t
  misc_feature (19)..(19): n is a, c, g, or t
  misc_feature (279)..(279): n is a, c, g, or t
ggttctaccntgcccggcntgatggtgaaagggcccgtagttctggggaagaaccgttcggccaacggcagcgccaaaagccctgaatgcggcggtttttgcggcgcctcgtccaccatcggcgggctgctctactcagagcccgagagcggttgcagcagcgacgacgagcacggtgatgctgggatgagagtcggagccgaatacctcgctcggatccctgaatttgatccaggtgctacaaagttccctgctcttgaccgtggagggatgcttgtntggtctcctt

SEQ ID NO: 535954 - DNA, 208 bp, Homo sapiens
ctgttactcgagaacctgaggtctgatcaaaagacaacgatgccgagcgtctgttcacccgatacgccaccaagtgctacacgtcagccttgcaaaatatgccccggagatcagcgaaactttcctattacctatctggctggcctgagcttggccgaaagttacgctggcagttacgcgaacattctagggccgtcccaggcgccca

SEQ ID NO: 535955 - DNA, 396 bp, Homo sapiens
gactctcgaggctcccctcgtgttatccccactaccaatgtacaaagattcccttttctccacatactaaccaatacttgttatcttctgtctttttgaatagccattctaacaggagtgaggtgatatctcactgtggttttaacttgcatgtccctgatgattagtgatattgagcatcttttcatatacctgttggccatctgtacgtcttgtcaattcagtttctttctccttttttaattgggttatctgttttgttattaagttccttatatattttagatatcaaccccttatcagatatatggtttgcaaatattttctcccatagtgttgattgtcttttcactctgttgactatttcctttgttatacagaagctgttttagtttg

SEQ ID NO: 535956 - DNA, 960 bp, Homo sapiens
gcgcagccattttggtttcctgaccttgggctactggctgaccgtttattgtggtgtactccgtgccatcatgtccgtcctgacgccgctgctgcttgcggtgcttgacacggctcggcccggtggctcccagtgccagcgctgccaagatccattcgttgcctgccggaggggcagcttgcggatcctcggaattgcgccgttgcggcttacctcctgcttcgtgaccttccttcctgccagcgggctggatcctgtcacagctggtacgatgctacaggacggccacgagtgaacggggtccgttctgtccctcacactgtgacctgagccagcaccaccggcccatcctggtcatgtaactgcatttgtggcctgggctcgcctggatcatgtcattcaattccagtcacctcttcttgcaatcatgacctcttgatgtctccatggtgacctccttgggggtcactgaccctgcttggtggggtcccccttgtaaccaactaagaatctattttacaactgttaacgcacaaaccaaaccaagcaccttcccgggggtactcaatttcccggttcgccgccacacagacgtacctggacattggcgccatgggccactacgtgcgaccctgacccagtgtgctgtgatcaccaaaagtcggtcacaaaatcgtgccgggatttcaccttttaacgtgaagcccacaatacattttgcaatgacaccccggttgaacccttgcacatttactgcaacctcgcgaaaaaacgacgcccacgaccataaaacgcagcgcgccgacggagcagcccagatcgaccaaggagccccgaattgcaccaacccagtgccacgacacccacaaagctagtgaccacgccaccatgccaaggaaacacgctgctaacccaccgatgccgcccgacgacccgcccaagcaggcccgacccacaggg

SEQ ID NO: 535957 - DNA, 752 bp, Homo sapiens
ggtgttggcttggatggtacctaccgcatcagttaacagaaatacaggagaaatggcgtgattcacgacgctggcagctctctgttgcactaacagatgcaaccagaactggagatggaccatggggaaggacttataggagagtctctcagggtgacgacgccgtggaaggcagtgcggagagctttcagagggtagcagcgtggacgagaaacgagttaagattcagatggacaagcgggaaggcagtagagagccctgagcaggacagcgatcaggaggtggtgacaaaagtaacgatgatgcacgagaataaagaggccagaagctggagttttatgtaaatgcgatttggtctataacttgaataacactagaagatttatattgcagaaagagaatgatggttgggcaactataggaactgatacgattatattcttcatgcagagttaaaaagcgccttgtgcctcctttggaccacttgccaagtccctgtctctttcagacacagacaagcttcatttaaattatttcatctgatcattatcatttataactttgatggtcacttcatcagtttttccttttgaaaggtgtatgaattcattacattttattctaatgtattatctgtagattagaagatcacaatcagcatgtatctgcctatactttggagttcagctgtctttatactcaaaagtgtccttaatagtgtcttgcctgaaataaatactaagggggtgtac

SEQ ID NO: 535958 - DNA, 144 bp, Homo sapiens
  misc_feature (1)..(1): n is a, c, g, or t
  misc_feature (97)..(97): n is a, c, g, or t
natttgactgttattcctcattcccagaagagcatttcatcagtcagtgatataagccttatcttatctaaagcatcagaagcatatgacatcagtnctctcaggacaatctctttatatttatacaatgaatcgatgataagc

SEQ ID NO: 535959 - DNA, 216 bp, Homo sapiens
aaccttgcctggtgttatcctccatctctaggctgtcttgggacgtacctgccaccgaggcagcccctccacctccagagccagtccctggcctgcacagtgccccagcaactggtccagtggtgtggaggactttgttcctgactgaccgcctggaccgcatgcttcctggaaggacacacacccccgccatggcacgatgaagaatggtgtggg

SEQ ID NO: 535960 - DNA, 298 bp, Homo sapiens
  misc_feature (61)..(61): n is a, c, g, or t
ggtttcaggaacagcccttcccccaccaatgggaccctccccaggctggagagtttatcantacgtaaggaaaggtccttccgcccctccaaagcccttaccatgcctaacagaggcatgcatttttaaatcagattattcaaggacttttgtttaaaagatgtttataatgtttgggaaagaggataggatgggaatgctgcctaaaggaagggctggtgaaaggtgtttatacaaggttttattaaccacttttaagggtacacctccctccaaactactgcattttttatggatt

SEQ ID NO: 535961 - DNA, 171 bp, Homo sapiens
gacctagagttactgttattgccaacacccatcatttacgattcttcttgccacaatcactaaatatctagtgctaaacctatcttgtattggcagcacagttactcagatctgcactcctgtctcttgggaagcagtttcagataaatcattggggcattgcttggactt

SEQ ID NO: 535962 - DNA, 405 bp, Homo sapiens
  misc_feature (29)..(29): n is a, c, g, or t
  misc_feature (329)..(329): n is a, c, g, or t
gagctcgcgcgcctgcagggccatgggcnccgccccgcccgttgttaccggtattgtaagaacaagccgtacccaaagtctcgcttctgccgaggtgtccctgatgccaagattcgcatttttgacctggggcggaaaaaggaaaagtggatgagtttccgctttgtggccaaatggtgtaagatgatatgagcagctgtcctctgaagccctggaggctgcccgaatttgtgccaataaggacaaggaaaaaggttgtggcaaaatggcttccatatccgggcgcgctccacccttccaggtaatccgataaaaagatgtgtcctgtnctgggctaaagttcaaaaggattaaggtcctttgaaaccacagaacttgcagggtaattgaaatttattcccccca

SEQ ID NO: 535963 - DNA, 293 bp, Homo sapiens
gtatgtcagcggctgtgggaatctctgggtggtagcagactttgagacagaggcaggtgaacgtgctagtatctctctctgagctcttcgcttcaacaaggccaggcttcacaggcggaagctcagaagtagacgaaaccgcgctggactccgatgaccctgctgatgtgaaactggactccgatgaccctgctgacctgaaactggactccgatgaccctcttgacctgaaactggactccgatgaccctgctgacctgaaactggactccgatgaccctgctgacttgaag

SEQ ID NO: 535964 - DNA, 258 bp, Homo sapiens
agtctgtcgatcagagtctgcagctccttgcagagagggcaggactgggtgagtaagatgcggcgtttggaagagcggtggacttattctgagacaagattatttgccggtggcttcctggtcagtaacttccaattttggcctggccttttccagtgtgggaaggcccatggtccccctcactgggaattatttctgggggggttgcatccaatcctggaaaggggtggggaggagggagggcaacagaagggacag

SEQ ID NO: 535965 - DNA, 447 bp, Homo sapiens
agcggtccacgggcggaagaaggcggcggcggcggcagaagcggcggcggcggcggcggcgggagccgaggaggaggttccggacgctgcttaggaaccggggactcaggagtgcccgcgccctgagcgctcagctccagacggcgtcatggctgagtacgggaccctcctgcaagacctgaccaacaacatcacccttgaacgatctagaacatgctcaacgtctggcccctgcaaaatggcaaacgaccaatcccccccagccgaacaacgacgtcgaggacgatcactacatggcagtgcctgcgtttagcttcctggagagccacaacaagctggacaaagacaacctctcctacattgagcacatcctttcgagcaattcgttccccctgccccgggtccccttgaaacccttaacttcaacctaatgcgtggcgtctgacc

SEQ ID NO: 535966 - DNA, 794 bp, Homo sapiens
gagagaaggccggaggggtcttgcggtctgtagtggcgctgttggaggccgtggcggatccgtaagctgctggttttgcggctggaaagagcggagagagggtctcgggcatttcttctgtcgggatcgcccgcgaaggatagttagtggtgcatggatgatgtgctctaccgtcatggtgatgaagctgtgtcataccttgctcactgaagatgaagaatctgggtggatctagcaatctgtggagggccaggagatctgggggctaatgaagcaggagagaaacaagaagttcttgagaacttatgggtgcgggaaagaaagaatatactggccgtcttgtttataggagatcacaaatcaacatctcatttccgaaccggggaagaagacaagaaaattaactgaagactgaagtctccaatatcagcaaagtatggaacagtaaattatcaggaagatatcgggacattgtggacttggcttcagtgaggtagaagaccatgatggagaaggtgatgtggtgggagattgatgattgatgacgattgatgattcactgatcctgaaagtccagatgattctgaaaagcgattccgaagtcagagacagaagaatctggtgaaggaatccaagctggtgaagcaccttgatgaagtggaggattccaaaaacaaaaaaagatgcaaaagggaatttttacaactgatgtttgttaaatccagtggttcataactccagaggttagttttggtttaaagttaggctttttgttaatggcccgggggggctgg

SEQ ID NO: 535967 - DNA, 274 bp, Homo sapiens
actctagaggttccccattccaaacagccccccagcagattgcagcggacatccctagaagtggttgtttcccttgcatgggacgaaagcttggatccaagcatccaggctcaggaataaacatggcctgctatagcagaataccagcgtgcatcgcaggagaacgtcgctatggaacctgcatctaccaggcaagactctgggcattctgctgctgagcttgcagaagaagaaaaatgagctctaaatttgctttgagagctacagggaattg

SEQ ID NO: 535968 - DNA, 579 bp, Homo sapiens
cgtctacgacgcccagaagagcgcccaagaagaaaagggccataagtggagtccctgtgctaggattttctcatcatagctgtgtgaggtgggcgcacaggagatcgatgggctatcagagaagaacatgtgatcatccaggccgagttctatctgaatcctgaccaatcaggcgagtttatgtatgactttgatggtgatgagatttgccatgtggatatggcaaagaaggagacggtctggcggcttgaagaatttggacgatttgccagcttggaggctcaaggtgcattggccaacatagctgtggacaaagccaacctggaaatcatgacaaagcgctccgactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagtcccactatctccccttcctgccc

SEQ ID NO: 535969 - DNA, 220 bp, Homo sapiens
agagtttgagctggaggaatcttacaatggcaggttcattctgggaaccatcatgaatacgatcagggtggtgactcttcagctgttaaaccaacaggagcaagagaaggaagagagcagcagttaagaagaagaagaaaaagcagaagagcggctacgaagaccttcccaggagcagtcagtctcagccagttctgggcagactcaagcacgcttgaat

SEQ ID NO: 535970 - DNA, 1009 bp, Homo sapiens
tcagctagtacgagccggtggtgaatcggccgagggtgctgtgctccagtagcttcgctccatcagggttggcatcatctgatggcatgtcaagtgtgcccagcagcggatgctgaagcaccagagctcaaggccttcacctgctctaggccagccctgtcaccacctccactgtccatgaccaggccgaaggcagggaaccgccctccccagtcccggctgtccagcaaggccccgagacttttcttctgtgatttccaaaagctagggcagccgtgcgtgtttatagtttccgtctccgatcccgtcctaccttcccctcccggctgccccatgaagtttcctatcattccatgtgagaaggctgtgtttccacctgtaatcctacgcatctttgcccagttccctagggcatgagataagcggagggcccgacctagggaccatatgagagagtagtgaagacggggacgagccgggtagcgaatacaccaccttcatgacacccgggccttctcctgcccttcgtcccgcggcgggcccgagcgtggtgctctcctgcgggacctcgtcgcgggtccttgggcctgcccattccctggccctccgcgctgccatcgtccagaatcctgacatcgcgaagcggcgcggggattgttgggtcgcgcctgttgccccggcccttttcttcttccccttcccttccccggtcctcggtgtccccgcgtcggctccccacccgcctgctcctgttgccaggctcctctggtcgccatgatgtgccttccttggggcccagctgactggctttgccgtggctgggtcgtcctggtcttgcatgagaagcataggtcgactggcctgtttgtatcctttgctggtcttgctagggccccgggtcgttcccaggttgctgaacccgggagtccaccgatcgtactttcctgccccggacgaactcttgacggggcctctacccggtcccaccactggtcatccccggatacca

SEQ ID NO: 535971 - DNA, 156 bp, Homo sapiens
  misc_feature (107)..(108): n is a, c, g, or t
  misc_feature (133)..(133): n is a, c, g, or t
ttgtcacacgcacggagtgggatcttgacgatctcgtcgatcagctgcctcgcagcacgccgcgtcgttgacgtcgagcaccgcgccggcgcccttgagctgctcgnnggccaggtattcgccgatcgcggcngcgcccttctccggtggcgtggt

SEQ ID NO: 535972 - DNA, 312 bp, Homo sapiens
gcgatgacagagccgcgagcgggcggggccgtgcatgggccaaatcactgcccgcgtgaatacggcgactgattgtgatgagacagaatctgggggggtcacccaggcgggagtacaagggcacaatcccagctcacgtgcaacctccgcctatcaggttcaagcaattctccagcctcagcctcccgagtagctgggattacaggcgcctgccaccacgccccattaatttttgtatttttagtagagatggggtttcaccatgtaggccagactggtctcgaactcctgacctcaggtgatctgcccgcc

SEQ ID NO: 535973 - DNA, 365 bp, Homo sapiens
  misc_feature (326)..(327): n is a, c, g, or t
atctgtttaagtgtgcatgttatgtgtgtgtctctgtgtttacagatgtgtatgtgtgactcctgctattcaccctagggcctgacctagtttgagtatcattttgtttaggacatgtatccattactgaaggagctaatgtttcaggatagaaatgttcggcagaattgttaaagcctcagtttttccaaggtgaagtttttaatcccaggaacccacaagcacttctgtgtttggctgtgagtttgatctgtgattggactggggtgaagcaatgaattcctcaatcaaacacttccctctgaacttcactttgaatactaganntacttgactctctttcttgggcttggcaatattagaag

SEQ ID NO: 535974 - DNA, 767 bp, Homo sapiens
gtacccaggtgttattaacagcaagccagtcattagcatgtttctatagatatatattagctgaaagtatcctttatgggaaacgaagggatgggccaaaataaagggatgggttgggctagttatctgcagcaggagcatgtccttaaggcacagatcactcatgctattgttgtggtttaagaacgcctttaagcagttttccgccctgggcgggccaggtgttccttgccttcattccggtaaacccacaaccttctagtgtggatgtcatggccatcatgaacatgtcacagtgctgcagagatttgtttatggccagttttggggccagtttatggccatatttggggggcctgttcccaacacttctctttcttcaggtctatactcaaacgtcacctccacggagaggctttccctgatcaccctagctacccctgtcactatctctatcctgcttttttttcattatagcactttcataacatttatatattggtcatgtattggtctatattcaatctctcccataaaacataggttctgagagagggaggaatctactgtatgcttcaagctagaagatggttagcacgaagtgggtcttaatgaagagttgtgactgactgaatgattgttatatgaaagtcataagtctaggatttgattatattagtccggtttcacgatcagaagaggaatgttgttacgtggacaatcagtatgctggtacggaggtggagaaaatggggagaacggaataa

SEQ ID NO: 535975 - DNA, 550 bp, Homo sapiens
agatagaaaatttggcagtattatagaaaattatcgagactcacaggcatgaccatctaaatggtgcagcgtctggcacagagcaagcttcaaatagacttatgaaagagctcagtgtcatatacagatcacagagttataaatcagtggtttatttagtggaactcataaaggacagattatatgactggcatgttacactgcggaaggttgaccttgatagcgcttggcacagggatcttaagatcttaaaagacaaagaagtcgtattaggacgagtggtgtgacctgttctatgatgagggtatggattgcccgtaggatcaggatgcacgctacaccaaacctacgccagaatgcattggactatcatattcatcggcgtcaatctgactttatttgcacactattttatcggcctatcccgaatgccccgacgttactcggactaccacgatgcattcaccagatgaaacaaactatcatgtgtcggcgcactgatttatgtaacaggagcatgtttcacccttttcatgaattggggatgcca

SEQ ID NO: 535976 - DNA, 1891 bp, Homo sapiens
tgacaggaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 535977 - DNA, 1103 bp, Homo sapiens
tacggcgtgcaccgaagaacaaaatgcggccattacagtgcctgctccacagcttgtggcaccatcggacacctcgtagtggagtagacgggagtgcttcagatgaggagtctggaggcacactgccccctccagactattccagcctccaccactgccggactcagccatcttcctgcacccccagcctggatcctttaccagggaccagaggtccggggccgtggtgtgggctgagtgcccgtggtccaccacctcaccaaggcccatccaaggcctaccactgaaccccaggcacctcaaccagccagcactttcctgggggaagtggaccagatggggatgaccaggtcctgcatcgagtgcaagacagagtggcacaagaccgacagagacgaggatggactaatgaccacactgctgaggccagacaacgcgacaagacgcatactacacagggcccaccagagaagcagacacgacacacacaagagggaaaaagaacacatcggaccaaacaagaccagacgagcccacatacaagacataaccaccacacacaacacagcaatacacgacgccaaaaaccaaataccacgcgacaagaaccaatggcgaagaggggaaagagcccacaggacggccaagacacgcagggcccaggacagacgacgccaagcacagagagacatagaaagcaccaaaggcacagaagcacacagaacagaccaacgacagagacagagccacacatcacgaacaaaaacggaagcacacgacaataagacagagacagcgtcacacgtaggaaaacaagaaaaaacagccaaagagacacaaaccctcggagaactacacacaaaagagcacaaccacaccgagaaggacacgcaccaagggaacaacacgccgggagaagcaaaacaatcagaaaaacgacacgagcaccgaagacaacacacgcgaaacagccacaaacaaacccacagcacaacgcgcaaacacagacaagtgagacaaaaaacacacaaagcgcaaacaccaacaaacaccacaagcacaccggcaagccaagaggggaccagaccaacagaaccacaaaa

SEQ ID NO: 535978 - DNA, 645 bp, Homo sapiens
  misc_feature (601)..(601): n is a, c, g, or t
  misc_feature (604)..(605): n is a, c, g, or t
tgatgtcagtccccgctgtatctgagtcaatctgcgccccaacaaataccgtcagtataagcacatgttatgatattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagccttaaaaaaaaaaaatgccntcnntggcctcacggtggagcttttgtcctccttccccttctac

SEQ ID NO: 535979 - DNA, 252 bp, Homo sapiens
  misc_feature (56)..(56): n is a, c, g, or t
ccttgcccaatgcccaaagttgggcaaaaaaaggcagggaggccagttagggccanggagtgagtgttaaaaaaaactggggcccttcgcctgctttttattgggaaaatgggcttcaattaaatggcgaaggaaaggacccccccagtggtccaaaaagggtgcttttttccacctggcccagaccctgtggggcaacggagcttccctgtggcatgaaccccccagggtatttaattatgaatcagctta

SEQ ID NO: 535980 - DNA, 126 bp, Homo sapiens
accttctcgctagtacgaaaattatgccattgaccggagcataactgtatattatgctctctctctccagctagcccataaaatctcgaggctagcagtctatctatacccctgtaagctagaaca

SEQ ID NO: 535981 - DNA, 928 bp, Homo sapiens
cccgctggccatgggagtatgtcaacgacttcgacctgctcaagttcgacgtgaagaagtgagccactggggcgcgcggagcgtccgggcaggccctggacacgcctgcagcagccggtcggtgtcctccaaccgtcagcactccgtgtagctccgtgcccctcgtcggcccagcttcaggcccgagcctgatagcatgaagacacacctcgagtggatcttgtacttgtgattggcggagcaactaccagcagatgaaacccccgaggcgctcaacctgacgccccgaggacgcgggtggaacgcggcctcatcggactcgacaccccaagtggccaacagcccgctggccaagaggcttttcgaccagcctttccggcgggccgctccaaccaaccacgcacgatcagccaaccagccctcacgcgcagacaccactccgtacccggggcgcctggcgtttggccccacgggaatgaggcttggggggcccagcacctgcttcgaccccggcgaccattcaagaccatcgattcaccgcaaaagggcggtcgcgccgagcccgtcgcgatcacaaggcggcccagattaggcccccgggggacaaactaaagctgccccaacttaggcacaccccccgtgggggccccgtggacccggcgaagcggcgaaacgcggccgctccggggcggaacaggtcgcggcgtgcgggtcgcgggagaccacacggggcggcagggcgtggaaccgcgaaccgcttttcctcccggatcggaaccccaaaagacactctccgggtgggctccccatatttgttccccggttgccggccgatgagttaaaacccaggcaaccattttgcaggggtgcgctttttcccaccccaagaggggtaaccgcggcacggcatgcgtaattcacgcgcccc

SEQ ID NO: 535982 - DNA, 399 bp, Homo sapiens
ttatgttctgacccaccaaagacatgtgagcaacgtgctaatgaaaagctagtaaacagccgcgttagagctatagtcagctttcaactccactctgaggtgaacattccaattacattcgagacttaagttcttgcaattattgcctaacaacagttgctgagtccagtatttacaatattacagcactagcagatcagtgtctacaactcatctttttctgctgtatcctcttcaccagttgggggagggcctgcacttccatagagtttgctgataattggttgaacaatttcttccagttccttcttcttagctttgaagtcttcaatgtcagcatcttggtggctttccagccattcaatcttttcttctacagctttttccatggtctcctta

SEQ ID NO: 535983 - DNA, 261 bp, Homo sapiens
agtgtgatatggcgtatatatctcgcgcgtgatgcagctgcgtgactagcaccttgggcgatccaccactcctctccgtaggaggctgccccgtctaaccggcttggtgcgcaagtgggccattgatcgaagaattcacaggaaacaatagcctcatcatccccatcatcatagccgagcatcaggctccttaacctctacttctacctacgcctaatctactccacctcaatcacactactccccgcgtcagtatagata

SEQ ID NO: 535984 - DNA, 1670 bp, Homo sapiens
tgacaggaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtacaagtggataccccagaatgaccttctagtataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 535985 - DNA, 1951 bp, Homo sapiens
  misc_feature (1907)..(1907): n is a, c, g, or t
  misc_feature (1910)..(1911): n is a, c, g, or t
tgacaggaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagccttaaaaaaaaaaaatgccntcnntggcctcacggtggagcttttgtcctccttccccttctac

SEQ ID NO: 535986 - DNA, 1472 bp, Homo sapiens
gaggcagcccttaggcaacttaaggcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggaaatgaaagcattgtccagatctctggcaaagatggcactgtggtgttttctctggggccagttgtgcaaaaccttatagaagagaaggctgatctcattgcttcagacttggcccagattccacagaaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 535987 - DNA, 235 bp, Homo sapiens
cccatcgtcctagtatcctagccttagcctagctcccaaggtatatccaaggtacctagaccaaggaaggcaaggagtccataaccagaggcccaaacaaggctaagccctagaagcaagggcccccaagcctgaggcccaggagtggacagaccttgtgacacccattctctcttccttttccatctgtgccgaactctggacactgcctggaggaatcaggcctccgtagcca

SEQ ID NO: 535988 - DNA, 1344 bp, Homo sapiens
gaggcagcccttaggcaacttaaggcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 535989 - DNA, 464 bp, Homo sapiens
tattgcgtcactgcgagtccagagcgcacggctggatcatgagcacgcccgcgctggcgcctgcgcgcttgcgcatcttcctctgcccggcgcgcgccgcagccgtcgggatcacctcggggttgcgctgcttctccagcaagtgcatgcgcgccatggtctcagtcagcatgtctatgagcagttcctgctgcagcttcaggtagttgttctcctccagcaacacttggcttttggaccgctgcacctgcgccttccagccccaggcggtccgcgagagcagcggcgaccgcgtcctcgccagctggctctcagtggtccaccgcccgccgcggaacacgaaggcctggttgctgaggcgcatgcacggcgcgccgtaggcgaggcccagctcggcctggcgcgtgttgtggtccagcaggtagaaggtggacagggagggcatgcggcgcagtggcggccgc

SEQ ID NO: 535990 - DNA, 345 bp, Homo sapiens
ccaagctccccgagtgagcaattcctgtcccttttaagggctcacaactctaagggggtgcacgtgagagggtcgtgatcaattgagcaagcagggggtacgtgactgggggctgcatgcaccagtaactagatcggaacaaaacaggaaaggcattgtcacagtgcttttctatacaatgtctgtaatctatagataacataccaatcacgtcaggggttgatttttaactaccaggcccacggtgtggcacctggggtgtctgcttgtggatgtcatttctgccctttagtttttactttttctttctttggaggcagaaattgggcataagacaatatgagg

SEQ ID NO: 535991 - DNA, 388 bp, Homo sapiens
atgcccgatcagataggcggtgggatgacaccctgcccctcctggaacactatagaccccgagggacagggacaggcttgaccaggactgcttgaagatcgtagtaattctggatgctctgtccagtgcctgcctgaggccccattcccgcctggcagatctgtaacctgacctctgacactctcaccagcgattcctacaagaagtggagactctccagtatggatcgtgaactggaggcggggctccaccgcgggcggttgcaggacactcacccgaacatccttctgtcatgcaccctcgagttacctcatcccgctgcgatcgaggagcgatgaggaccaggaggagtggggagagcggtcgcaccgttctgatcgtggctcgc

SEQ ID NO: 535992 - DNA, 2143 bp, Homo sapiens
  misc_feature (1860)..(1860): n is a, c, g, or t
  misc_feature (2143)..(2143): n is a, c, g, or t
tgacaggaaaggaacagcaactggaaaacaagcattgcattgcaccaggatgtctgtgaaatggacttcagtaattttgctaatacaactgagcttttgctttagctctgggaattgtggaaaggtgctggtgtgggcagcagaatacagccattggatgaatataaagacaatcctggatgagcttattcagagaggtcatgaggtgactgtactggcatcttcagcttccattctttttgatcccaacaactcatccgctcttaaaattgaaatttatcccacatctttaactaaaactgagttggagaatttcatcatgcaacagattaagagatggtcagaccttccaaaagatacattttggttatatttttcacaagtacaggaaatcatgtcaatatttggtgacataactagaaagttctgtaaagatgtagtttcaaataagaaatttatgaaaaaagtacaagagtcaagatttgacgtcatttttgcagatgctatttttccctgtagtgagctgctggctgagctatttaacataccctttgtgtacagtctcagcttctctcctggctacacttttgaaaagcatagtggaggatttattttccctccttcctacgtacctgttgttatgtcagaattaactgatcaaatgactttcatggagagggtaaaaaatatgatctatgtgctttactttgacttttggttcgaaatatttgacatgaagaagtgggatcagttttatagtgaagttctaggaagacccactacattatctgagacaatggggaaagctgacgtatggcttattcgaaactcctggaattttcagtttccatatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctgtggagatttgatgggaataaaccagataccttaggtctcaatactcggctgtacaagtggataccccagaatgaccttctaggtcatccaaagaccagagcttttataactcatggtggagccaatggcatctacgaggcaatctaccatgggatccctatggtggggattccattgtttgccgatcaacctgataacattgctcacatgaaggccaggggagcagctgttagagtggacttcaacacaatgtcgagtacagacttgctgaatgcattgaagagagtaattaatgatccttcatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtgttttttatgatgtttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaataataatataaanccttgaacataaagaaaaagaggcactgaaaccttggtggcgccgcttccctttagggagggggaaacgatggttcctattcaatagatcgctgagctggggcgtacgggtggggggaggcggtatgagcacactcaaaggggggaatacgcggtttcccagaaggtgggggaaaacgcgagaaaaaaactgtgagccaaagggccacaaaccggcagaacgcgcaaagagcgcgctcgtggggtgtttcactaggccccgccccgagaaatgatcaaaaatn

SEQ ID NO: 535993 - DNA, 589 bp, Homo sapiens
  misc_feature (62)..(62): n is a, c, g, or t
  misc_feature (66)..(66): n is a, c, g, or t
  misc_feature (69)..(69): n is a, c, g, or t
tattagaataaaattatagcctcactcccagacaaagcaacgacccacgcccctttagggtnaacnagnatgttatgtattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtggcaactgtgatatttatcgtcacaaaatgttgtctgttttgtttctggaagtttgctagaaaagcaaagaagggaaaaaatgattagttatatctgagatttgaagctggaaaacctgataggtgagactacttcagtttattccagcaagaaagattgtgatgcaagatttctttcttcctgagacaaaaaaaaaaaaaagaaaaaaaaatcttttcaaaatttactttgtcaaataaaaatttgtttttcagagatttaccacccagttcatggttagaaatattttgtggcaatgaagaaaacactacggaaaataaaaaataagataaagcctta

SEQ ID NO: 535994 - DNA, 148 bp, Homo sapiens
actctagtaggatccccatgtcattcactaatttttgaattgttactcatatatgctactagaaaatgccttgtttgatgaagcacattttggttagttgaggtcttttgttttcgcctttagctttctaagtccttcttacaactgt

SEQ ID NO: 535995 - DNA, 125 bp, Homo sapiens
agtgtcagacctaactcgaagtccatcgatgcctggtctccagatccacgaggatggtccgaggaacatattagttaccagtgggttcatagtattaaacatggattctctccagctgtacctca

SEQ ID NO: 535996 - DNA, 517 bp, Homo sapiens
caagccctagtcatgtaatatcgtccctctctgcatctcacaatagcttagtgatgctgttgtaccacattgtaagttgaggcttaaacgcagtctcctcccattctttgcagtaattctgtagtcaacatccccctaagttagtgctactgagtcaatgttccttggagtgatgtagagttttcaacagagatcgattgtggagtataatcttgaatcctagaaataactcctcctggtagatcctattttctttacgaaacagagaatgctgttgggtgtggaggctcacacctattatgacaccacttggggaggctgaggcagtcgtattccttgagctcaagagttccaagaccagcttcggcaacatggcaaaaccctgctccgcaaaaaatcctaaaattaaccaggtatggtgcctggcatctgtggtgccacctgctcgggagggtgacacaggaggatcactttagcttagcggcgaaggttgcattgagccaagatcaaaacactg

SEQ ID NO: 535997 - DNA, 443 bp, Homo sapiens
gccagtatcacatatcggaacagttgatctgataacaagatggtactgtattagtccgttttcacactgctgtaaagaacggccaagagtgggtacttgatagaagaaaagaggtttaattgactcagtgctgcgtggctggggaggcctcaggaaacttacagtcatggcggaagatgaaggggaagcaaagaccttcttcacatgatggcaggaaagagagagctagcaaaagctggaacaactgccttataaaaccatcagatgttgtgagaactcactatcaggagaacagcatggggcaaactgcccccatgatccagtcatctcccacggggtccctctcttgacacctggggattatgggtattacaattcaaggtgagatctgggtggggacatcgccaaaccatatcagctactaagtgatcgtggggttgtaa

SEQ ID NO: 535998 - DNA, 1357 bp, Homo sapiens
gccccccctctttcatgatattaatactcgccagattttattcacattcacccccttgattggggttcccaaaacaccaaacaatacccgaatttttttagggcgaccacgccatatatataaggagaacctttctctcaagggggagtctccccacacaaaacagtgttgtggtctgtaccacaacaaaaataccactcacgcgccctttgtttttatatcacacctcccctggcgcccccatacttttaacatgattgtcaccgcggtgtcccctctaaagaggtgtatactccgcaggagacacttcgtgtggtgggcggcactattttttccgggcccccccagaggggggggcgcgtaaaccccctgcggtgggagggcccccccctcccccctggtgaaaggccctctcttcgtggccacccccctttatcttgagggagtggttatcccccacagggtatattttgtgtggtctccccgtggccccctggccccccacccgccccccccccgcaaggtggccgcccctctcactcgctcggcgcactctctttttttcccgccccaactttgtcgagatattctcttgtggcgcccgctcatatatacaccacggtttctgttttcccccacacaaggtgtccccgcccctctttcttgggtgataactctctggatatattctctcacgcctctttataagagaagagagattgtagaaagagaatattttctctcttcacacgggggagagaaatttgtgtttctatcactctttggggcccaccagcgcggttttttggtagagagaagtttcccccccccccctcgcgcgcggggtgtagaaagagaatctttttcgcgggagatttctcggtctgtgcgcgctatatgtagatctctctccgcgagaggcgggccacacctcaccacacacacatgtgttcccgcgcgagatatatccgcggagacctgtagacccccgccacaggggcgccgtgttcacacccacagcgtgtcttatccgcacaacacactgtggggtgtcccgcgcacccgcccgcgcccgcagggcccacactccacattctacgagtattacatgaagagtgggagagagaattcccgcgcccgcacacagatgccgcccgcgccgcgctgtttcaagacacgatttccccgactccccagaattccagatttcccgcctggccccacccgcggttcctggcgcccgcttcagccccagaccccgcgcttctcaccccccagaggccccaccacccttttttagggcccgggcccttgtcccggtgtgccccccaattaactccagggacccccccggtta

SEQ ID NO: 535999 - DNA, 208 bp, Homo sapiens
ctttgagcgatagcggcgtctgaggaaccccaaatgcagtggcaagaggaggttggcggcggtggtagtggtgggctcctgcagggagtggtcgtctatcgctcgaacacccattcaggggcagcgccgtgaacgaacagcaaaagtagtccgagatcgatattgaagacgaagttcttcctactttcttgatcagcagtgtcaacta

SEQ ID NO: 536000 - DNA, 383 bp, Homo sapiens
acatttcagtcaaagatggattacatatacaaaagtgggcctatgagattataatacatatttttacatgcttttctatgttttaagtatgtttagatacataaactcttaccgctgtgttcttattgcctgcagtattcagtacagtaatgtagtacacaggtttgtagcctaggagagagaggctataccgtataacccagacgtggtaggctgtacaatctaggtgtttgtaatattctctctgacgtttgcaaaatgatgaaattgcctatggatgcatctgttagaacgtatccctatcattcagtgatgtgtgactgtactaaaatgctcaatctaagtttcaatgccctccataaaattgttgtaatgaaaaatac

SEQ ID NO: 536001 - DNA, 287 bp, Homo sapiens
gtccccttttctcttgtcagagcccccctccaaccgggggggcagtgggggggagaaccccaggccttgaaatttaatggcccctccttcgtggagcccaaaggagggcccccgtagggggtggtgtccccacccccccggccctagggaagaaggggggttttttaatttcccccccccctttttcccccgcccccaggagggggccctttttggggggggcagggggtcccaaatgggctccccctgagaaggtaagaactccaaccaaaatttttttttaatta

SEQ ID NO: 536002 - DNA, 431 bp, Homo sapiens
tcccgtgactgattcagagagtcaacttgctgttggcggaacgccgagatgccagcccaatgacacaaccacaagatatcgcggcagcaggtgccgttgtccagggtggcttgtacgaacggtttcggtccaaccggcgttgtcggtggttgcagcagaattaaccggggttgatttaagctggttcaaagggttgccaaagcacaaggtcgacatcggttttgaattctaatcggccaatttttaactaacagaacaggcgggtaacagcagtctaataacaggcggaatcgataaagcttcgggcgttgatgccaccgcatggtactggccgccgtgaagccccttgcaagtcttgccgggtcgcgggctgatccgcgtttacttgggtacacctattaggattgagatctttggaattcattccgggg

SEQ ID NO: 536003 - DNA, 296 bp, Homo sapiens
  misc_feature (247)..(247): n is a, c, g, or t
tgatttttaagtggacatttctagaacaaaatattgtaactaaagtatcatcccccctatttgttttttcttagatatcacctgagtcgggtaattagaaaaatatattgtggacgtgctgacaaatgcatattacctgagttgcttgtactgtacccggagtcgaatccctttatcaaagaaagttatgcagtttataaaaattcaaggacttaacaaatcagtgactagcattaaactctaaggncactttccataaagcaaagatatttagtcagctaccttcctggggaatt

SEQ ID NO: 536004 - DNA, 1507 bp, Homo sapiens
cccacgcgtccgcaaattcattacttggtccaccaagtggtgactgaagcctacgaggtacagcgactacggcggactaattctacgacgaacgtcgtacttcctcgctactcactacgacacgcagacttatcaccctttcagtgatccacggccgctcatgaactcatgtattgccgttgatctgccttcctagctcctggtagtggcgccttgtgtacctaaacacgtcacgaacaaaactatacatgacagttacataaccaatcttcaggatcgccttgcagggataaataagacaaacctggcgtagagacctagtcctgggccccgtccagtcgattccctaggtctctctattcgtcccatccacattccactagcggcattccctcttacataaccagaacgaagagttcctagcgagtgcgcctgcgcctttaagcagtgcaatcatcaagtttgggtcacatccacagtgggctacttgtaaacggtacccgaggtagcagccgggactaacgggacgggatcatagatccttcaagcatcccgtgacacatgcctttccccccaagttgagttcccctcagggatcccagggcggacacgagagctgacacttcccattgtaagcgctatggacaaatgttctggaagctaagggtaagcctccgcgtaaattgccacaaggccctccacactgccgagataattatgtacgaatctaagccgattcaaacgatacgcatcgggatccactcgctcggggtcacaagtggacgccctgtgggtctgcccccgacggatttcaggggccgttataccaatagagcccaagaatggcaaattctccacgcggcggagggggtcagtaaaaggcacaaaacccacagatattatcatgccggcggttaaccatacggaatcccgggtggggtcttagtaaccttaacggggggcagaaaggggtccttgaaaaatatctggtggtgagatacaaaaattcgaacacagtgttcgattggccccaattcgagatcccttaaggaaatttacatttaccccccttaaggaacagtactcgccgagacagttaagggggccccggtacttttaagccccgtaaataggcagccccccgtcgtaaaacccccttcttgagaaagcccagagaaagaaacacacaggactaaaaccacaacaaaccaaaacaaacaaacaggagagcagcacaaacaaaaaaagaccccaaaggaaaaggaacacagagaaaaaaagaaaacaccagaaaacagagagacaaaaaggaaccaacaaaagagaaaacaaacacagcagcagcgaacgacaacaaaagaacgcaacgagagcgacaaaagccaaacaaaaagcaagagaagacacataccaaacagcgagcacaacaccacaccacgacgacggacaagagaagaaagagcaaccacaaacgggccgggagacaacacaaaacggaagacacaaa

SEQ ID NO: 536005 - DNA, 102 bp, Homo sapiens
ggatttgctggtgcagtacaactaggcttaatagggacatgttatgtttcttctgtggtggcagtatagtcacaggaaatccattcttaggagctccaaaaa

SEQ ID NO: 536006 - DNA, 210 bp, Homo sapiens
  misc_feature (123)..(123): n is a, c, g, or t
taactgtggagacaatggaagaagacaagagccagtcggatgtagatattcagtcttgtgaatcttgtagcaacagtgatagagcagaatatgaaaatggctctagatacttttctgaagatnataatgaaacaaccatgttaattcaggatgatgaaaaccattcagaaatgtcaaaggattggcaaaaagagaagatgtgccataaga

SEQ ID NO: 536007 - DNA, 418 bp, Homo sapiens
tttttttttttacaggtatacaaaaagcaacaagagtttaagttctctttttacatggccacaggctctcttcagccaggggaacttcagctggtgcctctctcttgcagctatgaggcgacagtgtggttgacagtgcctcattacagactgtcccagttaagccaggacaagttcaccattaaaatctggcatgaacagcccgtgggcacgttgggaagtgttaagaaagagccaccggctccttagtcagcgttaaccacagctccaaacgcagttgggtcccagtgtggcaaacgcctcaaacaccaagtcatgcgtcggagctcctattcgggggtttttataaaacaccttttatatagcgatatagatagcacagtaaagtggtgcttctgatgcactctaacatagaagg

SEQ ID NO: 536008 - DNA, 213 bp, Homo sapiens
caaataggcgatagactgagtggttataaggcacaaaaggctatctcatagctatgacagctgggaagacaggactgaaggtacgacaagtctggtgaggcccaacttgctagttcatagatggcaccttcttgctgtgtcccacatggtgaaaggagcaggtagctctctagggaacttttgtaatggcactaatcacataagggtagaccc

SEQ ID NO: 536009 - DNA, 174 bp, Homo sapiens
accccgggggccccccccccggttttccttcttttttccctttttttccccgggggggaaggcccgggggccctaaccctggttttggggtttagggggaggttttcccaaattccgggggttccccttttggaattcccctttttttaactttaaaccggggtttttttttta

SEQ ID NO: 536010 - DNA, 370 bp, Homo sapiens
  misc_feature (56)..(56): n is a, c, g, or t
  misc_feature (74)..(75): n is a, c, g, or t
  misc_feature (147)..(147): n is a, c, g, or t
tccccaattcgcttgctcacaggaattgcctgaacctgggaggcagaggttgtggngaactgagatcgcaccanngccgtctagcctgggcgacagagcaagactctgtctcaaaaaaataaaataaaaaataaaaggaataaaatnaattgaaaggctcctgggtcaatcacgtaatggaaagtagaattgaaccatcagacatcgcaaagcaacctcaagggcgcttgtggtacctggcatcctactacatttctctaggccatttcttctcttctagatgatcatctcagatgttgcttttcattccacagagaaaatagatacaatcagaagagaacttctgcaagctaccaccacaatatccaca

SEQ ID NO: 536011 - DNA, 217 bp, Homo sapiens
catacagtagtatactagtgcaggaacacataaaaactggtgcaaatctgatttttagattaaattattacatagcagcttatcttctggtcacattttaagcccaatcagtttatactcctgaaactctttttaaaagtcctgtattatgtagcacatatgccagtgatgttcttaaaccaaattataaatttgctgtaccttggcacacgggctt

SEQ ID NO: 536012 - DNA, 295 bp, Homo sapiens
tgctgggattacaggtgtgagctaccacacctggcttgggtgatttcattgttgtgcgaacatcatagggtgtatgtacacaaagctagatggtaaagtctactagacacttaggctctatggtatagctgattgcttctaggctacaaacctgtatagcatgttactatactgaatactataggcgattgtgatacatggtacgtagtggtgtttctaagatgccctaaatgtagggcattctaatcttatgggacacttacgcagtcattgttgacaaaaatcatttgtagcc

SEQ ID NO: 536013 - DNA, 117 bp, Homo sapiens
acaaacaatactgtcaacgatctttgtaccaccttcacctaccattctcagatacagattctggtgtgtaaaccaaccaggaacacagacggctactaccaacctgccttcttgatg

SEQ ID NO: 536014 - DNA, 604 bp, Homo sapiens
cttcctgtactatttgtaatccagacctcatgttatcctaagccaggaataatagggccaccagttggaactgttaccccaccgtcagtctagcatttgatccgagtgttcggatatctgcatcccagcatgatatcagtcatacggtctttgctttgtccacaaacagcaggtttttgctatgaagtatgcgatcgggcaatactttgttgcttacaggttcaatctgtgcacgcctattaacaccttccgtcataggtttcatcaaaattcgccaccgtgcaacatatgttaccataaggatgtagtgttagcggtcacgtgttacagtctcctcgtgtccacattctgtttgaaacaatcaagaggcttctttctatattttccaaaggtgctatagaagccttcggtcgcatatagtaaggcatcctgttccatgcatgaggtgtgtcactctgttctcacgaatcatgatctggacacctgtcgtcactcaggtgcgcatcttagtaacacgcgccggtgtaattagccgagataaacggctctatatggagagaggaggtcacccacttctatgcgttgacgccgtgtttggactacg

SEQ ID NO: 536015 - DNA, 531 bp, Homo sapiens
ctggctcctgcacttacaggactcctcctattcagctacgtaatgaaatatcagcatccttcaaagatttggggaggctgggcatgggggctcatgcctgtaatcctagtattttgggaggctaaggcaggcggatcacctgaactcatgagttcgagaccagcctgggcaacatagtaaaaccctatctctactaaaaatacaaaaagttagccagacatggtggtgcgtgcctgtagtcacagctgctcgggaggctgaagcagaagaatcgcttcaacctgggaggccagaggttgcagtgagctgagatcacacaactgtgctccagcctgggtaacagagcaagattctgtctcaaataaaaaaaaaaagaaaaaatggaaatcgaagaacctcaagaaaggctcattctgggtcagtatggtagttatatgctcaggctttgagagtgcaacaggtgtggctttgaatcacgcttctgccatgactttgggcaagtggttaaatctcattgaaccggatagcttg

SEQ ID NO: 536016 - DNA, 370 bp, Homo sapiens
  misc_feature (295)..(295): n is a, c, g, or t
tacgctaggctttttcttttctttctcttttaaaacacatctagacaaggaaaaaacaagcctcggatctgattttacactcctcgttcttgtgcttggttcttactgtgtttgtgtattcttaaacggcgacgaacgacgacggggaacaaaaccagctggatccatccatcaccgtgggtggcttttaactttttcggttttttctcgttatttttttttaaacaaccactcttcacaatgaacaaactgtatatcggaaacctcagcgagaacgccgccccctcggacctanaaagtatcttcaaggacgccaagatcccggtgtcgggacccttcctggtgaagactggctacgcgtacgtggact

SEQ ID NO: 536017 - DNA, 399 bp, Homo sapiens
aatgctcaaattacatcgtttattaaataaatgtaaaacacattctgagaagcaggaggcttgtgctggggtgggtcaacacacggtagagggggcaagttgggtggaatgatctatcacaccaactgaactgtgggtcatgcagtgtgcatccatcctgtcaaattgaaacctcctgcatcctgagtgcctcatgtctcatgtatttagggtaccgtgaatatttagagcctccttggtctttctgtccctttggaactctgcacacacgaatacgttgtactatctacagatgactaatttagttatctgagtgtaacactgctttggagtggattgaaatcctgccttctacagcggaatgggatattcccaaacaatctgcaagtctggtgttta

SEQ ID NO: 536018 - DNA, 387 bp, Homo sapiens
ccaggttggtattgagtggcatgtgactgctgtgatatcagcccagctgtcgttatcagtgctatattatctggaatatagaggctccttttactgttttaaaggtgctttgtgctagggttgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatcttattctcctggtcattccttggtagatatttggaataaaataatcacactgactgtgattgggtagatcacactccatattctcctgtgagtctc

SEQ ID NO: 536019 - DNA, 307 bp, Homo sapiens
atttctttgccaactctgagaaagtcatataagggagcaaaagtaacatgcttgaaatcacagtgaccaaaggacttgaagtcataattaccttaaataaccatcacctttcatttaacctattcacattccactcagtggaaattatcctctcctccggatttttcacttacacctcttaaccttgaagacctaccattagcgaaaaccacgtgcagacctcctagatgtgtggttttttcctttaatgccgagcacaaagtgtacatcataaaattcaaatttggtggttggccctaatctaata

SEQ ID NO: 536020 - DNA, 868 bp, Homo sapiens
  misc_feature (4)..(4): n is a, c, g, or t
  misc_feature (106)..(106): n is a, c, g, or t
  misc_feature (125)..(125): n is a, c, g, or t
  misc_feature (129)..(129): n is a, c, g, or t
  misc_feature (132)..(133): n is a, c, g, or t
  misc_feature (189)..(189): n is a, c, g, or t
  misc_feature (221)..(221): n is a, c, g, or t
  misc_feature (241)..(241): n is a, c, g, or t
  misc_feature (271)..(272): n is a, c, g, or t
  misc_feature (294)..(294): n is a, c, g, or t
  misc_feature (304)..(304): n is a, c, g, or t
  misc_feature (510)..(510): n is a, c, g, or t
  misc_feature (649)..(649): n is a, c, g, or t
  misc_feature (755)..(755): n is a, c, g, or t
  misc_feature (766)..(766): n is a, c, g, or t
  misc_feature (810)..(810): n is a, c, g, or t
acantctgtgtgtattgtaacgtggcggggcccaagggcgtgttttggacatttggctaggacaaagatgtgtctggtacatatggccaattaagaggcacttttntgaggaaaaacatactttntgcnagnnagatctctagtgtacccgatccaccaaatgccttcgctctgactctgtatgtggcntctgctgctactttgctcgatgcgttaaatgntgtctctgatctcctggacncacgaagctgccactggggaggggctgggnncctacattgctggtgtcactgntactaatggngtgtgtaggagtcttccccaccttacgcgtctttcttacacttcttcaataagactttctataaaggcagagcaataccagagcagagcgcaagccctgcaagacaccagccagacgcaggggcccgaggagctgaggagctgaggcgccggggttggggagagtaggacaacattcggccaaggcagccacatcctgttcctggncagccacagtggcaatgtgccaggaggacgcggggatggctcgcacaccgcgctgccaagtcaaacacggggcactccaggcataatgagggactaatcttcccgactggtgtaagtaaaacctcctggtgaaggtcanagtcttcaaaagcagaccgaggcagaggcatcgctgagtcagcagtgagagatgggagcgtggaaactggtctcttcatggaggaagtgacctgtttatgagcaanaacaaggccangagaaggcccactccccgcaagctgtgagttgactcataggggncatgggactgtcccaggtgatgtgagcgatctggagcaataccggtgtactctgcttt

SEQ ID NO: 536021 - DNA, 264 bp, Homo sapiens
  misc_feature (85)..(85): n is a, c, g, or t
  misc_feature (188)..(188): n is a, c, g, or t
ggctcggctgggttgttcgaaggacggtttgagcacgccatccttgagttcggtgccatggtgcaaacgatgagaatcactaaanacagtcaacatgaaagacatccacccgtgaaagacaggtgattattttgttctggctacggtgggctttctttgcttttatgtgcgccgatgctagcgtagtngggcatttttaccccaatgggccgccatggagaaagccaaccaaggccatcaacgtgcctacggcgatgatgaatg

SEQ ID NO: 536022 - DNA, 495 bp, Homo sapiens
  misc_feature (426)..(426): n is a, c, g, or t
agggttttattatgttggccacagtgaaatggttcttttatcggcatttgagccgcccgcctttgactcccaatgtgctgtgacaacgggcctgagctactgtaactggatcaaaccccttcacatagatttctctactacggtgtgtaccatgaaaagattggtgttcctcacggacctaacataaaacgcggcggctaaaaatttaaactaccaccaccttttatttgcagctctagacatgaacatgagattgcgaaaacatatgtggctttatgaaggtaaaaatgtttaatacaagtgacctgtcaaggtaaaagtgaatactgatgaataacttataatagcactctgcatcacatggtgtatgggatccaacattatatactactgtgtggggtcagaatccatgactgaatctcttcnacaaaattggacgggaaggcaaagcgtgattgtgatacctccaatatagggttcaaatactgatggatt

SEQ ID NO: 536023 - DNA, 397 bp, Homo sapiens
ccatgcatattcccaaatcagatacccagaatcgtcgcggttccactggattgtgtcgggggctcctacatctatgatcctggccttgctgtacttggcttatcctggagcaaactagaactactacagtctactttgcttgcagatcagttgctgaagcttatgagtacttgtagaatcccaagtagaatcatgtagctgctggtctcgtggcaccgaagtctgaaatcggatacctctagtacagaaatagaggaagctatgaaaagagtacgagaagcacagtccctaatgtcagctgctatagaaccagataagataagaagaaaaaagaaggcattcaagatcaagatcacgttctaggaggaggaggagtccctcatcttctagacacagg

SEQ ID NO: 536024 - DNA, 103 bp, Homo sapiens
gctcgcagcctgaccacgccaccccaagtacaaagacggagctgtgcagcaccttccacaccatcggcatatatgccccatacggagccccgactgacacttc

SEQ ID NO: 536025 - DNA, 1922 bp, Homo sapiens
  misc_feature (470)..(470): n is a, c, g, or t
  misc_feature (516)..(516): n is a, c, g, or t
  misc_feature (1167)..(1167): n is a, c, g, or t
  misc_feature (1808)..(1808): n is a, c, g, or t
accagaaaccagaggagggtggggcacagaaccagtgagacggacccctcgtcctcccccagcggaggtagggggacccggggggctcctccccgctctgcgggcctgggggagcgacctggggctggggagccagaactccacgctttgctcttgtaaaactcgtcaggtggtaacctggtatccgcgctggagcacttctcagttctctcgtgtgtaaactagatggtagtttttttatggccagtgttgtgtctcgtcttgtatttagagggtcgaaaaacgcaccagcgaaaaaacgcactctgccaatgatcaagatgggacgttctcgagagagggaggcacactaaaagctctctgggcgtgtgtagtctcgcattagtatcatgagatactcgagaacacgcacgcggctgcactaaatctcttattcgcgcacggtgggtgaagaacatcgcgagtggccnttaggagcggtgaggaataaacgttctagacgggtgtacagacganaaaccaggcgggcgacctggcgctaacgagcgcgcaaaggagagggctgtgtgcacccatagaggggtcgtgagagcagtgtggtaaatgcactcccgagggtgctggggaagatatacgcgctcctcacacgatgtgggtgccgaccccacacgcgccagacacagcagaacaacagagtgtgggggggccactagtcggcggcgctgcgccacaacatcagagacaacatagagcgggacgagtggcggcgctctactcgagcagcgacgctccacaatgaagagacgcgtcgttgtgaataatagatctgctcgcgacgcacgcgctctcttgtgtgagagtcgctcaccgagtgggccgctaacaaaaagtgcgaagagagtgccaccaacaggagaagacatatctccctataaataaacacgcggaagacttccgtaggagaagagcgctaataaaagagcggcgtcaacttgtgccgacgaggaaaggacacctccagcagccaccccaccaggggctgcagacacaaacattggaggagggggcagctacgtaattaaaacaaaggaggggcgaaggagacacccccacacaaaagaatctatacacacaagcagagcaagcgacaaccaactaagatataangccagcccaacgtaggaggaggggcggccacccactctgctgctgcgtcggagaaaaagacaccccacatagtgagtcgacaagtgagctacacaacccccaggaggaatatgcagcacgagcaacacaccccagatggaagaaagaacaccaagggacgttaggaggttctgccaacaaatcattttcgtcacgcccgagagaaaacaaggcggggggccaccaacaagagctaacaacagtgttgtgtggcacccaccaccaacttatgtgggaggaacgccccggttgttacacacccacaagagggaggcaaacatcatcggggaggcgagcacaatgtgggggaagcaccacaaaacaccacaacaagtaatgcgagggggggcgacctcaacacccagcgggggggccatctcccaccagcacaaggatgagaagaacagttgggtggctctccctcgtaagagcaagaaagcagcaggactcggtgcggtgaattagtagtcacacaaaccaggtgaagtatgtccataggaaggacaacaacgaccgcgtggggtgatgttacaccaccaccccacgaggtggtggagagactaaacactagcagggggtggtagagagagagccaacgagcngtgacagagaacagcaagacacagcatacgaacgtcgggagcaacgaacacacgtggcgacggggaattcataccatagacgggagtcagcacagtccggcgttcatcagcacg

SEQ ID NO: 536026 - DNA, 394 bp, Homo sapiens
accaacgagtggataaagaaaatgtgatacacacacacacacacacacacacacacacacacacacacacacaccatggaatacatactcagccataaaaggaatgagataatggcattcacagtaacctggtatggggttggagaccattattctaagtgaagtaactcaggaatggaaaaccaaacattgtatgttatcatttataatgtgggaaccaagctacaaggtatggagaggcatcaagagggcagagggtgaaggaaaaaagactacactattgggtacagtgtacccaagtacactgcttagtgtaatgggtacaccaaatatcttggaactcaccactaaattacttttccatgcagtaaaccccatctgtttctctaactct

SEQ ID NO: 536027 - DNA, 512 bp, Homo sapiens
aagccagttgtgagtcagtacaataatttggtccctcaacagtctatgcagtgattcataaatagttgtcagttcacatagcaatttattcacgtagtcatgaattagataccccctatatataaatatatgttatcaatttcttcagatagcttgtttacatgataatcaattaggcaaccatgagtcatttagaaatagtgataactagaatacacagaatagtgatgaatttcaatttataacaaatcacgtaaagctccaaacctatttaatacaaatgatcccatcaacgggatgccaagtctggcgagtgtaggacctctgagtggttgtataaattgtttatttcatatgaaattcatttaaacagttgacaaactgtcattcatcaattagctccaggaaataacagttattgcatcataaaacagtcccttcaaacacacaattgttctgctgaagagttgtcatcaacaatccaatgctcacctattcagttgctctgtggt

SEQ ID NO: 536028 - DNA, 339 bp, Homo sapiens
ggatcgacatccctgtgtcggttcacctcaggaagatacaacaaggagaaacacttttagatgtgccgttgtttacaaggcttgagtgtttcttggatgtcacataatgagagcctttttttgaaacattccccagtgttgttaattgtgagggctgttctaggtcacatactctagtgtgagcccagtctactttcactgagtagtcccacaaagcagagcaggagattgacagcagtatttgtgtgttaattacgagccggctagcagcgtatggtgcgctcggtgtgaatgtgtttttttttttttcaattgtttggcagtgcattgtgggtgact

SEQ ID NO: 536029 - DNA, 171 bp, Homo sapiens
agacctgtggcccaagacgtggccctcgtgcagggtgctgtgccccagccaagaggcagtggggcaccttctgcctgcatcctggtgggcagcacccagttctttcattgcagtcaacttgttcacaggggaaaccctgtggaaccacagcagcagcttcagcgggaatgc

SEQ ID NO: 536030 - DNA, 162 bp, Homo sapiens
  misc_feature (109)..(109): n is a, c, g, or t
  misc_feature (162)..(162): n is a, c, g, or t
ctgggggtgtgggggccttaattctttccattaatttttgggggggccggggataggggaagggcattgaagttctacaattctggaatagttagtgatggacatagtnacttggcttcggtcatatggacttaccactgagaattatgcgtgcttggttgn

SEQ ID NO: 536031 - DNA, 576 bp, Homo sapiens
  misc_feature (466)..(466): n is a, c, g, or t
  misc_feature (508)..(508): n is a, c, g, or t
gacagtgaccgccaccgttgccgggggatgggtccctgagacttggcgaagtaggagccctgtgtgttcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccaacctcaggcgtgcgcggacggtgtgcggagtctagctttgtaccaggctgcagtgcagtagtgccatctcagctcactgcaacctctgcctcccgggttcaagcgatggtccctgcctcagcctcccgagtagctgggattacagccacatgccaccaacccagctaatgttcgtattttcagtagatacggggtttcatcatgttgcccaggatggtcttaatttcctgacctcgtgatccgnccatctcggctcccaaaatgctgggattacaggcatgagccnacagaaccggacatgctttccttaaaagctaaatatttaggcttgtgtgccattaggctctgttacaa

SEQ ID NO: 536032 - DNA, 832 bp, Homo sapiens
cccctacggtccaaattaaacatacactccctctctatttgtccatttccaatgtgcgactctctttctgacttaaactcttcccctcttcgcggaccaaccgtcttgtactcatccctctgcatcgctcacgcttacgtctaaactcgcttattttaaatccccgcaccttcctctctgatactacgacaatagatcttctgcttcgaagaagaagttcataatctgctcctctcactcccactactatagatcagcttcactgcttggtaaaacggcgcgattcttctgttctcctacagaggcccttctctcctcgaaaagataatcgcgcgcagcgcttattgctgcccccctcccgctttctatgtgacctcttccttgtgcgtggagacttgcctcctgtccagtttccgtgtgttgtatttcacccacggcttcttctgctcttggggctcactcaaagtctctcgtgcttcttcctgcaaagtctctccgcacggagtctctctctcactgactttttgggttcctcgccgccccgcattacattcgctctcgtcaactttctatgtgttgcccccccggccaccccagagggggtatatctctcccctccacccttctcacacataaccctctctctcgcacctcagtgccaacccccctcttctttgtattaccccagtttctacccacatccttctctcccttagctcctctacgccacgccgcgcgactcatctttataccgccggctgtgttctctctctctctttattaaagcaacaaaataaaatagaaaaaaaataacaacaccccacataacaaa

SEQ ID NO: 536033 - DNA, 426 bp, Homo sapiens
ccggcgtcgaccacaaaacccagagcccccttctgcttgaaaagggcagcatctttttcatttgtgtttactgtaaagggacacaacctgtccatctttcttgaaaatggcatcttaggactagttcacttgctgggcaagcactccactaagagccacatcagagacattctctgcaatttgatactgtcactttgaaaacttatttctgacctagttttctcagtgttctctttaaattcacctgtacaccttccagtcgcattgacagaagtggaggttccagaaattgcaacaattacagtcttcacccaagaaattgaaactaaggcaacattgaaacacatttgtgagctctcattccccagtgtgctcttgagcatgaacagcaacttgggtggcttctgcaggggatcctgtcgacgc

SEQ ID NO: 536034 - DNA, 411 bp, Homo sapiens
  misc_feature (18)..(18): n is a, c, g, or t
  misc_feature (388)..(388): n is a, c, g, or t
ccccattaccccttctangttccacctttccattccacccctcacctccccccccaccccttccctatttctttcttcccatcacattcttttctttctttattttctttctccatccttcctttttttccataaccttttacatttcctttccattttccttattcattataattatatttacattttttttctttttatttctccaccctttttcttatttaataacttccctcttattttttcctacaattttttcaacttcatatcctccatccaacatacttcccttccctaaactcacacatcacacactcccttcctttttttttaattactactcctcacctttctttcctcctttccttcccctcactccatcctcctngacgctttggttccctgtctaat

SEQ ID NO: 536035 - DNA, 1065 bp, Homo sapiens
  misc_feature (1065)..(1065): n is a, c, g, or t
gaagatggcgggggcatactaagacctcggagtcatgtagtagtgtactaatgagcggtggcgcaggaccgtaaggctaggagcgcgcggtgacgagtgtgagcccggatcctcggtctccatctcttgtggtcgcatcatcgtccgacgttattccacatcgctattgttgccgagatcgtggatcgtgtgtcccggttgggcgcctgtgtcgacggggtgggcccgagtcatatcgttccgggccattcactggaccaacagcttgtcgtagctcgtcattggagcggaactcggataccgacagcggctcatcgtgctgagagctcctgaacgcggagaaccatgcatttacgagcgatgggttacgagccgaagtggggcaaagtttgtgcccgaagggaaggtggcttgctccagaggataactatccaaagggaacaaaaaaacaatgggatcgaagtaaatacaggtggcggggtcaaacagtccaacaagagttgatacatggggctttccctgtgaacaacctgtgggttcccaacgaagttccggatggccaaggggccgttgcccctgggtatccacatggcccagggacagtcagacggaaccggaactgacgggtgcatgcatttccaaggcaaggccccagattggttgtaccccttgccagttggggcccagatgaagtcacggcattccccttttggactaacacgttcacaatgacacggacacatgtctggaaccccaacgaatgtgtgggatcacaaacaccgcttgggaaaagcaaagttgggaacacgcaccggtttcaaacacgtaggattcccgggaccgacaggggaacaacggtggtggtttgaacaccaagagggcactgtggtatttgaacacggttggacagaccgcagtgtcaagagcatttgttactatttccacaaaggggtcaggcgaaccacggccaacgtgaaaggtgtgcgcacatcttgtgctgccactcacccaaaggaggcacaccctaatgtggtcacaccatgcacagaggacctatgtagagcn

SEQ ID NO: 536036 - DNA, 232 bp, Homo sapiens
ggtagatcctcaagatagaatgctcctgattcagcggtggaatggttttccgatttgaataaaatggttgcattatctgcaaggatcataaaggctaggtacttttatctcaaagacagtatggatttgtgggctgctatattcttagtgctgtgggcatggttggtgtccagtaaatatgtgataagtgaatctgactttgggcacatctccaatttctcatcctagggag

SEQ ID NO: 536037 - DNA, 162 bp, Homo sapiens
  misc_feature (35)..(35): n is a, c, g, or t
  misc_feature (61)..(61): n is a, c, g, or t
aaaatggaaacttgcaaatacctgtttttaattanttttaaattatatatatttaaaattncccaggtgcagtggcttacacctgtaatcccagcactttgggaggctgaggtgggcagatcacatgaggtcaggagtttgagaccagcctggccaacatgg

SEQ ID NO: 536038 - DNA, 1204 bp, Homo sapiens
cgcttttctctttttttcttgtagatcgcgcttttgcttctttttgtttttctttttctgtctttctcttctcttttttgatttattccggtgtttgttgttcggcttgtgttgtgctttccttctgttgttgatttctttcttcttcttctttgtttttctggttctgttgtgttccgtgtattcctgtttgctttgttgttttttttttttctgttcctgtccctcttgttttggctttcattctcgtgtctgtatagtgtgggtgctgtttgtctcgtatggtctgttgtttttgcttcatttgttttttgtctggtcctttttgtgttcttgttttttttccttgttttgtcatcctctgttttgttttcacttttagtgtgttgtattctttgtttctatggtctgtttggtgttttttctttctttttttcttggcatattttgtgttcgtttgttattgttttttttttgttgtttgttctgtccgtttcatttcgtttttgttctttattttgtttctgtgtgttttaagtatactgtgcaagtttatagtatctggttatattataatttccaatgctggacaatgtagtattttaatgttttctttttcttttacatatgtcggtaccatgttatagtattactcgtgttctaggatgtaatgtccactgtttgtatgttgaatgtcatctaatgcttattattggtttttatggaatccagtgtgattatggttttatcctatcctgtatagccagatgtatcaggtgtggtatcgtgcaacatttcatgcacattttggattttgtttgtcattcaaaattgtgcttgtaaaaatgtatacaatttctgagttttataatttctaggtacttgttttttcttgctggtaaatagcttttttttaaaaaaaaatctaatataaaagaaaccatgtttatattttgttagtgatcaatgactttgtttatatggaaatttgtatattgttggcacacattttgttgaggtttacgtgcatgaaggcctgcaataattagcacaatgaaaactgctttttcttacatgttcatttttttgaaagattgtggtgcaaaggcttactctaataagtaaccttctggactatggaatgaatataaatgaatggcactttgagtgttaataaagctaatatttatttccactgtgaaaa

SEQ ID NO: 536039 - DNA, 677 bp, Homo sapiens
ggctgcttgtcagtaggaatttggggtgggggtaaggcgcacacaaagaggggatggagtttcgtgtggttgagtcctacgcatgagggagtgaccacctagctttattatggtgccaatgtagtaagaggggagatgggtggattgaatctatacagcaattaccacaaatgcgttaggctgttatcatatacctcatgatttatggatacactttgaaatgacaaataagatggagaactgattcggttgccaggtaggaaggcagagagggtgggagatggctgtagttaccatgtgtggcatccttgtgatgggacgtctgtatcaccaatgtgtgatttcacaaaaatctatacctgtggcaaaatttatagaactaaatatacacaataatgcatgtgaatgtgaaatctgaataaggtgattgataatcatgtcagtctggtgatatgactatagtctgaattgttaccatggagaaaactgggtgaggggtcatagaatcttctcattatttcttccagctgcatgtcagtttaagaattgtctccaggctgggtgtggtggcatatgccctgtaatctccagcattttgggaggccaagtgggtggatcacttgagctcaggagttgagaccaactgggcaacatgtgaaaacccatcttctacaaag

SEQ ID NO: 536040 - DNA, 1171 bp, Homo sapiens
  misc_feature (232)..(232): n is a, c, g, or t
  misc_feature (596)..(596): n is a, c, g, or t
  misc_feature (979)..(979): n is a, c, g, or t
tttttttttttcccgggaagcaagtcttttttatggacggaataaacacaacattgtgagtggtagataggaataaagttggggtggcaagtgtctcctgtgttcacgtgcaatttagtgacaattcaaattcagaacctacataacgtggggcgtgcttttgtgatttcttttacaacttgtgacacttgtggatatatctctgtggtcacagaggggcgcttcttataanatgtagaaacacgagaatttcactgtgtgccaccacacccctatactctccacctatatttatcacggtgttccggtggaagaatatacaccacaaattttttataaacagggggtggataaggcgctataagagagacacaacaaaacaagagatattataactataccaaatatagaggctatagtggaggggcgtcccaatctcaaagagaagagtggtcttataacctatttactctcaatttttctctttctctgtgtggagacaatatctctataaatataaaaggggggtgtgttctaccacaatgagagggagtataacatattagcctctcagacggggggtctctccccccaanccgagcgtgtgtcccatcttccacaccctgtgtgtctaacaaatggcgcccttatagagccttcctacagagcctctcctttaagagaggggccatatctacacccgagagtggtgtgtattttctccaaaaagaagaaaacccctttaacaatcttcctctacaagagaatactatgtgtgttgtacccaccggaagtcaatatttctttttttatataatatctcccatgaggtggtatttccgctgtgagtccccctcgtgggcggcgcaccagaggaaatatatttctcggtggacaccgcgtgggggggtggcctatctacgagggggctcttgtgggtaaccccacaaatttaaggccagttgcaaaattaaggctnagcgtggaccatagtggcagaaacaaactctttttccgcccctccgtggtccaagataattcttctccaaccaaaaagaaaactttttttgtgtctctatctcacacacataaacttaattctccttatggggagcgggtgctgtcagaaaattcaaagacaataaaattcacattcccctataaattttgg

SEQ ID NO: 536041 - DNA, 371 bp, Homo sapiens
  misc_feature (23)..(23): n is a, c, g, or t
  misc_feature (28)..(28): n is a, c, g, or t
cacccaagaaagcgtttttgtgnagttnaatgtttccaaaacattttagttctcccacatttttatttcatgctttatgatgtcagctcccctcaactcaaagctcaagagaaggaggtttgttaaaaattgcaatcaaggtctagatataagagatttcagaagctaaaggataagcatttgttcatacaggaggggttattaatggttgcctagtaaataattacctcaatgaaattagtggacatgaaagatacatttaatgtaatcgaaataacagtttcttcattcgaaatggggataatctcttctgttcaaattgcttctagattcagagaacagacaggttaagtccttcttatcatatgttt

SEQ ID NO: 536042 - DNA, 135 bp, Homo sapiens
gtgtcacgccatacttctgcctcacgtctctagtagctgggcccgccactacgcctggctaatttattatatttttagtagagacggggtttcaccgtgatagccaggatggtctcgcattctcagacgggtcgc

SEQ ID NO: 536043 - DNA, 529 bp, Homo sapiens
gagaatggaaatagaatagaaaattgctattttctaatagaaatttagaaagcagaagtaaaacttgagcgttctatccatgcccataagaaatatggtttccaatggggtttaatttttgttatcccatgcccagggtttttcaaccaaaaagagaatttggccccttgtcttccttttgtaataagctacaattttagcagcagaggcaagagattggaagagatacagacaatttttttaaaggcttatacccaatgaaacacagtcttttaaaagcaagttgcatgaaaacaaaacattcaaatcctgtttcttcctgcaaataattttaaactaaccagctaactgctaacataccactgacctttgccttggactcgcaggttttaggaataatctaaagatagacatttttttttagtgatgaatatgattaaattacaaacgcccgttttccccttaaagaccaataaataatgtttcaattttaagcaataaaaggtcgaaaaaaactcaaaatcaacaa

SEQ ID NO: 536044 - DNA, 663 bp, Homo sapiens
cagcgctatcaccgggaaagctgttataaacagaaagctcctaatctgcgctttcaccttacattatgttacagaatggagaaagccaaaaaggggagagcatgtggctaaaccacagaaagacagatgcctaagaggaaaaattttaaagtgttcctaaataggtattagaaggggaagggggatgtaaagcttatgtgatttacatcattttgttaatctgctaatctacttccctggaaggtgagaaagagtgttgtctgccttctgcaattgaagagactagggcagaaacttaattatgttcttaccctgtgtatacctggctgtcatctggctggcaactagtccacaaactattggttcaggcatttgcctggcaataatgttagccatcatttaaattgttaaatatggatcagaagatctctaagaattactgatatgcagctattaatactggatgtaaataatattatttggggtgtgggtaaatcatttgactggaaccacatttaaaaaaaggacttggaaattttatttttgaaatgctgttggggagatggcattgatgaaaaaaaaaattgaaaatgcgaaaaaacatcatctacaaagagatgggtacaaatgactaagcaaagaagcttgttaccttcgacctga

SEQ ID NO: 536045 - DNA, 128 bp, Homo sapiens
gccccccaagccaggaaaggagttgaggaagggttgggtggaccaggaggcctgcagcttttagattgatgcccctgcccccgcccatccgctccccccaatgaaataaagtttttttttctttccca

SEQ ID NO: 536046 - DNA, 366 bp, Homo sapiens
  misc_feature (154)..(154): n is a, c, g, or t
  misc_feature (208)..(208): n is a, c, g, or t
  misc_feature (273)..(273): n is a, c, g, or t
  misc_feature (350)..(350): n is a, c, g, or t
aagatctggttgtttaaaagtgtgtggcacctccccactctctcttgctcctgctccaaggctctctctcccgactctctctcttgctcttgttccagccatgtaagacgtgcctactttcccttcgtcttttgccatgattgtttcctgaggnctccccagaagcagaagcactatgcttcttgtatagcctgcagaaccatgaggnaattaaacctcttttctttataaattacccagtctcagttatttctatatagcagtgtgagaagnaatggggtttcagattgcatctgaatggggacataataatttaaataataaatttaatttataattaataataacangtaattaatataatta

SEQ ID NO: 536047 - DNA, 696 bp, Homo sapiens
gaattcggcacgaggtacattgggtgcctaattgtagacagtgctctgaaggagatttccatggtattatggaggtgtgtgacagagggaccagtttgatccaaggggtagtcaaggaaggtttcctggaggtggggacacttgagtcgaagcctgaagaacatttggcagttaactgggcagaagagaggggatgggatagagatagaacattccaggctgaaggaagtctcctgtgcaaagctcctgagataggaagatgtttgaggcacttgaagatagctgatgtggctgtagttgggggtgcaggggagagagggattgtggaaaggagagaagtccacacagtgccgttaataccatactggattctcatcatggtctggagggcaggacccatgggtcagtaagccctgcagcttctacagatttctactatgaacccattaccctctatgatggtccttttcccggtcatccccattcttaaacccttggagtaactgatttcattgtcgtgttacatgatctttaaccattgctttattcgcttccaactaacttagtattattctgtattcccttcttcattttaccagttgttgcatgccattctttttgtatattattcttccttctttatctcctttttatattttctcatatcctcctttatttctcttctttctttcttcc

SEQ ID NO: 536048 - DNA, 943 bp, Homo sapiens
  misc_feature (12)..(12): n is a, c, g, or t
  misc_feature (37)..(37): n is a, c, g, or t
  misc_feature (374)..(374): n is a, c, g, or t
  misc_feature (448)..(449): n is a, c, g, or t
  misc_feature (451)..(451): n is a, c, g, or t
tgtactctccantcagatggcagatatgacctgaccnaagcaagtacagagcttgctctgcatgttctgccccagggttgtagcctaaagactgaatgctgccattgtcccacaagaccaagtgtgccatacacttggttgatgactggtgccccactgggtttcaggttggctttaatttccagccctccaatagtagttccccaggcaaagtgctgagcaataccacaaccatcacaggggcctgggcctttatcacaagcctgccaagcaagcacttacaaaccagaatgagagtgagggcatggagaaggggatgttttatgagggcttcaatggcctggctgctttgtaaatattttttggttttggtngagacaggtctcactgtgttgcccaggccggtctcaaactcctgacctcccagagtgttgggattataggcgtnncnaccatgcccagcctgtaaatgtttataaagaaatgctgtaataaaacatattgagaaagcaaatgtggcagggagataataagaaggacacaggatgataagggaaagtggtagctgggtcaagggaagggcctgaacatcaatcagctgtagtgacttctcaaaaaaaaaaaaaaaaatcacatgactttagggcttcttggactctaatttgcatgcagacttctgtggatcatgttgaattgtagattctgactctgtaggtctgaggtagaacctgagatctctatttctaactagctcctagttatgcctgtgttcctactgccaatcagcagactaccctttaagtaatgagctctagagcaaccctgtctgttagaacattctgtaatgatggaaatgttctagaccacactctctgatacagtagcgattactacatgtgggttgtgagatctgaatttggctagtgtgactgaatttgaatgt

SEQ ID NO: 536049 - DNA, 231 bp, Homo sapiens
gcagcacgcatggtctatggaccggtgaccaccatgcgggacgtgcgcaggcagaatgcccgttcaagtatgcccctgggactgaggccgccctgcaccttcagcggatttagcggcttaggctctttatggtaactggcagactttccaagcggaagaggccacgcggcggtagaaggagcagtctatctttggtgaccatcggaataaggaggacgagacccacatcgc

SEQ ID NO: 536050 - DNA, 537 bp, Homo sapiens
  misc_feature (88)..(88): n is a, c, g, or t
tgggtcgagttagctaatccatcaaacatgttccacatccattcccctcaccactgtgcagtgtgtatccgtttgtgcgaaaggaaanactactctcttcctggcctgtcagcaccagttttgccgcagctgctgagagcagcactgctcagttctcgtccagtacggcgtgagcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactggcccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtggtgcagacgaactctgaaacagccaactacatttgtgctcacactaaagactgtccc

SEQ ID NO: 536051 - DNA, 318 bp, Homo sapiens
cctacctggcgcggcggcccaagctgcagctgagcgtgtacaacaacgaccgaggtcccacctgggtgcttgagacaacaatcgaccctggcttgaattttggaaggctttgaattgtggggtccaattttaaagggcaaggtaattgtttctgtacccaaggaaacggggaacaattgggacggtgaattgctaacatctttcctcctaacggttggggtcctccgtgaccggcggaaggaaggttaacctggtaagttcctttaccccctaattgtcccaagcagaagaagtaatcctgttacccgggggtttata

SEQ ID NO: 536052 - DNA, 364 bp, Homo sapiens
tgggtgatggagtacaatttttagaaattacatattgggtcagttttgttttgtttttggtgaggaaaaggtggaaataggaaaccatgaatgggaaggatggcaataagtgcaactatactttccaatgactaaagaaagaaaatcttcagtatattcgttctcatgaggacacggtcagaacactgaacatggtattgtatgcactgcaaacgttacactgacacggtcagaaccatggctgggtggatcgcacgctaaagctctgccacctaaaaatcacaaagcacgaggttaacacggaaacctgggggggagtgtggaaaagggaaaactcgtttttgcctgaataaaggtcgaattt

SEQ ID NO: 536053 - DNA, 405 bp, Homo sapiens
ggcacagctatgaccggtgcagccggatgtgggactcgtatctcgtctacctgagagcatgttagggtggaggaggaccgtctatgtagaacagaagttgagcagtcgggagtaccttcaataaaggagaccgcactgttccatcgcggtctagtatttaagaagtggaacttgacagtcctccttctaccaactccacctccaccccctcattccccttactcccaaagtactactgctgtagcatgacaaccccaaatatgttctgtcaacacaaacctgcctttggtgtataaacagggcattacagaatggtacaccctatatatttctgtacagtatccattcactagttcttcatttataaatatcatcttccccattctagctgctgaatgcgtccgt

SEQ ID NO: 536054 - DNA, 116 bp, Homo sapiens
ccagtcacgctaccagcaagccagctggccactactcccgcatccttcaaacgactgatccccaaccccaaccccaccgcaaactgatcagcccacacttcccaccacaacacgga

SEQ ID NO: 536055 - DNA, 633 bp, Homo sapiens
gcccctggccagactttttgtggtaaaacgtgccctggtgttgacgcaccattgtatgaaccacgggccgagaaccctgcaccaaggaagttttagtcatggggcgaccctttgcgggtggaaactacctcttgattcgtgttgatgctatagcatgttggaataactgttggcgggtcattgttattccaggcgctatctttataaccgggtcaaaaggatcagtggttcgcccacatatgtgggcggaaaagacctcttcatgataggagaacagccatcttcttgtattagaatagtagcgcgggacacaccttgtcctcttgttggcaacaacacaggggaagtccatatatcgggggtaatgcacaacgcgctgtttctgctcacggagggattccactcttgggggggtagcaggcaccccataccacgtcacggccgagaggcctatgtatgtttctccacgccaccaggcaggtgcatccccctgttgtgctaccccgcacagtgaagacgcatactggtatgtgcatgtttgggagcgctgctgggatgtcttaccaccggacactgttttcacgaagggcgtcgtttttcccatgcatttaataaaaaaccccccacaaaaca

SEQ ID NO: 536056 - DNA, 387 bp, Homo sapiens
tttcagaaaagtccccatatgattctgatgtacatccctgattaggaaatgcagtattttatttttattttttgagatggagtctcgctctgtcgcccaggctggagtacagtggtgcagtctcggctctctgcaaccacctcctcccgggctcaagcaattctcctgtctcagcctccggggtagctgggattacaggcgcatgccaccacgctgggctaatttttgtatttttagtagagacggggtttcacaatgttggccaggatggtttcgatctcctgacctcgtgatccacccgcctcagcctcccaaagtgctgggattacaggcgtgagctaccgcacccagccagggatgattttatgtgttaaaacagcaaagttg

SEQ ID NO: 536057 - DNA, 339 bp, Homo sapiens
gagctcggccctctatagggcacatcaatagcgcaagtgcgttgattgtgtagtatggaatggaaagtgatctgatcgtgaaatggtaagtcgcatacctagttgggttgttcgctcccgttgcgtgcataaatagtaggtggcttgctgctatggctgcattaatgacaggctaaattaagtgataggtaatcaatcgagtgagggtgtgactgtctactgagtaccctcctcacattcattgaactctgtctcgtccctatgtattggatggtggttagtaagttttgtactgtctgtgcgtccctctgatttgatgttctggcttatcgaggtcct

SEQ ID NO: 536058 - DNA, 208 bp, Homo sapiens
atagccttccagcccctgttccctccaagtgcacatttagccttaaaatcctgggagtcgggagaccccgtggagtccttacatccccagggtttgctggttgtggtcaaaaggcagtaaagcaaaagtccttttgtgaaaagtgtttttatgtaaagatgtttatatttaagtagtttttttataaataaaagcctttttaatggca

SEQ ID NO: 536059 - DNA, 376 bp, Homo sapiens
cgacgcgtttgcccatgaaagccgttctgggcatcttgtcactcttgcactatgcagagatctgaccatttaaacttatgcaataccgaggaaaggcttccaaaggtaaatggggattcaggaaatgtccagtgcaaaccataacagcatcaaagacagctctatttagcttgccctctgtctctgtgacaacataccactgaccagtttcggagaagtctggacgcttcgttatgctgcacacagtggtcttaaactgaatgtatttcaggaggtcaaggtgctcagcaaattcttggagatagtcccgacatttttcatggttcatgatattaggataatcttcgtggaacgggaagtcactgtaacatgacat

SEQ ID NO: 536060 - DNA, 122 bp, Homo sapiens
ttatacttactccagtcatcgcttccccttgctgatatatcggtaattgcgctggcagtccattcgccatcgttatttttttctctaattgatctcagttcatcattagagataaacttaaa

SEQ ID NO: 536061 - DNA, 215 bp, Homo sapiens
tactaaaatgatatattctctatcaagagcagagaaaaggttcacctagaaaaagagagctagcagtggatgctctattcccaaccccccttctctccccttgggtcacaaagttgtactatacattgtcctatatgctacgtaggagatgccttttaaatacagtctagctcagatcactgtaagattttctgctggtgtatagcaacttaggt

SEQ ID NO: 536062 - DNA, 201 bp, Homo sapiens
ttgggcactgctcaggctattctccaaacagaagaaatttaaggtttatgaagccaggctcactgaggaggaaactgtctggtgctggcggatagccagggagctgaaatgcaccagggtctggtaatgcttctggcgcagtcgtgtgaactgagactgtattttccgcttgtccatcatctccaaacatctctgagccat

SEQ ID NO: 536063 - DNA, 241 bp, Homo sapiens
gctccttctccagctctttctccttttccgcaagtctctctctgtcttatgccctctccttctctcgctcaggttcttgatctgtttcaagttctttctcacgctcccgttctttttctcgctcccttacccaaatttcctcggaaaatggtagtatttccaggatgacaagcttctcatccaatcgtttcagtttctccgcacaacctgccttcctttgttcatccattcttcgctcttc

SEQ ID NO: 536064 - DNA, 263 bp, Homo sapiens
ctgtagccaagacattcctttgtagtgataaccaattctcgacgagaagcagaaaatctatccaaaacctggaagtgccgcctttctggaccaaaccaatgtatgccttatgtgtatttgattcatgtctcatgtctccctaaaatatgtaaaaccaagctgctccccgcccaccttggacacatattcttagggtctcccaagggctgtgtcacgggccatggtcaactcatatttggctcagaataaatctcttcgaataa

SEQ ID NO: 536065 - DNA, 121 bp, Homo sapiens
cgactctactcgaccgcgtttggtggtcttggtgacttggtggtcacctttcggcgccggacgcctacttacgcttttacgacttctgctacaacacggttacgggggactcctctacgac

SEQ ID NO: 536066 - DNA, 378 bp, Homo sapiens
ggccttagttgtctggtttctgcttattttctcctaaagaaaacatacactggtataggccagatgcggtggctcacacctgtaatcccagcactttgggaggccaaggcgagtggatcacctgaggtcaggagtttgagaccagcctgcccaatgaggcgaaactgcatctctactaaaaatacaaaaattggcctggtgtggtggtgcgtgcctgtggtcccagctactcgggaggctgaggcaggagaatcgcttgaacctgggaggcagtggttgcagtgagctgagatcatgccattgtactccagctcaggtggcagagtgagattcagtctcaaaaaggaaaaaatatatatatgtgtgtgtgtgtgtgtg

SEQ ID NO: 536067 - DNA, 1010 bp, Homo sapiens
  misc_feature (199)..(199): n is a, c, g, or t
ttgtcgctacgatagtccgtggtgtgttaagtgttgtcctggtgttcttcgtctgtgtcgcgtggggccttcttctgtagtggttgctctcctctagagcgcggcgctcttgtcgcgtcccccggtcccgccccggctctctggttcccgcccggactgcttttctctcccgccggggccggccccacatatttcccanagcgccgctcaacaccacagtcgttgaagtggggaagaagaatacctcctccgtggtgggggaagcctgtgagccgcgtcccgtcttccggaaattattccgcagcccgtcggctcttttttaaaaagtcgccaagtgggtatttggtctgtgctctccccgccgcgccggttgttttctcgacgcccggaccctgtcgttgcgtgttttctcggggtccggccgccccaatattaatcgggggacgcctccccctctggccggtgcgttattatatttggcacattaatggggcgccccgcccctggttgatactacaggtgggtcaccgctggccacgcccgttcggctcaagaggcgccccctcttgtgctcgccgccccggcgtatttgggggcgcccttctcctagactctctcccgagtatgtctctctctcgcgcgcggtgtggtatccgcccgccgatattcttttcccggtagaggggcgcccgtgggactctctcttgggatatgtcggaaggaggcccccagacggctttactccgctgattgtgcccaacctctcacgtgtttgggatgctgttgtgccacgaagggcaaccgctgagcgctctgagagacacatgttcctttccccccacacggggtgcccagcacgcagtgttcctcccgctcgcccctctgacagcggagaacttttttgttgagtggggcccccctattttttttctactgctttttcacggcgccccctttaaaaaagggttaatccaaaaaaaagggacacggaaaaaaatcaaacaaaaaca

SEQ ID NO: 536068 - DNA, 467 bp, Homo sapiens
cgcgtatgacgagcttgcatgaactatggttactaactagactctactagaaggaacgcaacttgcattatttctctgcagccagcatcattgaaggaagcccgtggtgtaatatggctgctagaagaacacagagacaagttcccagcattgcatagtgcgttagatgaattctttgatataatgtgacagccgcgtgtactgtgttaaggaaacaagatagtggtgaagcaccgtttagttcaaccaaggtgaaaaacaaaagcacgtaaaaagaagccccaggattcaaagcctatgttagttgggtctggaacaacttcagtaacttcaaataatgagatcatcacttcaagtgaagacacatagcaatcgaaattcagattctggaggcccatttggagtgcctgaccatcttcggcaagatgtagaagaatacgaagctcgtcatatcggggtaccgagct

SEQ ID NO: 536069 - DNA, 96 bp, Homo sapiens
gtggacacagccacatattactgtgcacacatcggcctgtttgggtcaccagctggccccccctactactactacatggacgtctggggcaaaggg

SEQ ID NO: 536070 - DNA, 145 bp, Homo sapiens
aaaaagttgaggtatgctgaaaccagtgacatgattccacaacgatggaacataggcaaattatcctcattgataattgcactgtcctgtaaagcaatgagcagacgaatgagatcaataactacttcttcgagtagaaatagaa

SEQ ID NO: 536071 - DNA, 262 bp, Homo sapiens
cagcgccagtgaatagactcatctgtgtggacgtgtccagctctcgtcagaatcgatagagaagtgtaattacctgagggagtattggccagaagtttgcctccttactgctgggatcttgtggatgtgtctcggatcccaattgcgtactcctagtccttactttttacctggcgggaatgtaaaaagctgagctgattaaattttatctttttcttggagctatttcatccttgtaaaaccagtccctgacagtacctat

SEQ ID NO: 536072 - DNA, 391 bp, Homo sapiens
cctctgcatataagatttactcttaataggccggacgtggtgctcacgcctgtgatcccagtactttgggaggctgagacgggcggatcacttggggtcgggagttcgggaccagcctggccgatatggtgaggccccgtttctgctgaaaatacaggaaaaattacccaggcactcactcttgaggtaactaaccaactcccacgataatgacagtccattcatgagcgcaaaggcctcatgacctaatggcacgcgcctgtggtcccagctgcttgggaggctggggcgagaggattgcttggacctgggaggcagaggttgcggtgggccgagtaccgccactgcgctccagtctgggcagcggagtgagacttcatctcaaaaaaag

SEQ ID NO: 536073 - DNA, 160 bp, Homo sapiens
  misc_feature (34)..(34): n is a, c, g, or t
  misc_feature (137)..(137): n is a, c, g, or t
gtgaacggcaaggagtacaagtgcaaggtcttcnacaaaggccttccgttcttcatatgagaaaaccatttttaaagcgcaaaggggcagccccccagagcccacaaagtgttacacacctctccccccatttcccngggggggggggagagcccagaga

SEQ ID NO: 536074 - DNA, 176 bp, Homo sapiens
gaatctagaggatcccgaaaccctaaattacggatcatagggggatagctatacccaggttattgatagttgtgtggtgggtgtgaatgagtgtggtagtaggcctaggatgtttgttgagccgatgaatataattagagatataagtattagtgatcaggttgggcctttttggt

SEQ ID NO: 536075 - DNA, 564 bp, Homo sapiens
cccccccccagaatgcacgatatttttcgtgagaaagccctctacacgggggagagagccctgcacccctctcgaggtgtgaaaccctctcggattcgcattaggaaaatgtaaaggccacagatccccggataaggaaggaattcctccctgatcccccacgagactcgtattctttgctggccagcacactggaagatggacgctactcttgtctgactgaccatattccaaaggagtttacttcttcattctctgtgttgagacttcgtggtggtgtcttagaaaaggatagtaagatagttcttaccccccttccccagatagttattaagccccagagaaagaaggttatagctggctgtcctgaaatattataaggtggatgagaaatggccaaattagtcgccttcgtcgagagtgcccttttgatgaatgtggtgctggggtgtttttggcaagatcactttgaccagacattattgtggccaatgttctccgacttactgtttcccaccaacccgaagaccagttaactgttatgagtttattaaagacatgaac

SEQ ID NO: 536076 - DNA, 318 bp, Homo sapiens
gaaactgtagatggtagctaatctctctctctacctatttttctaatgtcatgattcctgttctgcccaattggattcaatttgtattgttcaaccacttttattgtaaccaacctttatctggcaacataatttgcagcacaataatgatttgcattgataccttgagattggggagggggcatgcaagtgggatcactttgtcttagcaattaatgggatattgattactaaagtgtaaaggctgccattatgacattaggtatccaacataaccatctggagtgtgtccagcttgttcttcataggaccaatcgt

SEQ ID NO: 536077 - DNA, 932 bp, Homo sapiens
gggttgtagctggctgggtggctctggggtcgcggtcggcgctggcgctgcgtgtggtcggccgaggtggtggcggcgtgcgagcccatcaccgtgggcctaggccatcggggccgcgttcggccatcaccggtacctgtcctacacatgacatctactgccgcttcgccgagtgctgccgcgaggagcggccgctcaagcgcttcggctctcgagagctggatttggaggagaagtctgtattggacagcgatctaggccgacggcaagtgatctttcaaggcgctcgtaactggcttcaggaacaaacaagaaatcccaatgaaaccactgacccttttccttacacggctgggctggcgacaggcaagaatttttgtcagtcaaattgtggctgtaaaatcttcacccataaggtctgaagagtaactttgtgcacctgtttgtatcgactctgcgacttccctcatgagcagaggcataatagactgtaccaggatcagtgtacagaaggtggatccgcggtaatgtgagtgcatgtgcgacagctctgtttcatatttgcacgagatggataatattgtgccccgggatcattgagcgccatcaagccgtttctagattactaccgagcaggttgacggagtgtcttaccgtcaatgccatcttcattctttactcagcaatgcctgcggagcgcttatctctcagacggctcttgacctttcggcgggtccggacacaaaggagggacgacatttcagctggaagacctggaacctgtactgctgatcggcgctttcctataacccagtggctgttgcccagtgctggtccacaaaccatgtttcttatcccttcgtgttgagtacgacttcactttttaggccaagaggcgtgttgcagaatgcttgacatggtcaggctcccaa

SEQ ID NO: 536078 - DNA, 285 bp, Homo sapiens
aatcattccacttcaccctcccaagtagctgagaccacaggcacacaacaccacaaccagttgattgttgtactgtttgtatagactggatctcaatatgttgcccagactggtcttgaattcctgagctcaagcagtcctcccacctcagcctcccaaagtactgggattacaggcgtgaggtacctcgaccagccccagttacagatttctttgttccttctctctcccgctgcttaacttgattagcctttaaaaaagaaataaataaaaatttttaaattt

SEQ ID NO: 536079 - DNA, 300 bp, Homo sapiens
gcaccttcggttaacttgcatctccagattgattactcaagcaaacaacaacatatccatgaacaatggaacaactatcaaaaggtataacttacatatactgggaatatcaaaatgaaaagaaagagacagagaaacagaataaatatttgaagcaaccgtgactgagacttcctctaaattgatgcccgacaccgaagggaagatccaggaaattcaggtaataccaagcaggataaatgccaaacaaacaaacaaacaaaaacaaacaagcccactttagcataccattcaaagtta

SEQ ID NO: 536080 - DNA, 392 bp, Homo sapiens
aagggttcctgaaatggcatttgaaaccatggggggtccagactggaaaaggagggggttttactggaggaatgggccccaggaccagggggttaacatggaacccaggattgaatgggagaagatgttgaaaggtattggggagcacccagtttattttgcaggggatgaattacccacagtccgaaggaaccttgattcccgaggggtagaagtggatccaggttggattaaggttactgggcatcaggtttatggaggacattttttaaaaccagttttaaaccattgtaacctttgtcgggatgtggcctggttttggcgtatccagggcatgctggttataaccgcaaatactttagggcaccaacttacaattactgaagttaggc

SEQ ID NO: 536081 - DNA, 492 bp, Homo sapiens
ggtggacagtgacatctgtctttaaaccctgtgtggcaatccctgacgcaccgccgtgatgcccagtgaagacagtgcgacctggaagtccaactacttccttaagatcatccaactattggatgattatccgaaatgtttcattgtgtgtgagcatgacaatgtgggctccaatgcatgagtgcagcagatcctgcatgtcctctttcgctgggaatgtgctgtgtgtgctgatgtggcaatgaacaccatgatgctgcaagtgccatccgaggtgcacctggaaaacaacccagctctggagaaacttgctgcccctcatattccgggggggcaacttttgggcttttggtgttcaccaagggaaggacctcattgagaatcagggacatgttgctggccaataagtgtgccagctgctgccgtgctggtgccattgccccatgtgaagtcactgtgccagcccagaacactggtctcgggcccgagaag

SEQ ID NO: 536082 - DNA, 1088 bp, Homo sapiens
  misc_feature (304)..(304): n is a, c, g, or t
ggccagctcgctgttcgctatggcgttggtcaccgtgaaggccttaccttctgggcaaggaggacgcggtgcgcgatgattctgcctgcttcacgcttctgtctgcagtgcccgatgccttgatggtcgggacagcgcgtaggtgcgtgctggtcggggttcccgtggagcccgtgaccgtagtcgtgcctgcttgagccctgggtgggtctgacgttgctaccccgcggcatgtggccgtgagtcgtggttccatggcagcacttaccggctgaatgaggacggcggactatgggttgccgtntgtccagatgaccgacggtaatttgcacaatggccaatgatctctacgtgcaaggggatgacatcattccgacattcgtacgatcttgagacggaggcaagagacacagaggttgcccaggcctgcggaccaacctgttcacaacgcggatagttgactccagcgaagggcagcctcgcggagaacttgttgagttgcgtacctcaccacatggttgaatcattagcgaataggtccttgcaacattgagagcgcttgtgtgctagggaaactcccgatgtactagaagtatgacagaccgggtcgttgcccctaagtacttcaccggacgtttggttcgttaggcggttcttagcggtcagtgcggcacaagcgggcctttgcgaaccttggtggtgagcgagcgaacccatagagggcataccgggcaattttccccccgcaaagggcccacgcgttttctggggggcgacctcttgatactttgcaaggtgcggtctttacgttctgcccaacctatgtccctgctcttaggagccattccgccggtggaacaggggattgaatattagcaatccgggagtaacacagctgtttacccttgggcgtttggatgcgcaccaaacgcagcaccttgtggcgaacaacaacgttggggggttccctagggccacacggtggaaaagaacccatagggtggaatggacccgcaagcagggttttccctttcgccttaccggtttggccaaagcgtggctgaatgggtgcacccctcaggcaccgg

SEQ ID NO: 536083 - DNA, 167 bp, Homo sapiens
tactggtgcagcggggaatgctggcatattgtaatgggtatggagacatatcatattagtaatgctggggtgaggtacgaagttttttcactagcgatgtgtatgagttggtcgtagcggaatcggcggtatgctgttcgaattcataagaacagggaggttataag

SEQ ID NO: 536084 - DNA, 145 bp, Homo sapiens
gcgacagggtgctgaggggagtgatggcagggaggatgcatggggcctgtgggaacagagagaagctggggtcagaggtaggagctgacgctgtcgggctagataggggggataacacgttcgcgagctgtcgggctagtcgggg

SEQ ID NO: 536085 - DNA, 186 bp, Homo sapiens
cccccgctgaccatggcagtgttttaatgacgaggtggaaatcgaggacgttcaataataacgaggactcgagaacgaatttctatccttgccaatgtggagaataacttcttcataaccagggaagattttgagaattgggaaagacggtgcaacgtgtccatagctgctctctaattataaagg

SEQ ID NO: 536086 - DNA, 118 bp, Homo sapiens
ggcacggcagacagaacctgtatcacctgttacgaccagcagcactgcgttcttgcagaagacctgtgcaccgggtgcattctaggctgcagcacttatccccttctgtcgtcttctc

SEQ ID NO: 536087 - DNA, 210 bp, Homo sapiens
catcatcccgcccaacaagaacgttagcaaagtggagatccgaccgtacgttatcgactacatcccggacctgcagatcgctctggagacgcacccggccctgtgaggcagccactaccgccgcgccgccacaccacccggccgggacctgtccagcgcgccgtccggcaccccgctcactgcgctcaacaccgacccggccggcgcggt

SEQ ID NO: 536088 - DNA, 480 bp, Homo sapiens
  misc_feature (17)..(17): n is a, c, g, or t
  misc_feature (55)..(55): n is a, c, g, or t
  misc_feature (59)..(59): n is a, c, g, or t
  misc_feature (232)..(232): n is a, c, g, or t
  misc_feature (427)..(427): n is a, c, g, or t
gtctgaccagtttcttnttcacccggcacgtatgggaaccgcgggcgctgaagcngtangttcgcgcgacggatttttgacggcggtatcggatcgatagcaaggacggcagggcagggcaggccgcgcaggaaaggtcagcacaaccatgagttcagataccatgcctgccatcgcgtttcccggtggtatcggcacgctgccgcttgccgatctggcaaagcgcaggttncttcgatgtcctgcaggcgatgctgcgcggggagtatcccgctccgcccatggccaaaaccctgtccttcgccctgcatgaggtcgagccgaaccgggttgtcttcaagggcgtcccggcgcaggagcatcttcaatccatcagagttcgccacccagccgccattgaattgccgcccggggcagggagcatttnaattccgttggggggcatttcattggcggttgggtgggatttttatggaattt

SEQ ID NO: 536089 - DNA, 155 bp, Homo sapiens
ttctggactgagcttctgactcctctgactctagttgaacaggcccagctcagctccggcaggaggtcacccctccacttcagcttgccctgacctccgctcgcaaaccccgagcttccaagccttttgctccagccctgtctggctagtcgggg

SEQ ID NO: 536090 - DNA, 361 bp, Homo sapiens
tccctttgccatattcccctaacaatgtctatcaattatcagtctgggtgggaaagcccccaacatccaatccacttcttccgtgcattcagggtcccttggttccagcttactctttcacgaacagcacaaacgagcattcaatatctcccctgggaagcgactcaggcaccagcaggcacaggcaatcctctcaatcggtcccatactcactcccaatacaacctcagggtacatccagcacgcagtacagcgccctaggttgcacctactcacatcgcccagcccagcacacatcacttggcaaagcatacattgggtccaccgtgcgtagcgcatcgtccccacactatcatcctca

SEQ ID NO: 536091 - DNA, 585 bp, Homo sapiens
  misc_feature (39)..(39): n is a, c, g, or t
  misc_feature (73)..(73): n is a, c, g, or t
  misc_feature (98)..(98): n is a, c, g, or t
  misc_feature (107)..(107): n is a, c, g, or t
  misc_feature (111)..(111): n is a, c, g, or t
  misc_feature (120)..(120): n is a, c, g, or t
  misc_feature (126)..(126): n is a, c, g, or t
  misc_feature (177)..(177): n is a, c, g, or t
  misc_feature (206)..(206): n is a, c, g, or t
  misc_feature (240)..(240): n is a, c, g, or t
  misc_feature (273)..(273): n is a, c, g, or t
  misc_feature (320)..(320): n is a, c, g, or t
  misc_feature (328)..(328): n is a, c, g, or t
  misc_feature (347)..(347): n is a, c, g, or t
  misc_feature (367)..(367): n is a, c, g, or t
  misc_feature (386)..(386): n is a, c, g, or t
  misc_feature (407)..(407): n is a, c, g, or t
  misc_feature (452)..(452): n is a, c, g, or t
  misc_feature (463)..(464): n is a, c, g, or t
  misc_feature (579)..(579): n is a, c, g, or t
cgctgtgccgcccagggcaccaaactgctccacacagtncccgtagtcccacacgcagatcacgttgcccganaacagggggctgaagggctgcagcncctgcagtnacanccggttganggcgancccctcggtctcggccaagaacacagccttcccggaggcctcgtgggcctngcggaatggcatccctttgcggaccaggnaataggcaagggcagttgccagcatgtcggggcngagagcctgtcccaagtcctcttggtgaatctncagcgtagagatgacgccagttgccacctggagcacggcacttatantgtcttanacttcaaacacagcctccntgtccccctgaaagtatatntagaaggatcagggaaganccttaagggtaaacaggagcncggcacaccgcccaaacacacgcccacgccatgcaccgtgaacancaccaaaccgnnaggggtttttcttctggggcatcaggctgcttcccgtgctgtaggcatcttagatctgcacgaagctgaattccttggtgcagtagaggatgaggtcctcggccatcctgccganatgggt

SEQ ID NO: 536092 - DNA, 760 bp, Homo sapiens
ggcccgaagtaagagagatagtcgaccacgctgctcgatacaagctggagagacgtgctgtgactcaccctagtaccattgatcaagtgatatggaatatcggggactctgtgtgacaaccccagtcaggcagcccacagccagggtccaggtggcagactcagctcctgtgcctcagttggctgtcagtagaatgggttggggagccagcctccagcggtctcacatagcaggcaggcagtgtcgcctggagcccagccaggggacgcatgtgaatcctttctgctttttaaaggacagacttttgctttaccacagacagtcgctcttgggtgacacacggaaagccaccactgagtttactataaagtgacagaggctggtgtctctaccgagaatgcgcgaatagtcacttcctgcctttgtccattatacgccgacaacgcgaccaggcttccgctctacattctttcagtggtgttgttgaaagcggcttggacgctccccatagtgtttgcacggtgtccttaggtcctatgagtgtgactgccttcttcttcttcttactttctttacggtatctacaaattcatctttgctaagctattctagcactaagtatttggcacaacaatctactgggacatgttgggagctccttttcctaaagaatctcacctttaccctacacgggggatccaggcacacgaacaacgcttccaacccgtacacgtctgacggatctaagctcaccaattat

SEQ ID NO: 536093 - DNA, 431 bp, Homo sapiens
  misc_feature (4)..(4): n is a, c, g, or t
  misc_feature (151)..(151): n is a, c, g, or t
  misc_feature (246)..(246): n is a, c, g, or t
  misc_feature (263)..(263): n is a, c, g, or t
  misc_feature (284)..(284): n is a, c, g, or t
  misc_feature (372)..(372): n is a, c, g, or t
  misc_feature (404)..(404): n is a, c, g, or t
  misc_feature (431)..(431): n is a, c, g, or t
ggtngcatttgtcgccggtgaagtgggtgccttgcgcgtgggttcgcttgcccatgacggcggcgcagtccgtgtcgggggctttgtcgatgttgaccagtggcagcagggcggccagcggggtgacgatggtggccagggcaggcggcgngcatttcagggccagcggcctttttgcgggcccacgtccggattcttgaacgtgcctttcgcgtacagggcgtgcgcagggtgatgatgcgggcncccttggtacgggggcnacgtcgaggtccagggtttcncttgccaggttgacgttgcccgtgacattcacgacggccgtgtccgtgttcgagcacgaagccggcgcacgtcggcctggccgtttcngtcacggaaaaatcgctggccaggcagttcanatggacttgcttgtcgccgaaaatttn

SEQ ID NO: 536094 - DNA, 347 bp, Homo sapiens
  misc_feature (8)..(9): n is a, c, g, or t
tctccacnnatggaacccttccttgggggttttgtgaaacttgtgaattgtgtgttaaaaaaatggcgctccacagttggaaagactaggggtgggtacatattggagacccccaaagagctgcagagtataaaggggagggaattcgtgcaggagcagagtcttctccggggttggctccccgtttctcacttttcccttttcattcccaccccctagactttgattttacggatatcttgcttctgttccccatggagctccgaattcttgcgtgtgtgtagatgaggggcgggggacgggcgccaggcattgttcagacctggtcggggcccactggaagcatc

SEQ ID NO: 536095 - DNA, 429 bp, Homo sapiens
tgggctccagttagttaggggagctggggcctcactttctcccagaattgtgggcttcactggaagtgaaggggcaggaatgactggactgtccaccccagccctgcctgcctgtggttttggccagggagcaagccatgaggtgccctggcacatgcacaaattgatcctttgcgtggcagttttgtatggaaaacagatgctgacagaattgtaggctaccatgcccccccaaaaggctaaatatctactccaatgggtttccagttcagtttgaagtcaatcaaatttttggattttcggtgtctcccgccccccttcgcccgtcattgtgttaattggacctttgcgatgggggggtttttttccttttgggcattttggaactgaagattcccctttcctttaataaaatattcaaaatcagga

SEQ ID NO: 536096 - DNA, 191 bp, Homo sapiens
aggcataggctatccaggacattccaagccaacatccccgctacatgctaacgaatcgaggcaaagtcaaaacaaaggaagatgtcactttggcacacgacacacccgatgcaggcagtcatgggggatgactgtttttaccccagaaatgcaaacaagtggcctactgtgccccatatagagactcccac

SEQ ID NO: 536097 - DNA, 677 bp, Homo sapiens
  misc_feature (651)..(651): n is a, c, g, or t
  misc_feature (675)..(675): n is a, c, g, or t
aaatgaagagatgtccgcagggttccagggacgtggagatgatggggctgttcgccccagagcaagatacagtctgatgggggctgggctttctagtgctgcgcggcagctccttgagtcttgggagtgtcagttacctaaagcaatgcaggccgtttgcctgattgcaatggaaagccaaacaaggaagcacaagggttttttagagggaaaggtttattttagtcgactaggaagtagatgggagaaatgttcaaatttgtctctcagatctgggggttggggcaggttttatagacagaggataatgaggtgcgatctgactgcatcgtgccatgaggtgatgtcagggctggatctgatcagatcacagattaagccctgaggtgtctccttcttaaatcagccctgctccttggtccaagtacttaggttccaccgtggttgcatgccaagtgtatctaggcatactcaggtaacataacttgaaaccaggtgtccatggcaacttgtaaacaacgcattattttattacacaaactttgaccacattgggcttgttcttgcagttcgtccctttttttggtttttcatttctcaatcttgagggagaatgggcgacaggcactctagcactttccgcttgatggngcacagacctttggtagagggatntt

SEQ ID NO: 536098 - DNA, 199 bp, Homo sapiens
ccggaccatcccgggacattgacacagcagccaagttattggtgctggggcagccacagttggtgtggctggttcagagcgctggcattggaaccgtgttggcagcttgatcattggctatgccaggaacccgtctctcaagcagcaactcttctcctatgccattcttggctttgccccgtctggccacctggagtgg

SEQ ID NO: 536099 - DNA, 576 bp, Homo sapiens
cctgctacgatgtatcccatcttacagcctctcgattactatgcagttaccaagcgggctaccaccttactaagactctggccatattctcattctagtcaaaaaagtaagtcatcggtttagtgggagagggcagctaaagcccaagttggtattggagaaagatgtacaacaggtcctttaaaaaaataaattacataaaatttgctggacacagaactcctatccagaccactagtcaatggagaagaccagaagccacaaaatacaatcctcagggagaaccagcctattcgctgtgtgcactcgtgcaacgggtaagccttccctgggggtctcaactctcagaactctggcttgttggacgtaactggtaattccttgcaatttcaccagaatatcctcctagatgggtaagcgagcagacattggacccctggagtgacactatctcaagggttgctcaactattggcatgtggcagccgattccaggccacgactccaggccactgttgccatcacccctcgcctggcttgcttgaaccaggccagcttaaaacaatgatgaacctcc

SEQ ID NO: 536100 - DNA, 1895 bp, Homo sapiens
atccatggaaatatgttctcttctctctcctttctatttgagcgggggtggggggacacacccagatacatacacactctttacatccaagaagtagacgaaaagcaccagaacttctgagtcacgggaaacagaaaactcagacctttcacatatacagtgaacatacgaccgtcactgatggggcaccgggcattgacatccaaaaaacctagaaacttcttcaacatggtcactcacacaggtatcctttggccaaggcactaggtagctcacgccgtgtaaatctacacgccccttttgggcaggccgaagatggggcaggactcaaccttgaaggcccacgcacgttccgagaccaagcctggggctcaaaccatggtgtggaaagacccgtggtctctaccttaacaaccacaccaccccgacaaacaacagacaccacaacaaccacactgtgcgcaccgcgcgcagcgccccacaagaaacaagctcttcaacaaccacaaaccgtgtgagggcgccggcacccagacaaagcagcgatgaccatcgggtcacacacacaggtctccttaagaaggacaaccccgtgcacaaacaacaaacagtgctggagactatacaccaccaaaaaaaaaaaaagccgccggcggcacacgcgcgcttcttgaacaaacccacgacatagagtcccgaaggacatcaaggggactaaccacaagaggccacggcgagccgacataataccccccgacgctaggtagacagacaaccaccagccacaacgacgacgacaaaaggaagacacgacgacgagacagacaagacgcagacagcagggacgagcggcagcagagaggcgcaagcaagcgagaagaagagaagcgggaggaaaaaggaagcaaaaggagacaaagggcggcaaagcgaggcaagacgacagcagagaaagagacaagacaagacgagaaagaagcgaggaccacgcacaggaaaggcagcgcaccgcgacacaagcacgagccgagacggagcgagcgcgagggagagggaggcacagggaccacaagagaagcgaaaaggggaaccgccggaggctgaaacaagcgaggacggcacgaacacagcacgcggcgaagagacgccggcaggagccaggagcgagagtgcgagaggagcagaccagcgacagaagacagcgacgagcaagctgagccagagcagcaacagcaacgaagcagacacaatataggcaggagacggcgagcaacgggagagacgcaacgaccacagccggcgacacgaccagcacgaccataggagccccgacgccacaagacgccagaccgccacagcaagcgaccaagcccacggccccacgcaaagggagaagacacgcgaaagtaaacgaagcaagagaacagcaacgcgacgagaggagccgaacagagaagagcaaaggcaacaagtcacaaacgtgacaaagaacagagacggaacaaaagaagcaaggcacaagaccatagacacagcacacagcagcagagaaggagagaaagagaagaagcgaagaagcaacgacgagaaggaaggacgagcgcacatgtagaagacaggcgaagcggagacgagagagcagacagggagcgcaggacagaaagacagatacaacacgcgagacgagcggcacagagcaaacaaagacgagcaccaacgcaacacacccgcaacgaccaccaccgaccaaacacaagacccaacaccgagcaaacagaacagacacgaccgcacaagagacaacaggacaacgacgacacaagcacacaaaagcaacgaaaagagacacaagcgaagcgccacgaaccaaaggcccagaagccagcaaaccaagg

SEQ ID NO: 536101 - DNA, 453 bp, Homo sapiens
  misc_feature (403)..(403): n is a, c, g, or t
  misc_feature (434)..(434): n is a, c, g, or t
  misc_feature (448)..(448): n is a, c, g, or t
tttcctgggggagactgtgtcagaacagatgatagtgttactgttggtgattatctcaataaagttttcttatatgttatatcattaccagcaattaaaacctcaaaatattgtctcatttctctgttaatatttctctcctctaagaaaatgctacagcaagtttagatcctcttggcctccagcaaaacaagagaattaaaacctgcatgcaacataatggcaatgtgaaatggagttgaacatactgtttgcagtgacacgagagtctacaaaatacctatgttgtaggttgttcttttcattctaccactgatagttacacactgctgtgcgggacatgccagtgtgaagaggctgaggaagagttggaattaaccaaagagctcgtgccgaattcgcngggttcaaaacattttatcctactaaagtantgggaggaaagaantcgtt

SEQ ID NO: 536102 - DNA, 245 bp, Homo sapiens
ccagaacacttacaacatgaagcatttccttatccttcttcatattttctgctcttacttctgatacgagcatagcttctcatttgcgtcctctcaaatcttgagttcatcgtattgattatctgttcttgcattatgagttgtggtagtgagtttctgatttctctcactgtaagatgattttatttgtcggactatatccttcaacattatcttgcagcatttcattaggtcgtcacacggac

SEQ ID NO: 536103 - DNA, 207 bp, Homo sapiens
cgttcctcacgctacgccctcaccgctacgccctcaccgctacgccctcaccgctacgccctcaccggtacgccctcaccggtacgccctcaacggtaggacctcagaggtagtacctcagcggtagtacctctcaggtagtacctctccggtagtaacattatggtgataactaagaggcctcagctctcaggtatggtaacggga

SEQ ID NO: 536104 - DNA, 280 bp, Homo sapiens
  misc_feature (11)..(11): n is a, c, g, or t
gaaagagaggncttcagtgacatgggggttgagcccgctgccaaacaaaagcaaaaaaaacggaaagctcagccccaggccacccgtgggggcagcaaaaaatataaggagttcaagttttaggtccccccccccaagccctttttttggccctacgtttggaagcgtggggttcacccaaaaaccccctctcccgcagttcccaaggacttgtcatttcatgtttttattttagacctgttttgtaaaaaaagctgtttcccaaggaaaaagatgaata

SEQ ID NO: 536105 - DNA, 174 bp, Homo sapiens
ccgggaagggcggctgcgggcagacgggcgctgcgctctggccaggccgcaccatgcggccctgctctgcgcgctgaccggactggccctgctccgcgccgggctctttggccgctgccgaacccttcagccctccgcgagagactcagctcagagcacagcgtcgtgacagac

SEQ ID NO: 536106 - DNA, 258 bp, Homo sapiens
cttaaggagattatgattcagtgcgtgattgtgatgttatggttgaggagactggagtgcatttgaggtagcccggtatgaggaggagagaggattgtggtggagactggatatgcgaccaggctggggctcggaggtgttatgacaactatggaggaggaaattatggaagtgaaaattacaatgattttggaaattatgaccagaagaacttctaactacgagtcaatgaagagtgaacactttggtggtagcagg

SEQ ID NO: 536107 - DNA, 359 bp, Homo sapiens
cctgcagaacctggtgagcaacgccgtgtgagacgccgcgcgccagacggtgctgggcaaggccaacggcctggtgaaccagttcaacaacaccgacaaattccgtgcgcgacatggacagcggcgtcaatcagcagatcagcgatacggcgcagcagatcaacagctacagccaacagattgccaagctgaacgacgagatcacccgtttgcgcggcagcgccggcagggagccgaatgcgttggtggatcagcgcgatcagcgggtaacggagctgaatcagctggtgggcgtacaggtcacgcagcaggacggagacgcctataccgtctccttcgccaacggtttgaccctggta

SEQ ID NO: 536108 - DNA, 242 bp, Homo sapiens
agaccagtggtaatgttcattcgagggcggatcctctccggtgtggtgactatgatgaagatgccgaggaccattgttatccgtcgagattatctgcattacatccgttagtacaatccgcttcgagaagcgccacaagtaacatgtctgtacagcctttccgccttgctgcatgggacgtccacgactcgtgtgacaatcgtctagcagatgtggcgagttgccgcgtgctctgtacgcaa

SEQ ID NO: 536109 - DNA, 181 bp, Homo sapiens
gctattttctccttgaagatagaccgtgcccggtcgtgaccggcatctatgtccatcgtatgttcctcccaggccagtgggtagtagcttgctgccacctatgatgtgagttcatgaagctctatgtgaatggtgcccaggtggccacctctggtgaacaagtgggtggcatattcagccc

SEQ ID NO: 536110 - DNA, 452 bp, Homo sapiens
agatagagtcctttggggtttctctcttatgtggttgggattctagaaggtgtaaggattaaaggagatgggatcttaggcagggagggactggtcctatgcgtgagttggcttgggatgtgtacccaaggagtagatgaaccctggggagtcctctttgctgaggggtgactgtgggaaggcagagcgcagtgctaaccttgcgtgtggatgtcctgggtccctctccctggcccaggaggggaagctgcagcaaaatcccctcacagggcttcgtgggtgaagttggggactaagggtgagggatgcacgctgagccaagtcagagtgtcatctgggctagctgggttctggtgggctcagggaccctgagcctctgggacgggcacgtcagcaggtcacatgctggaaacttgcacaggtgaggcaacaggggctgtaagaagttgtcc

SEQ ID NO: 536111 - DNA, 135 bp, Homo sapiens
ttgttgggtcgcctatgagtgtctggtgagaatagtgttaatgtcattaatggagagaagtgaagagaatgtaatgcctgagtggctgtcttctgcattgttgtagtaagtggtggaatggtgatatttatctgg

SEQ ID NO: 536112 - DNA, 309 bp, Homo sapiens
aggacattctctagccagtatggtgcgcacatgatgctctccatatcctgaggtactcagagctgtggagtaggggtgatgagctccagtatttccagcccagcagccacatccataaagagcagcctgcccaactctccccggatgtgtcaaggccaagcctccagtggagacagcagcagcaacattcccttcgtggtccacaagcacagcgcgtaccgtgtccgaagtgcctgagtcattttccttctcactggattgtcttcttttcttgagttgcataagatctgtgtcctcattacatgccat

SEQ ID NO: 536113 - DNA, 302 bp, Homo sapiens
tctgcatcgctaatctttttgagaatgaacaagacacagcagtttgactaacactcagtaggaaacgtagctgttttacttctgaacctcagctgtgttactctaatattgtttgggattggcatggtgaaccgcacacacctataggctgatattggtggactaaccatgcaatctgaactgaagagtatccatggcagtcctactctttaggaaaaaatgaaagatgttttacactcagaagatgactgagacttgtgctactgctcatattgctggggttaatattgtgctgcttgaac

SEQ ID NO: 536114 - DNA, 335 bp, Homo sapiens
gtaaaattttaaatatttttaacaggtacattattaatattagataatatttataattgtgaaaatattccatgctaaaataagatgcaatgtctaaacatcagtattaaaactagtataaatatttgcttgtttatacaaggaacattcaagctcaacctaaaattatataggaaataaaataaaaatttgcagggagctctttaataacataaacatatatatatacacacacacacacatataacatgtatatatgttatatgggatagatatagatttaacatgttatatctatattttgtatctataactacagctgtatgtatctacat

SEQ ID NO: 536115 - DNA, 800 bp, Homo sapiens
ccccggaggggggacccacccggaggcggcgtgccccctcggcgccacacccctgtcttgggaggggctctccccgcggagcagagtattagccacacagggagagccaacacgcctctggggtagtgagagagaggaggcacgcacacatgatgtgtcgctctcggtgggcccggcccccgctctgttgttggcccgcaccacagagcagagagactctgcgggggagaaagagggaaagggggagagaactcatatattagggtgtgagagctctcttttctaaaactaaagagagcggattctactgcggggactattgcagagggaatccatttagaggctgtgagagtctccgttttctcgctgtggggaggttaggacgcgcctcgccttcctcgggttcttgcccggggatcgggttttgcctcttggagaataccctctcttacgagagaggctccctcccctcttgccctgggcctcgcccgcttctggggccgcccgccccccagctttgttttcctcccctcgatacgaatttcttttcctccccgcgtaggaatttttcctttgcctatagattgagatatcccctctgtcctcctcttttctcatcacccaagaacaatggaatagattgtgaatcctttccttttgtttgctcctgatattatgggttttttgaaagaaaaaccaaaatattttttttagcccttttaaaaaaagaaaattaaaagaccacttttaataaaaagggccctcccccctttgaaaaaaaattccgcaattgctttcca

SEQ ID NO: 536116 - DNA, 203 bp, Homo sapiens
  misc_feature (111)..(111): n is a, c, g, or t
  misc_feature (146)..(146): n is a, c, g, or t
gaattctggaacgagaagaagctgaagaagaagggcaaggagaaggcggaagacagcaggtggtggaccctgagacggggcgcaccaggcttattaagggagatggcgagntcctagaggaaatcgtaaccaaagaacgacacagngagatcaacaagatgccgagctgggttgcttccctgagggcccccgctggtcaaggc

SEQ ID NO: 536117 - DNA, 139 bp, Homo sapiens
tgtgaaaaggaggaatggggaggacaagaaagaaaaaacaagaaggcaggtgaaagaaaaaaaaacataattaactacaagtatcaataatattatcatttattgcacaattaactctcggatcctgcttatcgtacaa

SEQ ID NO: 536118 - DNA, 168 bp, Homo sapiens
  misc_feature (69)..(69): n is a, c, g, or t
  misc_feature (112)..(112): n is a, c, g, or t
tcccgtctaccaggtgttttcattcgattcctgtcttctgaggatgatgatgacttcctttctcgctgnggtcctggtatatttctgaaaagaaaacacagtcccttcgtgngcctgtttttgaggccgggggggttgctgaccttcctgtggttgatcctccatcac

SEQ ID NO: 536119 - DNA, 137 bp, Homo sapiens
ttggcccggggtttttcctaattgctaatgctgccgtcaaaggtggtaattttttttggttaaagccctattgccctttttttagaaggggttgcccccccgtccccttgtttttttcactgggtttttaggggcca

SEQ ID NO: 536120 - DNA, 528 bp, Homo sapiens
atagtgtaatcagtctcactctaagaagtgaagaaaaccatcaggttttgggaaggaatcacatcctagcaattgagccatttgcaacatagcttggtgactttgaaaaatatggtattttattctcagcattaaaaatcagggtattttggccctgaagtagtaggttcacgctatttaaaattctagatatatctctgctatactccacttaagcaggcctctagaaaacatagaattactttttggtattgtcagcattatgaagaattttttttttttttaaaatctcatccctcatttcagaaacttgtcagcaccttttttccttgacagccagcaaacttgcgtgggaagaataatcttgcaaacgctgccatttccttctgcaacatctgagagcgcatactctgaatagtcaatatttgatgatgtttaatttccattatttccttcaacactcagttataatcaggaggcatattgttgactcctgtttcatataaagaatcttttagtaacataaaa

SEQ ID NO: 536121 - DNA, 941 bp, Homo sapiens
  misc_feature (4)..(4): n is a, c, g, or t
  misc_feature (42)..(42): n is a, c, g, or t
  misc_feature (111)..(111): n is a, c, g, or t
  misc_feature (340)..(340): n is a, c, g, or t
  misc_feature (534)..(534): n is a, c, g, or t
  misc_feature (537)..(538): n is a, c, g, or t
gttntgatttcggtaactagtttaactacaggtaaccttcanagggaccattgtacattatgaacaatagatagagatgacatcttgatgactcttgaaatatggaaattntgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttntaagattgtgacaccaggcttaccttttaaagtttagtatatagagacaattgtaatggaaataactactgtagactattgaagaatgatctctttgtgatttaagaagtggctggattggaactttgaatatgctaatgtggaaaatgaattacctctatgaaggtggtttattacaaataagcacactaacnccnntcgaagtgtttacctactttaaaagtttaatgatatgacctctgtaacctatgctaaaatgtgatgatatatttgaaaggcttccaattatatataacttgcttgaagcttccatctatgtggttaccctgagggttataaatgtgtcaaagccctataaatgattgtttgaagttatgagataattggctttaattaagaagccattaacgaatgtcattctatcattataaaagacctgttcaagatttaccaaaccatcctttattgaccaaattgggtgtttacttaactttcctcataatctaggtcagatgctgaaaggcttaaatgagtactgcagaacattttaagataactagaaattggccattaacacttgaacctttaagtactcctctat

SEQ ID NO: 536122 - DNA, 328 bp, Homo sapiens
tgtttcaggcaccggagacattattcttattgatgttcatattgtgtcatcttagttcagtgggaacccatttaatttggctcctttgtccttttgatgtgaccccagtagtctttgatagcttttctgttttatagcacaagaaaaccgaggctcatctatttgtttcctttcaatagcaggccaccatgtcctgctatttttatgtttatttttatagagacaggttctccctatgttgcccaggctggtggtgttgaactcctggactcaagtgatcttcctgcctcaagtgattttactgcctcagattacatgcgtgagcaac

SEQ ID NO: 536123 - DNA, 364 bp, Homo sapiens
  misc_feature (5)..(5): n is a, c, g, or t
  misc_feature (42)..(42): n is a, c, g, or t
  misc_feature (44)..(44): n is a, c, g, or t
  misc_feature (103)..(103): n is a, c, g, or t
  misc_feature (135)..(135): n is a, c, g, or t
  misc_feature (202)..(202): n is a, c, g, or t
ggccnaaaatgtacaaaaccacaccagatgtcatctttgtantnggattcagaacccacttcggtggtggcaagaccactggctttggcatgatctatgattntttagattatgcaaagaagaatgagcctaaanacagactggcaagacatggcctttatgagaagaaaaagacctcccgaaaacagcgaaaggaacgcangaacagaatgaagaaggtcaggggcacgcgaaggccaatgttggtgctggcaaaaagaagtgagtggagattggatacagccaaaggagtagatctgcggtgacttgatgttttgctgtgatgtgcagatttctgagaggacaaataaactaaaaagctcca

SEQ ID NO: 536124 - DNA, 576 bp, Homo sapiens
tataatttccccagcaatatttagcacaatgagcgtgtatgtgcttgggggttaaaaattatctgctagggatgataggccggggtttctcgtgtgacatctagatgggcctgattagagcagtcatctccgggtaggcacaaaataatcaccaacagtaatgtcggtatctggtaatggtttggtttggctttttaaagttttattctttgatttctggtaaacatccattggcactgaggccgtatcattcctatagagacacagagccctatacaatctgtgtgacccctgtgttgggggggttaaaaactcctccgccgttgttaaggacaattaaaagtgggtggggcaaaacactctcacaacacccggtgtttgagagcctctccagagtgcatatctgtaagagaccctattttgcccaatacccgtgttgaggtgtattattcgtcctttcccttggaaagcacgctggacactggaaaatgtaatatcatataaattatgcgctgggcacccaagtgggggggaaacggggtattgttcggcggacggtttaattttgtgtgaggg

SEQ ID NO: 536125 - DNA, 650 bp, Homo sapiens
ggagactgttcgtgagctgatgtgcgtcccgggttgcttgccggtgcatgaaggctgtcgccgggagagcccggggtcagagcagaggtgctcatcagcactgtaggcccggaagattgtgtggtcccgtatcctgacccggactaatggtccctgtcttgcagactgagatagcggcaactacactcttctccactagtgcaatctgccgatatttcggttgtagtgaatctggctgggagcaagatgacctcgactaaccagtgtgctggtaatgggaagcagacagagctgcgagccagctttgtctgctgccctgtactatatagtggtccaaggcaagaagggggaagcatgtccttggtctcacgtgcggatgagcccgtgacctcagcatttgagccactagcgttgtaagtctgtcagaatctgtccgtttcctggctggggacgacagaattctctacgccgacatcgtatcgtggggagccctataaccattactgcaagatcccgcctacctccctgaggacgctgatgtgccctggcacaggctcgttccagacactgagtagcccaggaaacatgtcagcgagctgcagagacgtgtactgaaagagaaggtgtcctgggtctccggccttaccctt

SEQ ID NO: 536126 - DNA, 269 bp, Homo sapiens
gacatcctaattaccggaatacgtcacgtgtggttcctgtgagtgaggcgacatgggtttattacttttatttggagtggcaccaatttttgggttcctaagagcaccggatcgctgttatcctttaacaagttgcaaaaggccaccattttcaagtgtggcaagcatgcagttagcagttctgtgcaaactttttcggtcgcatcgcaatcattcaattttctattcactacattcacaatctagggttttcattaacactcagggtc

SEQ ID NO: 536127 - DNA, 436 bp, Homo sapiens
  misc_feature (166)..(166): n is a, c, g, or t
  misc_feature (183)..(183): n is a, c, g, or t
  misc_feature (187)..(187): n is a, c, g, or t
  misc_feature (194)..(194): n is a, c, g, or t
  misc_feature (204)..(204): n is a, c, g, or t
  misc_feature (215)..(215): n is a, c, g, or t
ctggttcggagaatggctaaagcccgagcctcatctgtaaatgcagctcccccttcatttctttaatgaaatattagttggaagacttcccaaagactgctgataactatctgtgattgataggaaattttttttcttgatttctctgtgagaaatgtaatgctgncttttataaagcctggncttntcctttntttaataaancaatgtttgcnatggtaaatgaaacctttccctggacagttttttgaaagtctttaaatcccaaagttttggaaattcaggaaagttaccaattatgtccggatattatccaaaggaaagtagttatatttttaaatgctattattgcagaggatcctcaaaaaaaaggtaatttacgttatttcctattttaatgtcttttcctaataaaaaacttcacctttttaagtta

SEQ ID NO: 536128 - DNA, 320 bp, Homo sapiens
  misc_feature (34)..(34): n is a, c, g, or t
  misc_feature (93)..(93): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (241)..(241): n is a, c, g, or t
  misc_feature (303)..(303): n is a, c, g, or t
acctctcctctcccagccagtcgtgggcgcgttntcaaagtgtgcagttgtctcctccctgtccagccccatcgtcgcccaggaccagctggncgcggtctgacctgaggctgctgctcagcgccgggctgncgntntctccattcgagcaccttccagcataccgctcggctccgggagccttctgcaaagttgggcagctcagagcgcaattttgcctctcgacttctccctccttggntccccggcgcccccgcttcccacgatccctttcactagggagcagccagttccagcgggtgnaaaactttgcacccctt

SEQ ID NO: 536129 - DNA, 112 bp, Homo sapiens
tcaccaagaagacatagctatcctaaatctttatgcaataacaatagagcttcagaacacatgaagcaaaactgacagaaataaaataggaatagttcccacatataaacag

SEQ ID NO: 536130 - DNA, 209 bp, Homo sapiens
atcttgtactgtggtgtacccgtgatgttgaaatgaatcaaaccaaggtgtttggtttggggagagggagtcggttctattgagtcatcacaactagccaagcagtagaggtctaccctacctcaaactgaatcagagctagaactggaatatgtgcatacatacatttatgcatgtaaaacctaatagtttcagaaagccaaaagagg

SEQ ID NO: 536131 - DNA, 539 bp, Homo sapiens
catggtggtgggtgcctgtaatcctggctactcaggaggctaaggaaggagaatcacttgtaccttgggaggcggaggttgcaggagccaagaatcgcacccactggcaactcctagccctgggcgggcagagtcagagactctgtcaaaacaaagaaaaagaaaaaaaaaaaaaaaaacatgggtgtgtggtggggcgcgcgcgggcgccccagaaaaagaaattttaaaaaaaacacttgtgtggtgtgtgggcgggcggcccccaattaagtaagacaaaaaggtggggccaaaaaaggggcccaaaaagagagaacaccggggaccaagaacagaagggcgaggggaggttgcaccaacacaaataaaaaaaaacgcccgcgcgggaaaacaaggagggtttctggagaaacaaacaacaacgaagggagcataaaggaagcaaaaacagaggaggacctacaaaaacaagagaggcacaaaggagaaacgagaagacaacaataaagccccctcgtggcgatgaaaaaaaagaa

SEQ ID NO: 536132 - DNA, 479 bp, Homo sapiens
aaggatcccctgggctgggaagagggctgtcgtggggaagacgggaaccagaggctggttactggcaagcaatcatctggaggacgagtatgaccgagctgcatagcaaaagatcgggtcgtgtaccattgactcccgagttatttaataattgatagcagcacattgcaatgttcctgggctcgcaccaatggcaaagcccatttcaacaacagctgatgcaaatacggagaatcgccctccactggaattcgcagcgctccagtcagcgcgagtggtgtagcgaggcgagtgagttcccgccagtatccccatggccgctgctagtgggcgccctcaaaaccgggttgcctggacatccacggctagggatcacgatccttccttggggacagtcggtaagcaaggtcatgccagtctcactggaggtggggggcgccggccaggtcatcaaaacaagccctccccctcttccccag

SEQ ID NO: 536133 - DNA, 530 bp, Homo sapiens
ttctgttactggcgagaagttgctaggtttaatggggcaacaagtactctttgtggcggtgccactacttcattaccccgactgcagatgcttctgtcacacagtattgaaacctgcttcatcaggtgctattagactgaccaaatgttacatgacttgtggaagtcggtgtacgggatatttgaatacaccaagggcactgtcactatgattaacaattcaaacatcttcatcaagtacaagaccacgactagggaacgctaattgatagcaactatatgcatgacctgcgaattcaaagtgccggggctctgacgtctatctatacatacactaaggggaagcagcgtactttagttccatataaagtcgcccgtcctttgcttaaaaccttaagattcattatctcgcagattatttcaaagattacagcctaccttccttggattgagggaaagtcgttcttatgcgaccagtggcgtaacgtctgtctatccatggaaaactccgaactagggaatgcgaccgct

SEQ ID NO: 536134 - DNA, 179 bp, Homo sapiens
ggggaatagctcgccagcaggttttgatgccagtgtgagctcaagcagtagtaatcagccaaggccagaacatcctgacacgcctgtacaggtcagacagagttacagatgctcagggaggaggaagttcatcacaacagcagaacagcagccataaagcaacaatggtaacaccaaaa

SEQ ID NO: 536135 - DNA, 745 bp, Homo sapiens
cttctcctgggacctcgcgggtaccccccgggttccccagttagaaggacttttatggactctatggtgcggccgaaggtcccgttgagttcccccggggtgcaatacgggccccttagctcttgaggggacccttggcacagagggcgtctttggccacattggggggtcaaatctcgtgggccagagacgtggcgcacaacacagaaaagtttcggcgcagccgcgtcccaggggcgcccgtgtctatcaccaaggcgcgcaactcccccatacatggcgcccaaaacactctcagtgccccctctaagagcctctgcgatagaaatcttgtgagacattttcttatgaagccctgtctgcaaaattggggctgcctgagggagatcatctgtcgcacagccgccaaccacagtcctggaaagaggatgggggccccctggaagggcgcctccccataaagtctgctgctgttctgtcacaaccccctgctggaccaggccttaggggtgtaaagtgggggcacagggccacaccccgcccgggacccgcgggagcatgaagacgcccctgggctccagcgctctcagagaagcaagtcggtgagggtggccatgggaccatgggcaaccactggccatgccggacctggctgcctttggggtcgaggttttgggtggaaggaccccgggtttcgccaggttttgtgtcagcccccaataacacgaaccccgaagccccttta

SEQ ID NO: 536136 - DNA, 179 bp, Homo sapiens
tcacaccacctcctactagggtgggtattcatctgtctctactactatgattaatgactgtcattctttaagagtagcatatagttcagctctgtgtaagtactgcatattttactgaataaatggatatccgagtattaggagttgggtttcgtagctggtgtgcgtgtgtgtgtgtg

SEQ ID NO: 536137 - DNA, 437 bp, Homo sapiens
ctccacactctctgaccagtgagagacgagacacggagcatcccttgttattcagtatacagagatttttaacttgactttaatattggtagcatgtcagtcctttggagtccattctcctacctttcctaggagtatataacttctgatattttcttagctgtgtgatataaccagttacctgaccacttttaccctgttctttctccatcccccaaatcctgctaagtttcgatggctgttgcttgggtacccctgaaatcattgattaaattgttggcgagaatgtacccaactaatactttatactgtagtctgtaaatgcacttaagctagaaatagacttttaaaaaaaatcaaagatttctgttttaaatgggaatacctgctatcctaagtctgttgactttctgtgagaaataaaagtccttgaacac

SEQ ID NO: 536138 - DNA, 761 bp, Homo sapiens
tcctgtcaacagcggcagcctcccaactacgaggatgctcaaggaggagcaggaagtggctatgctgtgggcagccccataaccctgctcccccgatgtccaccgtgatccacatccggagcgagacctctcgttgtctgaccatgtcgtctggtccctgttcaagaccctcttcatgaacacctgctgcctgggcttcatacgccattcgcctactccgtgaagttctagcggacagggaagagtggttggtgacagtgaccggggtcaggactatgcctccataggcaagtgcctgaatcaatctgggcccatgatagtgggacatcttcatgaccaattctgcatcatcatcatcccagtgttggtcggacaggcccagcgaatagatcagagaggcatcagttgatggccagagcgctctgcacagtgaccatgtatacccaggtactctatcgttccatatcctcgaacctgaccccagagggcagtgagctactgcccttgaacaggcatgccacttagctccaacgttccattcctcgccctgtcccccatagccgagtcttgcattagacctgatcctcgaatcgcttgtaatacgactggattttcaaataaaggtatattgtgtccggtgcttgctgtgcaaacacaagacatcaacacgagaaattggagcaggccagacacaaaagactctgaacaaccaagcctggagggaccacaaaactcgggataggccaaaggagaccaagcaa

SEQ ID NO: 536139 - DNA, 197 bp, Homo sapiens
tctacaggatcccatgaaggttctgcagggtaatggtgatccggttctcctcgccctctagctagcttcctgtaggtggcgagtctctgagtgtccatgggccagcttgacattgagcatggtcctgtgtactccgtgcaagttggacgggccatctcgttccttgagtgctctgcccgctcttcctccagtccgcg

SEQ ID NO: 536140 - DNA, 1334 bp, Homo sapiens
gacgcgatgaccctgaacggcggcggcagcggagctgggcggtgagcctgctgtgtgggtgtgccatgtgagcgcgagctgccgtctgtgtggcatgcacaccctgtgtgggcccctgcccctgcctgcgtgcacctgcctgcatgcatgcctggtgtgactgatgctgctgaccatgcatgtgctgtgctgcttgagcccctgtgtgttgcgccttgactggctggcctgctgtgtctgtgttgactgtgtgtgacccatggtggtcccatgtggcttggactcggtgccctgatgtgacctcctgatgggactctgcatcagtctcatgtggtgtgcatgctgagctcatgactgaagatgctgttttacaacgtgtgcttggctgcttggtgtgtgctgccctgtgctgttggtgccaaggatgctgccactggactgctgcaatctttctggccgtgtgttgtgagtgactggtgccttgaatgcacgacggcatgcatgtggcaacacgctattgatctggctccatttggtaggtgggactgggatgaaagaggcaatcactccatggtctaccgacgatttgggaggcagtgacgtggggcccgcttggttgcccgtgcacttgccatggccattgggggattgcctatgtcattgtgtacctcagtgacggacaagggcagcttcggagaaagggctcagaaactgcggtgtccagctgcgggcgttgcactggcgaaaccagattgatgtgcccattcatcctcgtggggcaacaagaggcgacttgttgcgctctcgtgaagtctcggtgcatgagggccggggcctgcggcgggtgggtcatttggagtggcaggttccatttgatgaccatcatgcggctatttccactacaatgttcaggtgcctgttatgaaggctttcgtgcggccagaatacggctgcgccgtgcactgaaggtagcaacgccggatgtagcaaggcccgggggcaagagcactttcaaacagcaaggagtttttgggccgagttcaccttagacaggccgagtagggtcctcttcggcggaaaccagagtctcgtgcaaagcactctgagccattgggccaccgcgcctaattttggtgcagctggcgagggtgtgggttcggccgccacaacgcaggagtttaaagacgtaacagatagatcagcgagaggtgccacactagtgatggacatgcagatcgaagtcacaggaggacgacgtatgcagatctatgcagacggaggaagggtcagctgtggtgcgtcatacagctgtctcagtcaacaagcagtgaatg

SEQ ID NO: 536141 - DNA, 416 bp, Homo sapiens
ttgagatatcctaggagtctgcatctaggattcatccatgcctctgtgtggcttgatggctcacttctcttttaatcactgaatattattccatcgtacggatgtaccatatctgttcacccactgaaagacatttggttttcggcgattaggaataaagctgctataaacatttgtgtgcatgtttttgtggggacatacatttttaaatcagttgggtaaatatctaggagtatgactgctggattgtatataagactatgtttagctttgtaagaaactgccaaactttcttccagagtgtctgtagcattttgcattcccagctgcaatgaacaagagctccttctgctttgcatcctttccaggactgggtgttatcagtgttttggattttaaccattctaatagttata

SEQ ID NO: 536142 - DNA, 130 bp, Homo sapiens
gtagccacttcacgttgtcaaaatgtgaggtgatggcagaagagcatctgtcttcgcctactgaaggaaagctcccctaccttatgatgacccatctccctcatgaccgatcccaagctcatcatttgga

SEQ ID NO: 536143 - DNA, 623 bp, Homo sapiens
gatcgagcaaccctctaaaagcagtttagagtggtaaaaaaaaaaaaaacacaccaaaggctcgcagccacaaaaggggatgaaatttcttctgggacatcctcctgggttctcccgttactggatcgtctggctccctagagtccttcgtggaagctttttattcctaagaggagaaaatcagtcaccgggcgaaatcgtggctggattacagggacgctggggcattgggaattggggagactggactggcctatgaatttggctaaacttaaaagcaagctgggttctctggggatataaataagcatgggactgggaggaaacagctggccaaatggcaaggggattggggtgccaagggttcataccttgggggtagactggcagaaccggaggaagatatttacacgctctgcaaagaaggtgaaggcagaaatgtggagatggtcagtatttgagtaaataaggctggggtagtctatacatcagatgtgttggctacacaagatcctcagatgtgaaagactttcgaagttaatgtactggccattttgtggagtacaaaggcattcttctgcaatgacgaagataccatggccattgtgtcctggtggttcggc

SEQ ID NO: 536144 - DNA, 258 bp, Homo sapiens
caccactaccccgtgcctcataggttttttgtttttttgacagtcttgctgtgttacctaggctggagtgcagtggggccatctcagctcactacaacctctgcctcccgggttcaagtgattctcctgcctcagcctcctgagtaactgggattacaggcatgcaccaccatgcccagcgaattgttgtatttttggtagaacagggttttgccattttgctcatgctggtctcgaagtgcggcctcaaacaatccg

SEQ ID NO: 536145 - DNA, 184 bp, Homo sapiens
tatggaaaggaccactcttacataactagaatagcattaagaatcagatttacagataatgatgtcattattatatatatatatatatattgtcactccgttcaagtttcgttcaagtcgacaaccaataaaaaatttaaaaaaaaccaggcaattaatagaaaaaatatgatatgaatgaatg

SEQ ID NO: 536146 - DNA, 682 bp, Homo sapiens
aatataatatcatttggcatgaaacctactcagactaacgaggcacagcttatgcactatcgagtattctatgatttaattatcacagccccacaagttagatattgtcagtcccgttgtacagataatgaaataggtttagagaggttactttgcctgaaatcacacagtgacccaaccccagttacatgtgcctctaaaacttttttctactcttctaagtggattcctctcagtttgtccatcagcaaaatagaagtaatcgttatacaaaacatataattgaatgaaagcatctcctccttcttaaggctcctctaaatgtcaaggactataacatattagggtacttatgtattgtggcatttgagaactaaattctgttttcacagaagcatagattattcaagatagaaaaacgggaactctgtagagcttttccttgcaatgtagaaagacatttaatcttagatttaggaggccaagaaagactaatttggactgggcatgatggctcacacctgtaatcccagcactttgggaggccaaggcgggcgggtcacctgagatcaggagttcgagaaccgcctggcctacatggcagaacccgtctctactaaacatcaaaattggctggcatgtggccatgctgtagtccactatctgaagctgagggagaatc

SEQ ID NO: 536147 - DNA, 119 bp, Homo sapiens
gtcatcgagagtgccacgaaagagcgttctaagctgcaaagttatacaaatagcagtggtggccaggtgctgtggctcatgcctgtaatcccagcactttgggaggtcaaggcaggagg

SEQ ID NO: 536148 - DNA, 395 bp, Homo sapiens
tgatctagaggatcccgtcatacctggtacgtggctgcagtactgtgagagactacaaggacagcagcgactttggggcgtcacctcaggacatggatgaagctggaaaccatcattctcagcaaactaacacagaagcagaaaaccaaacaccacatgttctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgcatgcacccagg

SEQ ID NO: 536149 - DNA, 149 bp, Homo sapiens
gacgcacgagagacaacggtatagagtgtggaagaaggagcggagagttctgctgacagggtcaaagtcagactaggactgataagttaagcgatgggtttaatgacatggaaatcattgatgtgacattagagccactatgctggagc

SEQ ID NO: 536150 - DNA, 1437 bp, Homo sapiens
gatccgccacgacgtccgtttttgtcaaagttatattatatgcgctaaatcctatagtatcttatatggcacagtgcagcgcagcgctaggatctacaagcacgctaggttcccgctatcataaacagagcttatcaccatttcatgatcacgcccttcataaatcatgtttcctgtatctggcttacctaaggtccttgtaattgccctatttatcctaaacaattacaccgaagagacaattgaactaaatgactaaacattcttccagaactgctccaggagacataagcaaacccggtctggacactaattcgctgcaccgccaatacaatcctaaggtccatcaattcgacccttccccattcccttatagcaattccgttttaacattaagtcagaacgaagggtcacagaagtccccctccgcctttaaccattccaaaatcaacattgggacccacccaaattgaggtacactggaaacacatcacggaagatacactgcggaacgtaacagacaggaggacattatatttcttaaaaacttaccctaacatttacatttccacgcccagttaagttccctaaggaaacccaagtgctggaagcttgccgtgcaacctcctcttagggtaccggcttgtgcaccaaaatttctgcacagcataagtataaccatacacacgagaagctgggcacagtgacccctgccaatattcggtcaacttacacgtaacagttgcaacgattacaaccacagggaacggcactcgatggcacacgcttcaagtggaaagccgctgggtcccccacgaacaacgttcaagggccctccaaacacccacagcacaggacactgccaaaacgttgcccccggggaaccggcacctataaaaacccagaaagatacaccaaccttgtattccacccgcgacttacaacacacctgaaagacggggacggattaaaataactaaaccgggagcaccaacggtgcgtcgcggacaaagacaccatcaaaacaatccacaaacaaaagacggacagcaggcccacacaactcttcaccaagcaggtacaaaccccccctaactgaacacgaggccagcccccaaaggacctgaacaaccgacgcagaagcacaccaaaacacgtcaagcgtgctagacccacacacaaggaggtgtgctccccacaaaaaaaggacgacgccccgcaaaaataacaaacgaacgaaaaagaccacagatggacgacacgtagcatgatgggtaacaccaccacctgactacgaatcacatggcgaaaaccaccagtgtcatctaccacgaaggaccacattgtacgtgaagcaggggcagacctcaagaagcggacagcaggagacggtacaagcacaacgtctgggagcacgcaaacaatcccgccactcag

SEQ ID NO: 536151 - DNA, 586 bp, Homo sapiens
ttcccatgaccctctgtaggatgtcttggatgctgctttcctgcctgatgttcctttcttgggtggaaggtgaagaatctcaaaagaaactgccttcttcacgtataacctgtcctcaaggctctgtagcctatgggtcctattgctattcactgattttgataccacagacctggtctaatgcagaactatcctgccagatgcatttctcaggacacctggcatttcttctcagtactggtgaaattaccttcgtgtcctcccttgtgaagaacagtttgacggcctaccagtacatctggattggactccatgatccctcacatggtacactacccaacggaagtggatggaagtggagcagttccaatgtgctgaccttctataactgggagaggaacccctctattgctgctgaccgtggttattgtgcagttttgtctcagaaatcaggttttcagaagtggagagattttaattgtgaaaatgagcttccctatatctgcaaattcaaggtctagggcagttctaatttcaacagcttgaaaatattatgaagctcacatggacaaggaagcaagtatga

SEQ ID NO: 536152 - DNA, 297 bp, Homo sapiens
  misc_feature (8)..(8): n is a, c, g, or t
  misc_feature (21)..(21): n is a, c, g, or t
  misc_feature (51)..(51): n is a, c, g, or t
  misc_feature (72)..(72): n is a, c, g, or t
ttttgggncccccaaaatttncctttttaaggggccccttaaaaaaaaggnaaaaatttgggctttttaganctttctggggtccagccactgattaaaatgtgaatagtaagtgcatcctactggttcccccccatataatttagtaatcaatcttcagtggattcactgattcagaatcgataaatttaattcattttgatctggcttattttttgctcacgcatgatgtagataatgtgtccttctaaagtttgtctctacttttagaaataaatttcagaaaaattgtttcaa

SEQ ID NO: 536153 - DNA, 838 bp, Homo sapiens
cactgacaaaggcaggctggcacatctggaaacttatctaaacacacgcctggccagcggactcttctcacagcacagctgcaactctcacttccaaagaactggctcctcacaccaacttggcccactaagccccgggcacctccacacgcggctacaaccacacttgcgacacttctccagcgaactggcttagcatcttcagcacaccaacccgctaaagcccaccgcaaactcacgctggacacgcactatctacgccggccgaaaccgcccaatcggctttgggaaagcattcggagacaacacagctccgaccacaccgtcgccgcaatccggccaacagtgcgacagcccacactgtgcacacaccaccaaccacggccggggcctttagcacactacccaacacggatccatccaacaaacactatcccccccccctttggcgcgctctggctaaagcgtctttcccgcaacccaagcctctccacactccgcgccttagtcggggcatggttctggcagcaacaaccagcttcttacacacacacatgagtgcctatacatacgcaacaatcgacgcgagcacccacccactgaacaccccacccagacgagggcgcccccacccacacccagccttcttcaacaaccaagtagcgccagccggcgctcaccacccccacaccaccccaccgcacacccccatagcacaaccgccactacgtgggacgcatagtccatgtcaggaaccaacatcacgtgctagcactacacccacacacgccccacctcacacccagcgagcctcacacactcggcgcgcacccttatg

SEQ ID NO: 536154 - DNA, 1111 bp, Homo sapiens
cgcagacattatgctgtaggcggatttgatggcatgcctgggctgttactcttgggctgtgcgtggcggcggtgtgtggttgcttcgtgtttcgtttgcgatattcgctgttggcgatgtcgttctctacgtccgccgtgtgggcgcttttcatgatactcctctgtcctgcacgagtgtccggggccatcgcgtttgctcgtttcctccccggtgctaggtgcgggatgaactttttttcttttggaccgcaaccctgcccggtcgccgttgggccaccttgtgccgccaagttgtgtcacccctgggtccagtgacacatcccttgattgtaatccccggagtgacgtccctgtccggacttggccacaggattctacattgcgcggccattgacgctcctggttctgctggcccggttacacaccctgaccagcgtcattcctgtggcgtctgccattgacacagccggctacagggagtccgcggcgttcggccaggcagcctctgaccatatcggccccgaagatgccaagagaccagccctaggtaccagatagacccaggcggacttgaggaggaaggggaccagttgccgtgctcaccctgggaccggcccccgccacggggtccggcccctacccgcccctgggatttaagccccatagcactgcgtcagctaacttcacgcctgtgcttgctgggcccgcacccccctgtcccctgtccctgtggcactcctgcacccatcctcacccctccgttgagcccctcgtgccatgccatgagatggagccctcctgtcactctgctggaccgagatttattttctgagtccaatataaagttaatgaataatttttgtccaagagagtatttaagctgtgctgttggtgtgagaaatgtcacttcttgatcttccgccttcgtttgccagaagagttcccgttgacgtggtgtttggttccctggcggggtaccctagggattcatctgttttcttcacttccccttgcatctgacgatcctgctgggaaccccccgccacctgtatcccctattaggaggttaaaatccataaaatggccccttcatttgtgttgtagctcca

SEQ ID NO: 536155 - DNA, 224 bp, Homo sapiens
gaggatccatggagaccaggctgaggcaccctggggccagcagtacagaagcaataagctaactcttaggcaaacctaaagtctcgtatgctgtggtgattttaataaataccaaaggacaccattagctaatgaatgctagactaactagataccaaagcttgctctgtgaaaatccccgcataaccattgaagtttgcaacaccctaaactcagccttccat

SEQ ID NO: 536156 - DNA, 383 bp, Homo sapiens
cagccaccagcagctaggaagaggcaggaaaggatcagccttcagagccttcagagaaaacatggcattgtttgtgtgttgattccagatgtccagcctccagtgagagaatacatttctgtcaccttaagccacaagtttgtggggctttatccaagcagcctcagtaagttaagcatcatgtcatccctcagaaagtttaatttaaagcagggtggtattcatgtaaaaaaatcagggtcttataggaaaaaggaagacgctgaaatcaatttatctgcaaagcttttttataagaaaagagtggatatatgaaaacaaaccagaagcaatgtccattttaaaacctgtatggctagttctgtttagcaattgaccaaaaa

SEQ ID NO: 536157 - DNA, 368 bp, Homo sapiens
ccatgggcatcactggcctccccctttttttttggagagggggtctggctatgttgcccaggcgggtcttaaacgccggggctcaagcaaccctcccgcgctcccggctgagattacaggtgtaagccaccataccgcaacctcaatgacacctttctgatggtctttacacagtcggtgatgtcggggggccccccggcccgggcctcaataatggcatagcattttcctagcagtacagtatgagcagctccagccattccattaaaagtcttagttctggttggagctgaaaccagtggagcctatgggaagcaggtatgtctttcttcttcatccaagcaccctcaggacggtttagttacatc

SEQ ID NO: 536158 - DNA, 381 bp, Homo sapiens
atacccagcattttataagtaaagagagagcaggagccttgatgatgcctctggtggatcagctggaaaacaggcttgggggagaagagaaattccaggaacgggtgacaaagcacctgataccatgcattgcacagttttcagtggccatggcggatgactctctttggaaaccactggacttccagattctggttaagaccagagacattcttgcctaagggtcgaattgctgcgttgagtactgtgttagcactgggtgaaaaactctaggggaattttattgtgttgcgaccagaatccattcctttcttatcacagattgtgggggaaatataagtgagaaaatttacaatcttggcccaaaaatatttttcactc

SEQ ID NO: 536159 - DNA, 512 bp, Homo sapiens
cttaaagcacgttgctatactatgtagatgattccatttcattctacaacaacctgttacgtaagtactattattatttcgaatttgcagatgaagatacagaagcacaaaagttaagtcatttgtccaaggtctagtaatttgccgaaggtcttgcagcttgcaaatggcagggtcaggattcaagcccaggcaatccggtgccagagtccacactttatctgccccatgagttttcctctctagaaggaaaaaggcagtggggctagaatggcagtgtgagaagcctggcaaatcctctcaaaaacaatgataaaactgtcaaaaacaaccatttcaagactctggacaaaacatacaacaaactgaggagcactaattcatttaaaaacttctggatagatcagtgggaatctggtacttgcccccgcctcctactcccatgtaggtgggcagaacagtggcaggcaaagcaatatggatggcaaataaacaaggaaatccccctcagc

SEQ ID NO: 536160 - DNA, 109 bp, Homo sapiens
ccaatatatcgaaaaatgctatacccctccctcacagcaccgttggatatatcgcagagaataatgaagagatcgctagtctagcataggggaatcttcaaagtgacag

SEQ ID NO: 536161 - DNA, 328 bp, Homo sapiens
atagctttgtagggtccctgaaaagcatattggattaatctgttctcacaccgctaataagacatacctcagactgggtaatttataaaggaagaggtttaatggactcacagttccacatggctggggaggctcaaaatcatggcggaaggcggaggaggagcaaaggcacatcttacatggtggcaggcaagagagtgtgtcaggggagccaccctttataaaccatcagatctcagagacttattcactatcatgagaaagcatggaaacccacctcatgatcactacctccactggtcctccatgacatgtggattatacatca

SEQ ID NO: 536162 - DNA, 466 bp, Homo sapiens
aaagtgcgtttttatcgtcaaggtgcggtaatggaagaaaaagtgaaggatgcgttggttatctataccaaagggggcaatgataccttagcggatgggggaatacccggatgatcaggaacaaaaagagttgtttgatgaaggaattttagcacctaaggcagctgataaaattatcgacttgaacccccaaatcaagcgcttgcagcagttagcaggagatgatttttcacagatgccgcgttctgaaaaagaacaagtcgagtttgccgtgacagcgacaaagttaactttacatgtccaccaattagtgcacaaggtatgtcttggggactctgttgtggaccagaggactctcaactaggcattgagagtccacgagctcagttcactgcaagcacgtttaacgatttgaattaaggttttccccccccaaaggaagttgatttacgatttcagctgtgtg

SEQ ID NO: 536163 - DNA, 267 bp, Homo sapiens
  misc_feature (126)..(126): n is a, c, g, or t
atgatgtgatagttactagacactgtatagggttttatggttcggggaaaacatttttaaaaaatggacttatctctattatacagagttataatataaaaatgatttaaaggctatatttttcanggatgtagcgtagctacactagtaatcctgtttgaagaacactttcctcatttaagacttatagagatgaaaactatatacattaaacgtcttcgtgaatcatagacttgagtaccactcaaggcgaatgtttacgtttcc

SEQ ID NO: 536164 - DNA, 81 bp, Homo sapiens
  misc_feature (62)..(62): n is a, c, g, or t
  misc_feature (71)..(71): n is a, c, g, or t
gctccatccaaacctccagcgaagacatccagccatggccatgcagaaaatctttgcccggngaaatcttnggactccagt

SEQ ID NO: 536165 - DNA, 170 bp, Homo sapiens
attttttgtctcagaagtgacaggtatctccatgttggctaggctggtctcgaagttcctgacctcaggtgatccacttgcctcatgtgctgggattacaggtgtgagccactgcgcccggccttctttttatttctgtataatatttcgttgtataaatctaccgtgtg

SEQ ID NO: 536166 - DNA, 450 bp, Homo sapiens
  misc_feature (40)..(40): n is a, c, g, or t
  misc_feature (66)..(66): n is a, c, g, or t
  misc_feature (83)..(84): n is a, c, g, or t
  misc_feature (228)..(228): n is a, c, g, or t
  misc_feature (256)..(256): n is a, c, g, or t
  misc_feature (298)..(298): n is a, c, g, or t
gatttctctatatatgataggtgttataaaggaaaatatnggtgcttgcatgaatatttcctagancacaaagatctatctcnngggaggtatctttttaaagaatactgttaacccttgtgtgtgaattttccataaaagaatgtcatttactcaaaatataagaacataaatctcaacagctattgactcctgccaatttttatcgttttaatcccttgtaaatcngacagaacaatacaatataggttagttngtaccacatcaaccagaactgggatagtcagtggagtagatnatgatcatctgaaactttctgttgaaatactgggagaggtgaacatgcaacattattataatctgcactcagatttttccatcctagaaacaaaacttattatcagaaaactctttgagtcacaatgtaatatagattcttttaatttgaga

SEQ ID NO: 536167 - DNA, 311 bp, Homo sapiens
cccgcttgggcttcgagttgcatggtcgctggtactatgaatgatgggggcagtatgtaggagtagactattactccgccaatattcggtgtactcgttgttgcagatagcataggtggacgaatagatttgatgtgtaagggagggatcgtagacctcgttctgttatgtaaaggatgcgtatggatggaagggcgatgaggactaggatgatggcggtcaggatagttcagacggtttctataacctggagcgtctgagatgttagtaatagttagttttgtagtgaggcaactcgaaagccccaagcg

SEQ ID NO: 536168 - DNA, 207 bp, Homo sapiens
tctcgcgcgctgctccgactgccggcggcggcgttggctcgggggggggccgcccagtcacgagccgcccccggctcgcctcgtaccccgtcgtgcatcgtctcggaaccacgacggttctcgggcctcccccggcgccaaccgcacgatgttcaactttgacgccttctaccaggcccactatgggggggggtcctggctcggggg

SEQ ID NO: 536169 - DNA, 876 bp, Homo sapiens
agcctgcctgtctacttcaatggatgcatgtttctaggacggagacgggtggacttcccgctgtgatccgaatccaaacacaagtcagattacaggcaaattctgttctacagtatcctggcaagttctacgtgtgacgaggagaaagcataaacggttttgcagacaagccagcgatgcacgctttatatgctctgtcggccagtttctgagccttatcagcaacaaatggccagacgctggtggtgcagtatcacggtgaaacatgagcagaacatcgactgtgggaggcggctatgtgaagctgtatcctaatagttaaggaccagacagacatgcacggagactcagaatacaacatcatgtcaggtcccgacatctgtggccctggaaccaagaaggtacatgtcatcttcaactacaacagggcaagaacgtgctgatcaacaaggacatccgttagcacggatgatgagtacaccaacacctgtacacactgattgtgcggccagacaaaactatgagctgaacactggacaacagacaggtggagtacggatacttgcgaacaacgaatgggactaactgccacccaagcaagataaaggatcctgaatgcttacaaaaccggaagaaatggactgagcggccaagatacgaagaacccatcagaaattcccaatgcagtcaggaactgggacacaaggccggagaacataatcctggaacccgtgagtgctatcaagcaccgatgacgggtactaacacgatgtgacgtgcaaaatgagaaccaccagaggaatacacaacctgcagtcagcggactataaaataccagaaagaagaagacaccgagttaaggcacccagaaccacg

SEQ ID NO: 536170 - DNA, 189 bp, Homo sapiens
  misc_feature (8)..(8): n is a, c, g, or t
  misc_feature (47)..(47): n is a, c, g, or t
  misc_feature (52)..(52): n is a, c, g, or t
  misc_feature (65)..(65): n is a, c, g, or t
cttactanatgaagtcagcttccaggaatcactctgagtgatgacgncacgncccccagcagtancccaagatccccagtggccctggcaggaggcaaatgttcttacccctaccacacgctgtctcagtcttcagatgagttcctggatgaacccctcccccctgtccaccactagaccagccagcag

SEQ ID NO: 536171 - DNA, 659 bp, Homo sapiens
agcctcggcctcccaaagtgctgggatcacaggagtgagccacggtgcccagccttaatttttgtattttcagtggagacggggtttcaccatgttgatcaggctggagtgcaatggtgcaatcttggctcactgcaacattcgcctcctggatttgaatgattctcctgcctcagcctcccaagtaactgggattacaggaatgcgtcaccacgcccggctaattttgtatttttttagtagagacggggtttcaccatgttggtcaggctggtctcgaactcctgacgtcagttgatcctcccacctcagcctcccaaaatgctggaattaaagctgtaagccagcgggcctggtggacatcttttaataatcagtctttccattcaggtatatggtatatgtctccatttacttaggtcttatttcatatccttcaggttggagctatcatttcttttcatacaggttttgcacatttcttgtgaggtttataccttcatggtccatggattccgtagtgaattgggaatcctttttccaccaagtatattttctacatttgttactttagtatacaggaaagataactaatttttatctgcagtttataatctatgaacaggattcaaagtagaactactcagtaacaggttcca

SEQ ID NO: 536172 - DNA, 196 bp, Homo sapiens
cgatctacggtgtgaggatagcaatttaataaaaacccaatgccacccaatttacatcatgataatcaacctaaagaaaccagcaacaacacatttttctctgcgttctcttttacagctaaattctcaccttttcagtcgtagtcggttttaatattatcaacgtgttgtttttgaatcctgcagactgagacca

SEQ ID NO: 536173 - DNA, 145 bp, Homo sapiens
cacgccccaggagatttgggacccctcagggcatcagggggggtggtctggtccccattgcggccccgggaggggaatggtttttatggccaaagtttggttttctccacactgtctaaatttggattaaaactttgaactttta

SEQ ID NO: 536174 - DNA, 711 bp, Homo sapiens
  misc_feature (402)..(402): n is a, c, g, or t
tctttactttgtaaattacccagcctcaggtattcctttatagcaatgcaaaatggatgaatagtcttgatgccaaagccctacaaagatgctataagaaatctatggactaatagttctttcttttttttttttgagacaaaaagagtctcactctatcactgaggctggagtgcagtggtgcaatcttggctcactgcagcctgggcctccgtgggttcaagtgaatctcgtgccaaagcctcccaagtggctgggattacaggcgtgtgccaccatgcccagctaatttttaaatttttagtggagacggggctttgccgtgttggccaggctggtctcaaactcctggccttaagtgatccacccacctgtggcctcccagaggtgctggcttgtggncccaaggggcgtttggaagcccacaacgtggcgccctgtggcctatagactaacttcttaaactggatgtaaatctccaatacaaaccaattaacagcattaaaaggatttttattacaccagtgaccaataagcactgtgaaaagatactcaatggtggctaattaaggacaatgcaagtcaaaactccaagatgctacctcacacccattaggatggctgctatcaagaacagcagaaaataatggtgggcgaaaaaggggggggggcccaaaacccccattttttttgtggcggacaaaaaaaatt

SEQ ID NO: 536175 - DNA, 297 bp, Homo sapiens
agcagtggactcagctgaggccctgggcatggtgcgctggtgccatgggcctggaatgtttttgaaacatcctgtgaaatgagatgtgaaaacttctgaagcccctttccactgccttgccaatgcagttccaccatgctgtacctgtggagaatggtgtgatgtgttttcctgtgtgccctggcatgacgatgcttggatgcatgatctgtgctgcacaaccggagaagacagaattacctctgctcttttaatatataattgatggctttaaataaacattaggagaaaatgtcg

SEQ ID NO: 536176 - DNA, 273 bp, Homo sapiens
agcagcaggtaccagaatcctcttatatttagaagaggttctgtagagtgtgtgtcattgttttgaactgtgtcctggtaatttgccagtgaaaccatatggacatgctcaattatctgtattcttcgaacgcttatatatgacaaatgctgtatctctggttgtgagagaaccgttcatattagttcaccgcgagtcttggctgtgtggtgtttagtggcattggcttatttgagctaacttgtggagtgtgtgtgttgcagtgtgcttccg

SEQ ID NO: 536177 - DNA, 394 bp, Homo sapiens
gaacaaaaaaaaaggtggaagtctcactggtgtcacatatcaagagaaacaggatcaattcataattaacaatctttggttcctggcttatagcaaacaggttaaattggaagttggtaccggaattagtatattaactcctaacaaaactaaccaatgaaagttttattatcatctcctttttgtttgtgatgttggatacggagtctcgctctgtctctcaggctagagtgcaggggcgtgatctcggactaactataacctctgccttctgggttcaacatgattctcctgttgtagtcaccgagtgggtcggattataggtgcgtgcgcaccaccacctggctaatttttatatttttaggggggaccggggtttcaccatgtggggcat

SEQ ID NO: 536178 - DNA, 201 bp, Homo sapiens
tttggggctttggtttttttttcactcagcataattattttgagattcatccatgttgtttttctgtgtatcatagttcctttttaaaattgctgagtagtattcaattgtatggatatactaaagtatatttgttcctcaattaaaggacatttgggtttccattttggcaattatgaataaagctgctataacccttta

SEQ ID NO: 536179 - DNA, 761 bp, Homo sapiens
  misc_feature (738)..(738): n is a, c, g, or t
ggacccgctacacattcgcaacagccctcccagacacagtgcacattaggcgggtggaggaacggctactcagcctagggcaaaagtcaccacctgcaagtgactacgtggccttggtccacccagaactggacagggagacagaagaaatgtctggcagaagctgctcaagcatggaagtcgtcagacagacagtggccgagccaggtgctagtaggaagcatacctgatgtcagtcacgcaatacagggaggagcatggtcgcatcccaagacattcaattgaagaccaggatgagctgtcctctcgtcttcaagtcccccttgtggctggggacatgtgaaccgaggcagtgagtgtgattgcatgctgggatggtggctgaatgactggtgtgccattctgtggcctggacacaaccagcacagagatgtcagtggtggagagtagtcttcaagctgaatgaagcccagcctagcacgcatgtgccaccagcatgcgggagttccgctcattagacagcctcacctgagtgcaccttccaagttgttccatgggctcactggctctggactgtggccaaccttctccacattccgcccaatctgtaccggatgctggcagggaggtggcagagagctcactgggactgaggggcatgggcacccaacccttttcgcacctgtgctatcgcctggatctatcattactgcaaaaacctgctctgttgtgctagantacacgcgggtgctgctggactt

SEQ ID NO: 536180 - DNA, 715 bp, Homo sapiens
  misc_feature (239)..(239): n is a, c, g, or t
  misc_feature (362)..(362): n is a, c, g, or t
  misc_feature (443)..(443): n is a, c, g, or t
  misc_feature (651)..(651): n is a, c, g, or t
taaccagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgnctcctgcccttacagacctaagtgggtggcttctttccatcaactcccaacttcttcctgtgaagtttaattgtctcaacggctccccctcccccattccctccatttttctcccaaggaaanctgactcaattatttggatatttgagaaactgctgcagattagttctttttgggcagttttcccctgggaactcctggctntggtggagggggagggatggagagaataggaatcttcactaggagccgcgggaggattgggaggtaaaatgctgtttttgaatgtcaggaggcttgataactgaggatcttcatcaagtttttttcccgatgggaggggattttttacttttgggggaggtgactctccccttcatggtattgggggaagaggcagaaatggaaatcnccggaagggcccggtagtgagggtccaatggttaaaacggtcccactcaggagggcaaagacca

SEQ ID NO: 536181 - DNA, 141 bp, Homo sapiens
tctccgcgaccaggtcaccagtaccacccgttgacactcagctaccccggacggcacccaggaggcaggaggcagccgccccatctgccccacagtctccggcctctccagcctcagccccctacttcagtcccttcccca

SEQ ID NO: 536182 - DNA, 460 bp, Homo sapiens
ggttgctttgtgacactctgagaggaccctgcctcattttagtattgtatacagctgtaccaatccaaaagcaaaggtgtcactatctcagccactcatgtggaacagtctgtggttagtatgacatacactatcatacccgtctctgaattaatatagctacgtataaccaatcatttcttacacatacacatggcatagtattgcccttggtgggcatgcttgcgtaaggtatactctggctagtgtagaggacaaagatatataggccagctgaaggagggctaggccaagggtcttttattctcttggagacaacttgttgtacaccttgcattctagactattgattcataccacattaaagtctgggtagtaagacattaatgctactttgtagccatccatggtgggagctccacaaacagtttgggaatttcgccagcaatttggggatttc

SEQ ID NO: 536183 - DNA, 844 bp, Homo sapiens
  misc_feature (359)..(359): n is a, c, g, or t
  misc_feature (483)..(483): n is a, c, g, or t
tttttcccacctcgtgcttccccctttttatttcaagaaggtgccagccccaaacaaagttacaaggttaagtgcaactccaagtccctgacacagtctatccccgtgtctcggtccttcaaaaaattagaggtctctgtaattcctcctttttgtgaaccatgtgccttctcgaagtgtggaggctcttgggccatgtgagcctcttctctcgacctctcatctctagtgtgcccacgtggtgtgactccgctcagcctctccaaagtctctcccactctcgtgctctttgaaaggcttctgcgtctgtggtgtctctgtgcggggcatgtgcgcccatgtgaggctgtgcctccccngtctcatctccgtgctctcaccgtgcatctcatctctccggtgatgtgtggctcacggcgcgacatttatctctgtgtggccccccaaaatctcagcacagagttaaatgtgcctccgaaaccncccaaatctaccatttgtgcagagaagagttcacccgcgtgacatgtcccagaaacactctcaccccgaggagatgtgcccatctctctacctgtgtgtgcgagtataacgctctccgcaactctccccgtgtgactgtgtctaaacccatatcagccctttataaacaaacgccgcgcgagtgggtctccacgtgtggcgcacacgtgtggcggcgaacccccttgttgtggcctgtggtctgtatccaacacaccctccgtgcgaaacacatgtgtctcccatctgtttgtggaatcttccaatctccccaaccccaaatttacacgacacatctccatatagcgggaagggcaccatt

SEQ ID NO: 536184 - DNA, 434 bp, Homo sapiens
  misc_feature (50)..(50): n is a, c, g, or t
  misc_feature (120)..(120): n is a, c, g, or t
  misc_feature (286)..(286): n is a, c, g, or t
  misc_feature (333)..(333): n is a, c, g, or t
  misc_feature (382)..(382): n is a, c, g, or t
  misc_feature (399)..(399): n is a, c, g, or t
  misc_feature (428)..(428): n is a, c, g, or t
agaaattgtcaccaatatcagcaactctatggagtgcaggcctcccccanctgtgaagaggatcagcagaaaaaagatgagttgtagacactgatctgctaggcgtgtaatattgtaaanactggactcaggaacttttggtaggaaaaaattgaaagaacttaagtctcgaatgtaattggaatcttcccctcaaagtggagttgaaactgctatagcctaagcggctgtttactgcttttcattagcagttgctcacatgtctttgggtgggggggagaaaaanaattggccttcttaaaaagcgggtaaaaaacctgggttagggggggngttccccttcaaaatgttttatttaacaactgggtcatgggcatttggngtaggaagttttttttnccataagtgaccccaataaatgtttgttntttcca

SEQ ID NO: 536185 - DNA, 267 bp, Homo sapiens
gctgtggtttggtctacactggaaacactgtgttgcctggcgatagataagctgaccttcaattctccacgttcatgtttgtaatgtgggttagtgaataacacttccgtcccaagactgttatcaggattacgtgaggaaatgtatggaaagctcctgacacggtgacaagcaggaaccattattagatttaacgccactattcttaagatcagcccagggtgatactggactggagagggtcgcatcaggccaagccccatgtgt

SEQ ID NO: 536186 - DNA, 997 bp, Homo sapiens
  misc_feature (354)..(354): n is a, c, g, or t
tggaaaaagtcatggaggccatggggttggcttgaaaccagcttgggggggtctcgatccctccctttttggtctaaatttatatgtaatacgggttctctcgaagtgtggtggtaggggtggggggcactccatatagtcacctccaggtttatggagggttctctctactattaggactttctcgcttcgaagcgaaggcttctcaaatctttgaacattttttaattatttacgtgcgtgcttagaagaaaattgaagtgagcctacagattgattaggcagtgtttccagtggtgggtgttagtgccactcggggatagtctccgagttaacgctcggggcatcccggantaggccgagaaaagtctgtttggtggggcaagcaaacgcttaagatttacgcccgttaaatttgcatagctgcacaagtggcatttgggccgtaggattgggcctagggggttacccgtgagaaataggggcacacactcagctgaaatgaagcctcctatgagtggccaaattacagcctccctatttgtacatgggaccattaggtggcaacgtgtgggcatacaagcgttatcacacgtgtgctcggcgttaagtcccgagtgttcataggtgactgacgcttggtgcctaaattcacaagttgcccagtctcaaggcccccaccatagcgggctgaaacacgcaaaggcattgaactccctagggggctccagaaagcacttgcacgacaagattccatttccatatttggctcacgccgtgggaagtgtttggcacgaagatacacgcttaaatttgccgagaagaaaactagtttctccgaaagggaccactcctattgtccgggggtggcgggaccacacacagggttactctgcaaatggtcgccccattggctcactagggtgtttttcccgggaaccccgagattttctttggtcacacaatggtggctcaagcatcctgccgggttccccct

SEQ ID NO: 536187 - DNA, 204 bp, Homo sapiens
cgatggctcacacctgtaatcccaaagtgctgggattacaggcgtgagccactgcgcccccgcccaggagctcttttcttatgacatataaattatgacatttatattctttatatgactttatgttctcttcttatgacattaaaattctttaagtagtttgttggtccaataaacaaaacagttgtatatctaaaaaaaaaa

SEQ ID NO: 536188 - DNA, 896 bp, Homo sapiens
tggtaggaggtgggggtataaaaggaaagtggcatacctcttagtcataagtactggggatagatatgcaattgagatctgattttaagtcatttttaagaatttgctgttttgaggccagcatctttcctgctaatctgtgatgcccttggccaatacagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatca

SEQ ID NO: 536189 - DNA, 694 bp, Homo sapiens
  misc_feature (363)..(363): n is a, c, g, or t
  misc_feature (365)..(365): n is a, c, g, or t
  misc_feature (489)..(489): n is a, c, g, or t
  misc_feature (491)..(491): n is a, c, g, or t
  misc_feature (512)..(512): n is a, c, g, or t
  misc_feature (527)..(527): n is a, c, g, or t
  misc_feature (586)..(586): n is a, c, g, or t
  misc_feature (612)..(612): n is a, c, g, or t
gcacgaggtagtgttcgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcagaaattcacattgcagtacatgatgccagaaatagcactgaatcaagtagccattgcggagctgacctcttgagtctttctgtccatgccattctattctgtactgtgactctagttcaggaagttttggtatgagttttaaatccagttctaaggccttatcacctncncttggcataggccaacaaccatagttcctcacatttagtgatagcagactctttgtggacgagtgaattcacatacagcacaatttcagaagaaatcagggcacatgctcctacttttcttctntngacgcatcatcctgtgatgtngaaatgtcaattgangatgctgatgttgtgacgtcatcactggcacttgatactctatgaacagttgacttcgntactgcctcttacttgccttgttgtngccactagatttcttgggcactgcatagacttgatgttgcacacgtgtcgagtatcttctcactctcgcgtgttcgtcgtcg

SEQ ID NO: 536190 - DNA, 1419 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatgtaagcttaatcaagtgcaggcctaggagagaatgcaaagtctgctctgctcccatgctgcttgggtggtgaagaactgttgtaaatcacattacctagcccaaagggctctgagaagtgctgataacagttttctggtttaataaggtggcaactctccattaaccaccttcctaccagctagttatacactaattaattaagtagttactaatgttttacctccatcctcctcgtcatccattctgtctagttactcagatgaacccgggggagagtggagatttttgtaggacgatgtcaaaactcttgattttttgtgaataagtaaccttgagattcaagagtgtggcttcaagtacaaggcacagtgctaaaagatgagctccagttctcatcatactcatctcttaccaaatgccctcaaatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatca

SEQ ID NO: 536191 - DNA, 201 bp, Homo sapiens
gaccaaataggagtgcctccaggtatccctttcctttttcccgtctatactagggaatgtcttccttcctatctatctgcgaaatggaaatctagcactccttcttcatccataagtggactgtggcagtacaatacatggctcagaccccaagactagaaggagctctagtctccttcctgtgtggaatctttcccactc

SEQ ID NO: 536192 - DNA, 333 bp, Homo sapiens
tggattttcctcgttctttcattggaactgccttgtcgcttccaattgctccccgtcggcattctgtcatgctgcttcgtggggataatttatcatccacgtctgtgctattctacagcagccatgtccttagaacatagaaaatctgattggccaaaaaaaaaaaaaatagtgccacaagtgtgtcaatttcaatacactcaggcaaaaaactgttctccattttggcatttgtactgattgccccctaaaaattgtttttctttctttggcctttagcaaggcccagccagaggcagagaacggggttgacactttgcttccagaggggtc

SEQ ID NO: 536193 - DNA, 126 bp, Homo sapiens
gagtatgagagaagttagttggttccctacaggtgcactgaaacactccagcaggaccttctgggatctggggagcactgctgctaattattaacagcagtcagggccagtaaagacctatcctgc

SEQ ID NO: 536194 - DNA, 733 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtc

SEQ ID NO: 536195 - DNA, 242 bp, Homo sapiens
gtgtgtgtgtgtgtgtgtgtatctatataaatctcaaaaataaaagatcatttttgagattatcattttaaaagacaagataatgttcaacttaatgactaatttaattattactattggactttttgtagactaaacagggcattcaaacaaatgaaggggataaaaaatatgtattacatgttgtaatataaatgtgatgtggttaactcttatattcaaagttatagcacatatatatg

SEQ ID NO: 536196 - DNA, 659 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctggacagattaaggcaacagggcagaacaaaatttccattggaaacttgatgggaaaggttaaatttgtgaagaaaccatttctggccttctatccatcttgtgaaccctcgcagaagttgtaaacagacaag

SEQ ID NO: 536197 - DNA, 121 bp, Homo sapiens
tgcggggactacaggcgtgagccaccagtacagccctggtttaatttcctaaggctctggctcggtcacccaggctagagtgcaggggcacagtcatagctcacggcagccttgaactccg

SEQ ID NO: 536198 - DNA, 670 bp, Homo sapiens
  misc_feature (436)..(436): n is a, c, g, or t
  misc_feature (470)..(470): n is a, c, g, or t
  misc_feature (504)..(504): n is a, c, g, or t
  misc_feature (552)..(552): n is a, c, g, or t
  misc_feature (640)..(640): n is a, c, g, or t
  misc_feature (648)..(648): n is a, c, g, or t
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggcagagtaagatgaatcacattcctaaagtagggggaatagcaggcttttcagttatacgaattgcctttctaagtctcacgctacttntaaagccaatcatcttgctctgtgcccctgcganctcgttgaacgtaatgcacgaactctaaggtggnagatgggccccaaaaatgactccatccttaactcaagcttcacactgnaaatcccatacattatttcaaagcctgctgttctttaccatcgggctatatgaatgagtccccgcccctcaggcccacggccaccggntggattanactcacctcctaaacacagcct

SEQ ID NO: 536199 - DNA, 137 bp, Homo sapiens
aaatcatgaggaggtgtgatgggaacgtggtgggtgaaagcagaggatgctggagccctcgaggagaagagacacaggctggggcagcaggggctgggggcaggacacaatcactgctcagacttctccaacagacg

SEQ ID NO: 536200 - DNA, 765 bp, Homo sapiens
  misc_feature (304)..(304): n is a, c, g, or t
  misc_feature (609)..(609): n is a, c, g, or t
aaccccacacccttgggggaccccccaccccgaaatagagagcacaagagccacaccacaacgggggggaacacatagagggtgacaccggcgaaaaaggggggctcaccccccaccacttaggccgcccgcagttgttgctcccagcacagagaagaggggtgctacaacacatcgcggagatcgtagagagagaggacatatagacagagaaagtgtattgttgcaccaccccggcccatccgtggtctccccacgagaagagtgtccccctcgtggtgagatactctctaaagaaaaaagnagtctcgcagtctctccgccacccacagtgtgggtctcacacacaccgcctgtgtcaccttaacaaggttgtgagaagggaggagataatctgtgtctctctcaacacacacacacgcgggagtttctttctccacttggtgacacacacacactctccccccaacctggtaggagcacgacacaggcgccccgcagagagatctctcgggctggacccacgctgtgggccgcccggtctgtaggacccacgaggaagacacacgcacaggagcgcccgctcgagagagacacccctccccgcgnccccaaagagaaagagaatactcttccagcagattttatccacacaagaagggaaagagagaccccggaaattaaacccccccccttttttttataaaatggcccctttggttaaaaaggcgcccccccttaaattaccaccccctttttttccca

SEQ ID NO: 536201 - DNA, 645 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggggtgactggattcttaagaacgttctgaaagactctacatcataggcctggcagatttttcaactggatttccaagactctgttcttgttctgagattctctgaagaatcaaacaaactgttgcttgagctttatgtgggcaacagctatgagatcagaacgctgctgagagaattgccaccaagccttcccagttatcataaccttgaatggccactagatgtacagtttgcaagtatgagcattcaggcaccagattaaacccggagtgactatatagatccaccttactcattgggt

SEQ ID NO: 536202 - DNA, 415 bp, Homo sapiens
  misc_feature (16)..(16): n is a, c, g, or t
  misc_feature (36)..(36): n is a, c, g, or t
  misc_feature (38)..(38): n is a, c, g, or t
  misc_feature (47)..(47): n is a, c, g, or t
  misc_feature (233)..(233): n is a, c, g, or t
  misc_feature (325)..(325): n is a, c, g, or t
  misc_feature (343)..(343): n is a, c, g, or t
  misc_feature (351)..(351): n is a, c, g, or t
  misc_feature (402)..(402): n is a, c, g, or t
  misc_feature (414)..(414): n is a, c, g, or t
taactctttttttttntgagaccgagtctcaataanantaataatanaataaaacaaataataatttccaaaaaagaggctagcaaggtgctagcaaggtgctccatgtctggggcagcctgctcaccaaggcctctcctgagcttcgttctccatccaacagctcaacaactttgggatttgctgacctgggccctcctggtccaccctggtcctacagaacttctcacacntcattcccttccccatgatggaccaagaaaggccccgtcctacccgcagccctccccgctgcgtggctcctctctttagagggtaggcagancaacgggcctagaagagntcaagtcncaatccctggagccccataaataagtgaactttaatcttcataggatgtcntgaagtttaacna

SEQ ID NO: 536203 - DNA, 401 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagcttctccgctactcactagctgtggtggcgccaatttagaggtttacaaacaaacaggtatctgaatcacctggggagtttgctgtgcgcttcttaggccctatctttcagaatcgtgacctcgcaagtctagggtga

SEQ ID NO: 536204 - DNA, 237 bp, Homo sapiens
ggagtcgagggagcgggagatggagctgcgggtgaggccctggaggaggagcggcggaggtgtgagcaggtagaacggagggtgcagagtgagacgtgcccggaggcagcagctggtcgagaaggaggtcaagatgcgggagaaacaattttcccaggcacgacccctgacccgttacctgccaatctggaaggaggactttgacctgaagacacatattgagtcatcgggccatgg

SEQ ID NO: 536205 - DNA, 969 bp, Homo sapiens
acagaatgatctcttctccttggctcgagctggaatcattagccactgtagaggttctaaaagtcatggaggctttgtgaatgagcccaattatactgtatggagcgacctgagtctgtaacctggggattctctcaaatctctgtgtcccatacagacttctatgaggaaatccaggagttgtgaaagatgtcttttcaccttatagggggagagtaatggcgctgcgcgtacccccaatacctggaaacaatggtccatcttctgcatgctaccttccatgtagagggcttgtgttctgggatacatacttagggaacaagccagggaccattacaggcaaccgtttatcaagaatcccagtccgtccggttttaagagcaccaactgtcggaaggcaacccactagattctctcctgctgtatctggtgcgagtcctgtctaatcttgatctgttattctgatacgccatgtgtgtaatgggtgacttgaactttagattatttaatagtttaaaagcctctcgataaaacctacaggcagactacttgtcacctgaaaggagcacacagaaccgcgagattcggaaagagctccttgtgactgactcaactccttcttgtcctggaacctgtattgcaacaacaggctcctcacgttttgtcacttatcacgaagaggtacgtccacaaggacactgtattggtaattggtgggagtagcgtggaggcaagcaagcatggtaggaaagcgtgtttggaagattcatagatggacaactgggaagaactttattatccggagtacagggaggattctttaatatccagactaataaatgctatcaagtagagggatttgccgttgataaaattggtggagagttaagggttgttcgaaagtacccattctttagtgagcttagcatcacgtgttgggaattttgggaagggtggtaagaaagtgag

SEQ ID NO: 536206 - DNA, 460 bp, Homo sapiens
agaaagggcattgcctctataagtattatacgtgattatatgatttggctatgaatgagtcctcttaacacaacaaataagatgtactgtgtaatccaccccattggcttcaaatgggcaaaaccatctggtccactcaattaattctaaggctcttggtatcactgagccagtgtctttgaatacatttctattcaatgggcatttacactggatacttactctcaaggttcccccttttaccctttcctctgcacaagcttcctacatgttaccatccctcgccccagatacccacaggtgaaggggactggaagcccattaagctagtagcatctcatttggcatttcacttgtttcattttattccagaaggttggtctgaaagcgtaatgacaacaaaagcagcagatttgagagattctcccaggagaaggaaaagggatgtctttcagaggta

SEQ ID NO: 536207 - DNA, 658 bp, Homo sapiens
  misc_feature (241)..(241): n is a, c, g, or t
  misc_feature (246)..(247): n is a, c, g, or t
agaggctagtggtggtggtggtggttgtggggagaaggaggagctggatgtgagtggcagtgtgctgagtggagtgagtgaatgctggacgcgcgagggaggggagggaatgtgtgaatggtgaatgtgtgaatgtgtgtgtgtgtgtcactgctgtgtggtgctgctgctgctgctgcacctgtgtgatgctgctgctctgtgatgtgctgatgttgtgaacttgtgactctgtgtgttnttgcnnttgccatgctgtgctgtttgatggctttctgtgccctgccagtatattaacaaggcaatgcgttcccaatctcttgcttgcccttgtgaacaactattgtgggattgccattgcttgattgccaagctttgcttgttttttccccccttgctagagccccccttgatttaagcccaggttcctgttgaagcgagtggtggaagttttttcccttccgccttggccccttttctaagtggccgaccccgaggaggctggtgttggttggaagatcggcaattttccttttccctttttaggctggccaaccacagtaatccaagatttttggtcggccccttttaaagcccaattgggcaaacgaaagccgtaagttttgtggtttttccaaagcaattttggggtgcggaa

SEQ ID NO: 536208 - DNA, 171 bp, Homo sapiens
cagcagttgcaagtgtgtttttaaagggaaaaacaagagacacttttttgttgtttttgagacagaatctcagtccgtcacccaagctggagtgcagtggcacgatctcggctcactgcaacctgcgcctcttgagttcaagtgatattcatacgtcagcttcccgagtag

SEQ ID NO: 536209 - DNA, 404 bp, Homo sapiens
aagaggttgttctctcaggaagttgcctcctagcctccaacgaggcctttcctatcactgctcattctcttctgtgtgtggattggatactgcggtcacccagagaagctggtgcacaccaggcacatgaaggggcgatccttgtctccttccgactcatgcgcgtgtcttgatgtttaaactcagaaggatgtttaaactcggttgtctatgagacaaaatggctagtttttggagggtctggggcattacattctgcagattaagatttttgcccgatattggccaagtcaaggaaatagatgctaaggccaaatgctttgaaaaaccacaaactcctgtttctgtgggaaatgtttggcctgttgaatcaaactcaataaagaccagtaaaatctgtaaaa

SEQ ID NO: 536210 - DNA, 729 bp, Homo sapiens
ggaagaaatttacaaaagaggcagggagggcgtttactgagaaggtgactgatgaatggaagtgaacggaaggggcatatgcagtgccagtgtgctcatcagtgtggaaagggcctggaggtggaagtggatcatgcacatgtgcgtgagatgtggagtttgcagcagcaggctgaatgggtcacgagagtcaatatcgtaaagccagcacagccgcgggctcatagctcgatgaattttcatttaatttatttaatttctgacgacacgaagtctcccgtcatgtatgccgcagggctggagatgcacgtgcgtgtgaccgtcagcatcacgcgcagatgacccccatggagttcacagcgcattcttgatgcctcaggactcccgacgtacgctggcgattgcagggccatgcagccacgcacagctcaagctaattcaaagatgtattactacgtagagatggggtctacgcatgctgcttggcgtagactggtttatgaacatcctgctcatcaagctgatccgcgctgcctataatttcaatataagtgactggggtcctgttctctcacaccaggccttgaagtaccagtggcactgaactacttggctcactaggcatccttgacactccatggtgtatcacagctatcactccatgcacttgagcccaaggagttagctacgccattgagccaacaacggccccagatgatatacagaata

SEQ ID NO: 536211 - DNA, 269 bp, Homo sapiens
acaagtgtttcacctgttggctggtcacacaaggagtttgcattttgacgggcctgggcttcaatggttttgaacaaaagggcaaggcaaagggggatgcctgtgccaacatcaaggtgtgggtttttaaaataaaccggggctgtactggcaccattgcttaatttgacatcaacaccaacgcctgggtgggccgatacatcttgaaacgactcatgttccttggaaataaagaactctctcatgcgctctggtggttattcctggcc

SEQ ID NO: 536212 - DNA, 761 bp, Homo sapiens
  misc_feature (251)..(251): n is a, c, g, or t
  misc_feature (253)..(253): n is a, c, g, or t
  misc_feature (302)..(303): n is a, c, g, or t
  misc_feature (329)..(329): n is a, c, g, or t
  misc_feature (331)..(331): n is a, c, g, or t
  misc_feature (336)..(337): n is a, c, g, or t
  misc_feature (436)..(436): n is a, c, g, or t
  misc_feature (451)..(451): n is a, c, g, or t
  misc_feature (469)..(469): n is a, c, g, or t
  misc_feature (480)..(480): n is a, c, g, or t
  misc_feature (491)..(491): n is a, c, g, or t
  misc_feature (515)..(515): n is a, c, g, or t
  misc_feature (647)..(647): n is a, c, g, or t
  misc_feature (761)..(761): n is a, c, g, or t
tcatatactggctaggtacgaggctgggtggcggctgaggggatgcgggggcgggcgcgatggcggaggcgggccacaggcgccgcgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgtttngnaaggtatcgggctaatcgagaaaaagtccaagaacagcatccagtggannggtgtggggcctggctgcaatacccngngaganntgctgacaaactgattgagctcaaggcagagatcgaggagctgcagcagcgggagcaagaactagaccagcacaaggtgtgggtgcagcagagcatccnggaacgtcacagagngacgtgcagaacagctgntttggcctacngtcactcatgnaggacatctgcagatgctttgctnggagataccctcttggccatccgggccccatcaggcaccagcctggaggtgcccatcccagagggtctcaatgggcagaagaagtaccagattcacctgaagagtgtgagtggtcccatttgaggtcctgcntggtgaaccacggagcgcttggctgctcaccccctgtggtgttgctgtgccaccactgaagatttgctcacgaaaccatctgctgttctacacctccactctggccagctggcn

SEQ ID NO: 536213 - DNA, 1209 bp, Homo sapiens
  misc_feature (251)..(251): n is a, c, g, or t
  misc_feature (253)..(253): n is a, c, g, or t
  misc_feature (302)..(303): n is a, c, g, or t
  misc_feature (329)..(329): n is a, c, g, or t
  misc_feature (331)..(331): n is a, c, g, or t
  misc_feature (336)..(337): n is a, c, g, or t
  misc_feature (436)..(436): n is a, c, g, or t
  misc_feature (451)..(451): n is a, c, g, or t
  misc_feature (469)..(469): n is a, c, g, or t
  misc_feature (480)..(480): n is a, c, g, or t
  misc_feature (491)..(491): n is a, c, g, or t
  misc_feature (515)..(515): n is a, c, g, or t
  misc_feature (647)..(647): n is a, c, g, or t
tcatatactggctaggtacgaggctgggtggcggctgaggggatgcgggggcgggcgcgatggcggaggcgggccacaggcgccgcgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgtttngnaaggtatcgggctaatcgagaaaaagtccaagaacagcatccagtggannggtgtggggcctggctgcaatacccngngaganntgctgacaaactgattgagctcaaggcagagatcgaggagctgcagcagcgggagcaagaactagaccagcacaaggtgtgggtgcagcagagcatccnggaacgtcacagagngacgtgcagaacagctgntttggcctacngtcactcatgnaggacatctgcagatgctttgctnggagataccctcttggccatccgggccccatcaggcaccagcctggaggtgcccatcccagagggtctcaatgggcagaagaagtaccagattcacctgaagagtgtgagtggtcccatttgaggtcctgcntggtgaaccacggagcgcttggctgctcaccccctgtggtgctcgtgcgctcgtgtgcccacacatctgaaacatgcgctccagagcccatctggctgtttactacacctacacaccttcgtgccccagagctctgccctctaggcccagttcccagtgcaagctctacacgttccaaattaggtcctcaagctcaactcccatcttgctgtcccctgggcagtgcagaagtccacggcaatggctggcccagcagctgagatcacagttgagtggcggccctgggcactgatagcaaggacacgtggtgagctcagttcactcccactgggacccaacaacactggacacccggccactgcagtcttctgcccttgctggacagcagcacgcagccagcaggcagcagcaggcagcagcagcagcaaccagtaaacagcaagcagttcgtccggacccaacccttctacctcctttgagcccatcaaggcagaccctacaggtgtattcggaactccccatagagctgtcagaaatctttgatcccacacgagagtgcatg

SEQ ID NO: 536214 - DNA, 159 bp, Homo sapiens
tcattttcttttcaatgcatcaaacaactgtggccagtgcaacaggcaaccaaaactggcagtttgtccatttgaatatcagcacctcagtttcttacttaatttcccacactatttctcccgatattccgttaaacttctatggccatccttcatgcg

SEQ ID NO: 536215 - DNA, 217 bp, Homo sapiens
atccggatcaggtgcaccgctcgggagggaaagaaatcaacacaactgaaattaaggaagagaaatgcaaaagcagactgcaggaatcctgccccttccaccccaaggggcacagcccggagataaagcttattttagggatcacaagtgcacgctctgagtagacgagaggatgactttgtcagtcttctggctagaagggcctatgtccaaaagt

SEQ ID NO: 536216 - DNA, 329 bp, Homo sapiens
caaccatatttaacaaatggctggtagagctcagcccaatcctatatgatcaaagactggtagagcctaacccaagcatgtcatctaagactggtagagctaacctcaagcatatcaacaaagactggtagagctaaccccaagcatataaagcgaagactggtagagcttatcccaagcatatcaacaaagagtgggaagagctaatcaacaacgactggtagagctatgcccaagcatatcaacaacgagtggtagagctaagccgaaccatatcgacaaagagtgataaagttaatccaaaccatgtcgacgatgactggtaaagc

SEQ ID NO: 536217 - DNA, 273 bp, Homo sapiens
cgacccgttctactcgccagtgggctgcggtgatacgcaaccgagacagagctctactgcctctacagcagatagcttctggagagcgagctgccgcgcacggggctggagtactgaagctcatcccttgagttcttcgaagcccggaatgaaggaaccccctctgcatgctgctgctcatcgaacacctggccttgcgggcccggaactacgagtatctgatccgcctctttcaggagtgggaggctcatcggaacctgtccccagctccct

SEQ ID NO: 536218 - DNA, 160 bp, Homo sapiens
tgtctctgaggatccctcgaaagagcgagggtggtctactctgcaggatgctgcagtccggtccatgcagcccgctctgggggaatgcttctctgtggactctcaagggcgttaccgtgggctcggcccataccagctggtgtcctgtcgtgtcggagga

SEQ ID NO: 536219 - DNA, 957 bp, Homo sapiens
tgctaaatatatcactagcattgtcttagagaggaacacttggtcatcatttggtggattacctacgatcttatacgaactggacgacagtcatattaagcctactcgtatggtagcaaagtgtgacatcgtaatatgactgtgcattacgtcttctagggacggccgtgtccgtatataacggcacagctatgctctttacatgacattatcccaagcaagtccaacacgctggagcaaatgaccattcacatgtactcaacctgctagtatacctaccactgctttgtatccttgatcggatctagccgcgatatccatatatcaggcaatatgatggcggaagagcaaaacaggattgccgcatacattggattctgatcacagtcctggcagatttcacacgggaaccgcgtgatctttggacaagcgtcgctaagccacgaagtgcatatgaattctagagcccgacgtgcctactattttgcacactacgcactgttggctttaaagatcgcgccaggttagcaatcggagatagctggagatccatacaggagtttccttatacttgtacatgtgaccgttacagattgcagacggcattgggcaacatcgtgtgcaatcgcgtgtcaaactgtctacacagggtagtggctaccagtgtatggtctcgccttgaatcaaaccgggagtacttgagccggtctacgaccccaggtaatgcccctggaacacagtttgtcaggatctactctaccgggaatggccacatccgtttccgtgatcaggaactatcagtagcccacggttgtctccgaggatataccctgggttaacccgttctagccccccaccgttcccatttcggcttcccgctatccgtacgaagagctatctaagccgagtgtactaaggacgctgcacgattttgggccttcacactctgtctcgggc

SEQ ID NO: 536220 - DNA, 729 bp, Homo sapiens
agaaaggacggaccgtcatctggcgccccagatataacttccagcgacatccgatcgacaacaagggtgttccgcaaaccaactgagcaccgaagatggggacacctggtggaggatggaaaggctcgctccatccagaaaattctcgagactattgataaataagcaccgtagtgtagaaactgagtaaatcccagcacccaaaccctttgggaaatctgccgtgggccctcccagatagctccatttccattaagtgttttcccccccaggtagaatttgccagagtgaccacatggattgccatttcttttgggggagctttcttttggtggttttgtttattataaccctcttaagtgtttccaacccagggttgcttttgttttgagttactggggttatttttgttttaaataaaaataagtgtaccataagtgtttttgtattgaaagctctttgttatccagattttcatacttttaccctccctggctctttttaagattgatacttttaagaggtggctgatattctgccaccctgtacacataaaaaatacggtaaggatactttccctggttaaggtaaagtaagtctcccgttggccccccttagctataatggcactttgtttgtgttgttggagaaaagtcaccttgcccttaactttccttgtctgtttagttaatattgtgaagaaaaattaagtaccgtgtgagatactga

SEQ ID NO: 536221 - DNA, 478 bp, Homo sapiens
  misc_feature (463)..(463): n is a, c, g, or t
tctcactgagcctggagctgggcagcaggagcatttcttgtgtctgtccccccagtgctgagtatagagacactctagaagttggctctggttcttcctcccagcatcatgttcccagaaataagactcagactcaaaatatatttacaaatgccttagccatattgctaagctcttttctggctagatcataactaaagataacccatttattttaacctccattctgccatgtgggtgcttacctgtgctgaggtaccaagcacctgtctagttacatcttcctgggcaaatctcctacctctggctctattccagaatcctttctgcctcctggatgtccctccttgcatttcctgcctaagtcacggccatgagccttttgattgaatcggtacaatacagaaggtatcttctccatagataactcagtcattcccagcttcttattaatagggaatgnaacttgagtcctatg

SEQ ID NO: 536222 - DNA, 503 bp, Homo sapiens
  misc_feature (210)..(210): n is a, c, g, or t
tagagtcgatagtcattgtgggtgagcatcactgaatcaggacgatgctgtcgtgcggcagaggatagagggggagcaagttgaatgggacgtacatggagggaattgaaggtttcaaacatgatctgggtcatcttctccctgttggccttgggatttaggggaggctctgtgagcagggtggggtgctcttcaggtgctacacgcagntcattgtagaaggagtggtggcagatgttctccatgtcatcccagttggtgatgatgccgtgttcaatggggtatttgagagttaggatccctcgcttggtctgagcctcatcccccaaatagctgtctttctgggccattcccaccatcacaccctggtggcgagggctggccacaatggaggggaagacagcccggggggcatcatctcctgcgaagcttgccttgaacaggccagagccattgtcacacacgagcgcggtggtctcctcttcacacaatggcacgtggat

SEQ ID NO: 536223 - DNA, 481 bp, Homo sapiens
ccattatggccgggggggcattcctgaagctgacatcattcggtccgagatgtctcgctccgaggccttaggtgagctggggctactctttatttctggcctggaggctatccagcgtactccaaagattcaagtttactcacgtcatccagcagaaaatggaaagtcaaatttcctgaattgctatgtgtctgggtttcatccatccgacattgaagttgacttactgaagaatggagagagaattgaaaaagtggagcattcagacttgtctttcaacaaggaccggcctttttatctcttgtactacactggattcacccccactgaagttaagtgggatcgagacatgtaagcagcatcatggaggtttgaagacgccccatcttgattggaagaattccaaattctgcttgcctgctttttaataattgatatggctatacacttacaatttatgcacacaatgtagggtataaag

SEQ ID NO: 536224 - DNA, 150 bp, Homo sapiens
attagtgatgtcatcgacacatgcctgtctgatccataacatctacgatcgcgaccaatttggcggggcatgaggtccaaaggagacataggcaaccggacaacctccatgaagcgcctgaacaccatgttggcgcgtaagggccagcag

SEQ ID NO: 536225 - DNA, 449 bp, Homo sapiens
atgaacaagagcatgatggaatcgcactcttccaaaataagcatcaagtaaagcaaaaaccatgacaacgataacaatctctatgtaacatagctaaataatggattaaactcaggatcaggcagtagttctacaaaataaaaaatccagctaaagacgagatgaggaaaatagggggtcatatacagaggggcttcatgacagatggggtgtgctgcagtgatcctctttctctcttgccagctctcgaatggaggtggatagtctatagtcagtatgaggaagacaagtacagatgattcctcctcttctgagggcgatgacgaggaggatgactataatgatgacttagaaaacaatatcattcctcttcctccagctaagcgcttgaggttaatagtaggaaaagactctatagatattgacatttcttcaaggagaagagaaga

SEQ ID NO: 536226 - DNA, 153 bp, Homo sapiens
acatcacaaccattatcaatataaaaccccctgccataaccaatacaaagcccctcttcgtctgctccgtcctaatcacagcagtcctacttctcctatctctcccagtcctagctgctggcatcactctacttctaacaacgaacctcataa

SEQ ID NO: 536227 - DNA, 345 bp, Homo sapiens
tcacatctagacggatccccgatgctctcttgtatgggcagatcgtttgccagtgaagcactaatctgatcttaaggactggctccaggaccctgggctgcctgtgactatgcagtccacttggtctaccttaatttatcctgtggccaaactctgagatggtaccagccaggggctagcatgagcagagccaggtaccctgtggctctgatcccccatttatccaccccaaagatgatgagcgtctgatgctctctcgggggggggtgacttgggtcagggcaggactacactttccggatggttgatgatggtggtgatgttggttggtggtggtgggtggac

SEQ ID NO: 536228 - DNA, 423 bp, Homo sapiens
  misc_feature (11)..(11): n is a, c, g, or t
  misc_feature (311)..(311): n is a, c, g, or t
  misc_feature (413)..(413): n is a, c, g, or t
caattttaatncgaacgggtttcttactttaaaaaaccgaaaaacaaggctaggagtggtggctcacacctataatcccagcactttgagaagctgaggcaggaggatcatctgagcccaggaattcaagaccagcctgggcaacgtagtgagaccccgtcttttaaaaaaaaaaattagctgggcatggtgccatgtgggaggctgaggtgggaggatcctttgagcctaggagatcaaggctgcagtgagctatgattgtgccactgcactccagccagggtgacagagctagaccctgtccccccccnaaaaaaaagtatctgcacatgtaccctaaaacttaaagtataataataataaaatttaaaaaaaaagaataattaaacataactccaaaaataaaataaaanttgattatag

SEQ ID NO: 536229 - DNA, 220 bp, Homo sapiens
  misc_feature (30)..(30): n is a, c, g, or t
  misc_feature (38)..(38): n is a, c, g, or t
  misc_feature (44)..(44): n is a, c, g, or t
  misc_feature (61)..(61): n is a, c, g, or t
  misc_feature (69)..(69): n is a, c, g, or t
  misc_feature (81)..(82): n is a, c, g, or t
  misc_feature (112)..(112): n is a, c, g, or t
  misc_feature (134)..(134): n is a, c, g, or t
  misc_feature (140)..(140): n is a, c, g, or t
  misc_feature (149)..(149): n is a, c, g, or t
  misc_feature (189)..(189): n is a, c, g, or t
  misc_feature (207)..(207): n is a, c, g, or t
cctttgggtatttaatgtacagtttcagcnaaagacanccaganttatacctctggttggntcaaaatncttaaatggtgnnacatatggtctcatgtccatttgttagcanacaaccagctgttctcagcctnccaaantccaagtanacatccactgtgtggaagagtgaatctgaaatggttcagnaaaaacatgaaagctggntttgctgaagaag

SEQ ID NO: 536230 - DNA, 124 bp, Homo sapiens
gcaagtagctgtgattagagtatgcaccaacatgctcagctaattattgcgtattttagtagagacggggtttttccatgtggtcaggctggtctcgtccttctgatctcaggtgatctgcccg

SEQ ID NO: 536231 - DNA, 505 bp, Homo sapiens
tacttcacagcggttggggggaaagggggcagagttgtagttgaagagatgcatgtgcactttgctggtcgtgctgacatgtctgctgaatttacactagataacagggacccacatgttgttatatgattaacgtcagtttcaactgagaaatattgtgaaaatcttgtggccagaggaagcctctcatattcagagtaaaaaaaatctaatttagtaaaatgtgtgatgtcttatgggctgtcttatatccttaagttcttttcaataggagagcaaaagagaaatctgttggcagtacagtgcttgccacattcctgttgctaagcaaagggaagctagggagaagaggaaaagcgaaggtctgtgaatcaggggcagtaaaattctaatcaactcttggtgttatgcttggctgactttctagagaaggaaaggcagcagtctgcattggtatatccaaaggctcaggaatgtagtcccagtattcacaaaggaaaacgct

SEQ ID NO: 536232 - DNA, 902 bp, Homo sapiens
gcgtgtcaactggagaacttgttccacgatgtgtgtgtcgctgcttgtcgtgttgctgatgatgttcgatgctgtgctgtgtgtgcatgcagtactggcagaaatgcccatcatcaaatggtagcgcccatggattgacgtagcaggaagagactacttgcatgcttatctcttgctggtcacattggtcggttgatagctgcattgttctgtccatttccgccttcctgtgaatgtgctggagattgcccggcaatgcacgcctacaggagaaatccatttctgcttctccatgaccggaggagcaatcggtgtgtttcctttcatagtgctattgggcgatggtcagttgcgtccttcctgaatcatgcgattgattccctcaagcttcactacgttagtcgtggtcccaatggaacgaccacaataggttggtggctcccgagagaaaactgaccacgggtcagctcgatcgaaagaaagctagctagctttcgcgtgcttgtatagcatcctatgttcgattagtagatccattggggatccagcacgggaggtgaactgagtgtgtggtgtttatcaaaaaagattgtgtcagtatataccactcagtggggtagggtggctacagatttgtttaggtatacacaattgattatactctcattggagtggataattcatatacatatatgggtgtgtgaactatctaagtgagtgagactgaatggtaaggaactggatatctggtctgtgaattgattgtaacttaggtattatggtgtacaaaaaacatatggtcagcatgtgggtatgtatgttggatatataaattgggtacttattggatggatgagtataagattattctatccttaggtagccattaatacaataaacaa

SEQ ID NO: 536233 - DNA, 406 bp, Homo sapiens
  misc_feature (14)..(14): n is a, c, g, or t
  misc_feature (42)..(42): n is a, c, g, or t
  misc_feature (99)..(100): n is a, c, g, or t
  misc_feature (115)..(115): n is a, c, g, or t
  misc_feature (137)..(137): n is a, c, g, or t
  misc_feature (203)..(203): n is a, c, g, or t
  misc_feature (250)..(250): n is a, c, g, or t
cccacaaaccgggntggaatagagacactgcaacacgatgcntctcccctattcacctggttgcactgtggtgtatgctaaggtagcccagggagggtnntggaaaggagggagntgtccccaggggagagcctggnacaaggggcaagtcagggcctgagtcttgagggttcaagtgtgatccagctccgagaagagagggncaggggacagtcccagcacaggtcatgggaaagagctgaggagcatnccgctgggcttggcacatgagctgagatattcctactgtgaacctaataggtatcaagatcctgagttatttaaaagaaagtcgaagccccctcactttactacagtgcgacatatcagtgtagcaaaattacacttgtatgttgtgaatatacac

SEQ ID NO: 536234 - DNA, 584 bp, Homo sapiens
actgcgctgcaaggctgtggcaaggtcatccctgagctgactggaagctcactagcatgcctcccgtgtccccactgccaacgtgtcagtgtggacctgactgccgtctagaaaaacctgccaaatatgatgacatcaagaaggtggtgaagcaggcgtcggagggccctctcaagtgcatcctgtgtctacactgagcaccaggtgtgtctcctctgacttcaacagcgacacccactcctccacctttgacgctggggctggcattgccctcaacgactcactttgtcaagctcatttcctggtatgacaacgaatttggtacagcaatctagggtggtggacctcatgcccacatggcctccaaggagtaagaccccttgatccaccagccccagcaagagtacaagaggaagagagagaccctcactgttggggatttcctgccacactcatgtcccccaccacacttgaattcttcccctccgcacagttttcatgtagaccccttgaagaggggagggtcctagtgaccctcaccttgttatgtaccatcaataaagtaccctgtgctcaaccaaaaa

SEQ ID NO: 536235 - DNA, 530 bp, Homo sapiens
  misc_feature (7)..(7): n is a, c, g, or t
  misc_feature (9)..(9): n is a, c, g, or t
  misc_feature (14)..(14): n is a, c, g, or t
  misc_feature (32)..(32): n is a, c, g, or t
  misc_feature (128)..(128): n is a, c, g, or t
  misc_feature (156)..(156): n is a, c, g, or t
  misc_feature (377)..(377): n is a, c, g, or t
  misc_feature (407)..(407): n is a, c, g, or t
  misc_feature (447)..(447): n is a, c, g, or t
  misc_feature (466)..(466): n is a, c, g, or t
ctcagcntntgcangatgtgaggaacatgtanaagctgtgaatgccaaatgtgcttcccttgagaagacgaagcagaggctccagaatgaagttgaggacctcatgattgatgttgagaggacaaatnctgcctgtgccgccctggacaaaaagcnaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatttgcaacaggagatttctgatctcactgaacagattgcagaaggangaaagcgcatccatgaactggaaaaaatanagaagcaagttgagcaagaaaagtctgaacttcaggctgncttagaggaggcagaggcntctcttgaacatgagagggaaagatctgcgcatccagcttgagttgaaccaagtcaagtctggg

SEQ ID NO: 536236 - DNA, 183 bp, Homo sapiens
gtttactggtcaggcactgaatgcctgtgagctctataccagcttacaacagctgaggtgagtgtgaccaccattgtgatcacatggacagcctgctccacgaattggtcatacgctgggtgtactgagcacgccagtgcaggagaggtagcactgagaagtgacttcagacctcatgatgga

SEQ ID NO: 536237 - DNA, 108 bp, Homo sapiens
gatccccccccgcagagctctccgttgccctcggccgatcgaaagggagacgggttcagatccctttcgatcggccgagggcaacgggggccttcgcccgtcccttcg

SEQ ID NO: 536238 - DNA, 563 bp, Homo sapiens
tgatcgtagcacgaacctgatgggataggcaggaagttataactaataccatagaagcaagtaaggaacctgaggtgcagacagcatagatatcttgcttcacaccacacagactataaagtggcagagtaagaattagaaccaagtttggtttcgttcagtgtctagtgacaaactcatcatattcaatttagacagcactgggaaagtcataaaaaaaaagtacaaatcatccataatcctaccaaccaacaacaacacactgtaacatagtctgggcaaatcatatcatacatattgaacctaaagtgctatttttcaacatctaagctgcatcattattttatgtcaccatcaagaaagcaacccactgccaattcaaattctgacatgttacctgtaggtgggcatgcatctcgattacagagcatattaaagtgtgggggcaaaggtgtatcttaacacatcactgcaaatgtatatcgtcatctcattgctttctatataaccattataacatgagcagattgtggtaattaggcaacaatgactctccttataat

SEQ ID NO: 536239 - DNA, 330 bp, Homo sapiens
  misc_feature (39)..(39): n is a, c, g, or t
aaggtaaaggcagacagatgaatcctccccatatgttgntatgttggctgcccaggatgtggcccaaaggtgcaaggagttgggtatcccccccctacacatcaaactccgggccacaggaggaaataggaccaagacccctggacctggggcccagtcggccctcaaagcccttgcccgctcgggtattaaaatcgggcggattgaggatgtcccccccatcccctttgacagcactcgcaggaaggggggtccccgtggtccccgtttgtgaacaaaattccccaaaatattttttgttaataaattgccttcatgtaaactgtttca

SEQ ID NO: 536240 - DNA, 185 bp, Homo sapiens
gtgactctagagatccccgttgtcatgtgtctgtggggtaggaaataaactgggcgagaggctaggctgaaggggttacaaaccaccctagttaaacaaaaccccaataactctataaaacatgtctatagatgtgaaaagtatgaacaattctagatatcctatatatagacaaaagctcttcc

SEQ ID NO: 536241 - DNA, 391 bp, Homo sapiens
  misc_feature (11)..(11): n is a, c, g, or t
  misc_feature (62)..(62): n is a, c, g, or t
  misc_feature (281)..(281): n is a, c, g, or t
  misc_feature (381)..(381): n is a, c, g, or t
aaggccatttncgccggccaaaaacggggccaccggaaccaaaggcagcacacagctcttcncaaaattgaaggtgtcaacgccccagatgaaacagaattccatttgggcaacagaggcgctaacgcaaagaaagcaaagaacaacacaggcactccgggcggcaaaccaaacaaaaccagagacatctggggaaaagaaacacgggcccatggaaacagtggcatggttcgggccaaacccccaaccaatcttccggctaaggccattggacacagaanccgagggacgctgaacccctcaaggatttaaacgaacgaaaaatcaataaataaatggggatttgggctcttgattttcaagtggattaaaaaacttacnaccttaaaaa

SEQ ID NO: 536242 - DNA, 1111 bp, Homo sapiens
aggcattatcccgtggtgtcagcatttccggatagacggcggcgggaaatcggctgtgggagagaggctaggaccatctgagagaggcgaatccggcgggtatcagagccatcagaaccgcacaacatgacggtgggcaagagcagcaagatgctgcagcatactgacttaccaggactgacggtgcatcctgcaggaccggaccggactcttccttggacacccttcaacggctttatgaacaacgcacactgaactttgatcctctgatgacctgtgactgacgttcagaacagactcacagaaccacaacgacacctaccacaaagccacggcacgacacaggggacacgacgacacgcgaacgatcctccgagatccatggatgactgaatgaacgaacgaggcgacgaacactcttggatacatcaacgtgacccgatacgaaaggggaccactcaactcgccaaacgactaacgtgggataataggccatcggagattcgcatctttgacgtggaagcatgacccagagtgtggaaccacagagggaaatcgagaaagagggacatgactgagacaagcacggacaatcacacaagccattgagagaggtttcacagcaatgacacaccaagagacatccctgtgacaagggcagcatttgagtggggagacccacagtcacaggatggagagcgctcatgagccagggcccaaatccacacaaaaaacaaaggcatggaagtagaacacaccacacacaaagggcacaaggacgcggttcaccaatgataacggacacaaaccagacatgcccaggcagtgtcaattgacccaacacaagagccaaagatagtttaggaaacagagaggtgacatttccaaaaagcacgaaaggacttagaccaccgagacccatgagagcaccggatgtgacgagggtatacccatcaacacgacgcaaaagcttaaattgagaacacagctagggatgtcagagccgcaacagttcgaagaggcacaatgaaatggagagaccgccaacacgtcactatgagttatttgaagaaaccgtaccttacttgagagtccaccgacaaatatggag

SEQ ID NO: 536243 - DNA, 120 bp, Homo sapiens
accgcgtgaacgtgacggtacggccgggcctggccatggctgctgagcgggtccaccgagccctgctgcgcagctgtccatctcctccatctggcgtagtgggcacctgccgaggacaac

SEQ ID NO: 536244 - DNA, 264 bp, Homo sapiens
ggacctgtgcatacgagccctcaatgtcaccaaggcccgtgtgaccccctggtcccctggccctcctggactccaggtgtaagcggtggtggttatgattttgggttacgcatggagacttctacagtggctgaccaagcctcgcatcagcaccgttctctacagaccccagaggactatgcaagttgactgctacctctaaatgtctctcaagcaaccagtattgagacccattcttgctcaatggagggctcacagatgctg

SEQ ID NO: 536245 - DNA, 912 bp, Homo sapiens
gactgagccggcggctgcggtcggcacccggcagctcttgcagcggtgtgttctacgtcagtggcttcaaagactccagttggattcattggactgggcaacatggggaatccaatggcacataacatctcatgcacaaactctggcttatccacttagttatttatgatgtgtccctgatgcctgcaaagagttgcaagatgcaggtgatcaggtagtactctttccccagcagatgttgctgaaaaagctgaccacgaatgattacaatgctgcccagccaggtatcaatgcgatagagagcttattccggagcaaatgggattctaaacaacagtgatgaagggctcaattattgagtagattccgaagcatctattgtatcctgcagttctcaaaagaattgggcaaagaagttgagaaagtgtgagcagttttcatgggatgcccctgttgtctggtggtgtaggagctgcgacgatctgagaacctcacgtttactggtgggaggagttggcactatgaatatgctgttgcccaagagttgctgcggtgcatgggctccaccgtggtgtctgtggaagctgttgatgactgggcagcgctgggaacatctgcgacaacatgctgttagctatgagtatgaagtggagtgctgagctatgaatcttggggatcagttaggcttggccaggactatggttaaaatctaatattgagctccgaggggcggcacgtgacctattaagcctgtcccgacgaggagggtccccggaaaaaacggcggtttcggcaccctgggccgttggtcttgcacactctcccaagccccctggggtggccccaccaaagtaaggccacaaaccgagcaaaaacatcttcccgaacacccccacaaatcggggctcaccc

SEQ ID NO: 536246 - DNA, 273 bp, Homo sapiens
ggctgtcgggttattttctcctaatctgtttgacctttccttgactgctgatctagatgcttggatccaacttactttcttacaccctcttgtgcgtatacctatcatgtatatataagctccacacttggaatcactgcatatagttatgtgtactactacctacagaggcctgaaggctactatagaaaatcacatagctgtgtagtttgccaacgccaggagtttaaccctcagtctcactgaattattccttttcttggtcttatcgag

SEQ ID NO: 536247 - DNA, 399 bp, Homo sapiens
acttgtactcatcgcgcagatcttcacattgtcctttttgcttttagctaattgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaattttcgtatttttaatagagacggggtttcaccatattagccaggatggtctcgatctcctgacctcatgattcgcccaccttggcctcccaaagtgtagggattataggcttgagccaccgcacccagccgcaatgagtacagattaggggatcct

SEQ ID NO: 536248 - DNA, 333 bp, Homo sapiens
tttggctgatcatcagagtcagcttatgagctcttaaaaacaaaaataggctgggtgcagtggctcatgcttgtaatcccagcattctgggaggctgaggtgggcggattgcttgagctgagaagttcaagaccaggctgggcaacatggcaaaaccctgtcccaacaggaaatacaaaaattagttagtcatggtggtgtgccacctgtagtcccagctacttgggaggctgaggtgggaggattgcttgagctcagggacgtagaggctgcggtgagctttgattgagccactgcactccagcctgggtgacacagcgagaccctgtctca

SEQ ID NO: 536249 - DNA, 227 bp, Homo sapiens
gtccgggccacacagacacagaacgcaagagagagactgacccacccacgcaccggtccccatagacgcagagaccgaggcagaaatgacgggattgccgcagaccggccaggagcagggacagacagcggctccgcagactctggtgggactgggctgaggccactctcgtgttctcaccacaccctctctcaactataactacctaataaaacttaattgttcta

SEQ ID NO: 536250 - DNA, 350 bp, Homo sapiens
gcacgagaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggaccccaattccccttatagggagtcttataacaattcactgcccgtcttttaacaacgtcgtaactgaaaaaaccctggcttaccccaatttaatccctttgaaaaacatccccttttccccagttggctaaataccaaaaagccccccaccaatcccctttccaaacatttgcccaccctaaatggcaaatggaaaattgaaaccttaaatattttgtaaaaatccccgtaaaatttt

SEQ ID NO: 536251 - DNA, 178 bp, Homo sapiens
ccggtccacagttgctattagaactgttattggtgtatgtggcaaggccactggctctgttactggtgctggtgatgagagtgttgtggcttgggcaggtggaggcggtggaggcggagatgagggcggtgagtctacagttgttgattctgctatcactgctggtaatggtgctgca

SEQ ID NO: 536252 - DNA, 117 bp, Homo sapiens
cacgagggggaaaggaaaagactcacatcaacattgtcgtcattggacaggtacattcgggcaagtccaccactacatggccatctgcatctatatatgcggtggcatccactcaag

SEQ ID NO: 536253 - DNA, 992 bp, Homo sapiens
agcaagccagaagtgccagttagaggtacagcagccttttaccatcatctcccagactgccagtggtgtgcaatgcagacctctactcacaacgcaaagtagaggaaatggacagtggatgcacttctatgcatgcgactcaaacggctctatacatgaagcataatagtctctagaacaatgtgcgcgtatctagtagtgtggccactgcatttatccaagcaccacagagaggaccatgctttcccctttgtcccaccctttgctagccctgtgttctagtcatgtaagtttcacactaacgtagctcacctttcgagtagtaaactcacaggtcagacgtacttttgcggaatcgcagcaaccatgccacaatatccaggcaacaggcgtgtcgcaacggaccatactacctttcacacatggtctgacattagcgagctgcagctcacgtaaagacaacacaaacagtcacacacaccctcttcatatacttatggtagtcgggcataattacggtatcgtctccaaggcggatactacatactgctactacgtctcacctgttactatcaggcacactcaatctacacgacagtcatacgtcaaatcatgcaactatacttccccaacacaagccgaactaccacgatcacacattgctctgtgagaaacatctccgtttaccaaccacgacactctctgtgcatctctgatcaatcccctcttgctctgcaccgtcgatgatcgctcatttaacatgtagcctcgtaggaacatgatataatcattagtactaactccagattatctctctattggtcccccgcgtgtaacacacaacagttcgagacgcattccaaacattcttcccgtgaggacaacagccaagacgtccttagtgtgtcgccgccataacaggcagtttacaggataaattaaaaaataaatcacggagtagtgtatatgaggcttgaggtccattattgacc

SEQ ID NO: 536254 - DNA, 219 bp, Homo sapiens
ctctttctgaacttcctagagccatcatttactgtattctctttctctttcctctttagtatcattaccagtgcttttcttcaccagtctttggtcattgctgtagttgtattattgttgctaactacaggattaaagaatctcttcatgtccatttgatctagtcgattctgaacatttaagaattgatagtaatctaattggtctggaaacattgcg

SEQ ID NO: 536255 - DNA, 136 bp, Homo sapiens
atcagtctgtggctgttatgaatctgctgcagtgaatattggtgtacaagtcgtatgtgtagacatccaccctcatttacttatgaggttaagatgtcaactacttttttcacaaaaaaaacctgatattacattt

SEQ ID NO: 536256 - DNA, 311 bp, Homo sapiens
  misc_feature (2)..(2): n is a, c, g, or t
  misc_feature (22)..(22): n is a, c, g, or t
  misc_feature (253)..(253): n is a, c, g, or t
tnacctttacctcctctttggnatttcttctcaattctaggcttgaagttacaactccctgctggataacatcacatgacccaacagacccaacacactttttcctcctgttgtgtctccaggtgacagcagcatcactctaccggctacatggacaaaaaaaccaccatgtcatcttcagagtttgcctttaagctgcacacagtggtacatgcctgtagttccagctacttgggaggccaaagcaggaggntcccttgagtccaggagtttgagtccagcctgggcaacatagcaagagcctatgtcgt

SEQ ID NO: 536257 - DNA, 1223 bp, Homo sapiens
tgacgcgcggctatgcaaaactggcgagaccggaaccgtggaaagagtcattgatggggaggcgcatgccacaaaggcggggacataactgcacaagcgtgggacgtaggggccgcatgagcggtggaaacgcggcggctgatgggccgccctggtccgccgagagtggggtatagggtgatggtgttaatagcggggggaaggggggggttctcaccctcctggtgcacaaagtttgttcttttggagcaccaatgtggctttagcccctggggggtagtggacaccgctgtgtgcgagacctcgggtagtgcccgtgcacgtggtcaaaaaggctcgggaagaaaggctgaacacattgtgggttagggtacagtgccccgcgtgggcccccgcaccagggaacagtcccccggaagaaacccgggtcaaggtggttgccctttcctgcccctggattcccttaaggttttttgaaattaagggtttcttcgtgaacaatcctgttttccgataagcctcgtgttaaaaatagtgttaaaaaggtttcttggaggcttccaaaaaatagcggtttcttcccacaccttggataatgttaagtaaaacctgaggagacacttgaacatcacctgaacacgggcacggcattaaagaaggttgcttaacacatgtgggtaagcacgctctgggtttgagtttcaaaagttgggtaaccactggtggacactctggaacacgccaccaatattagcccactataccacggcgtgttttgggttgaaaattgcacacttttctaacctctgtgataatgaagaatgttaccaagaactctttcctcttctgggtttgttatattcactgagaccacgaggggggtatctaataagggttggtttaataactgcacaataataagaaggagtcaagaaagccactttgaatttggtataggtgttgtcacagaaagggagaaatgaatggcacagacgaaactgctggaaagaaggtcacgaagatagccactggctataaaagcacattatatcctcactgtttatccccaaactaattcttggacttttccacactcacttagctttgttttggcccttgtttccctctgaaggtttaagttcaaccatattctgtcaactgttcagtttcagtggaattttgtatttttggttcattataaccaattgttcgcttaaatccca

SEQ ID NO: 536258 - DNA, 283 bp, Homo sapiens
ttttttcaaatccccccggccctttttcctttttcataaaactgtccttttttttgggggtccctaatcccagcgggtttgtttttaaaaagttgccaaacccgttgagcccctaacatgttgtggggctttttgcaagtccctcccccccttgggcccccccccttttttttttttttaaatagggatacccgttatacattcccccccccccccccccggggtttttttggggtccaattaaatttttttacgtgggaatcccgttttattttttaaggga

SEQ ID NO: 536259 - DNA, 303 bp, Homo sapiens
ggaaaggtttgttaagcatcttttaagtgccatgatgagcatacaagccggccgtggtggctcacgcctgtaagcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcgg

SEQ ID NO: 536260 - DNA, 575 bp, Homo sapiens
gttcaatggctgcagaacagttaattgcgactccgttttttactactagacgaagatcaggacagcggctgtggattaatccccggttaaccattaaaacctgatgcattacactgagctgcatacgtgaaagtttaccttttgcctgctagaacatattcctaatacatacacactttctctgaacatacacatctgtgtaaggcacagggtttgggacagaaaagcaaagacttggggaagaacaatgagagcgcatattaaaacatctctacaaaaaagggccgcaggaatcactgacgttctctatgtgcatgctttcgcaaacggggaaagtcaggagacgcattgtcgggatctagctatttaccctacctaatcaggatttgtaccgggcaaagatgaaacgttaggtgtatggcatgaatacagttctaccagctttatttatccaggcatgactctattatagatgtgatgtacatacaatggtcctgaagaatgttgactgtgacggtgaatgcatgattgtgtatagagaaactgcttagctgcggatgaaacaccgtccctcg

SEQ ID NO: 536261 - DNA, 110 bp, Homo sapiens
aagccgagtggtggattacaagggaaatcatcttgtacacatactttatataacaactaaggaaaacagaggccccaaaatgaaagatttctagcagaaccattacagct

SEQ ID NO: 536262 - DNA, 233 bp, Homo sapiens
  misc_feature (37)..(37): n is a, c, g, or t
  misc_feature (123)..(123): n is a, c, g, or t
  misc_feature (133)..(133): n is a, c, g, or t
  misc_feature (141)..(141): n is a, c, g, or t
  misc_feature (152)..(153): n is a, c, g, or t
  misc_feature (155)..(155): n is a, c, g, or t
  misc_feature (161)..(161): n is a, c, g, or t
  misc_feature (170)..(170): n is a, c, g, or t
  misc_feature (198)..(198): n is a, c, g, or t
  misc_feature (205)..(205): n is a, c, g, or t
  misc_feature (213)..(213): n is a, c, g, or t
  misc_feature (226)..(226): n is a, c, g, or t
atttaaattctgacgtttctgacgtaatttaaatgcncgttctgaaccaattttctcctatcttctctaggggtttcgaaagcgcagttaattgatttccgggaagtactcatagcgagttcntaaaagttcntgagaccnaaatttcttcnngnaaaaanaaaagatcntaagtcatacgttttaattgtgtagagnttgttcnacggaagnaataaatgtcgantaaacgg

SEQ ID NO: 536263 - DNA, 163 bp, Homo sapiens
tgggacaatcggagacttctcttacaagccttcccttactcttctcaaatatagctagtacacattacatgcatccttcccaccttaccttataatgccccttaccacagggtaagccttccctggatggccccactgctggtctatggtctagcctttacac

SEQ ID NO: 536264 - DNA, 390 bp, Homo sapiens
  misc_feature (26)..(26): n is a, c, g, or t
  misc_feature (39)..(39): n is a, c, g, or t
  misc_feature (62)..(62): n is a, c, g, or t
tcgcctaattttgagtatgtgtcccntttttagattccnacagataaccttagggccccaanaaggcattttgggtgattgaaaataatagcagtttgtaccttacgggaacctctaaagatgatgatgattattattattatcatgactgattttattgaatctatgaggcttatgaggtcttaagttcaggatcagcctggccagcatggtgaagccctgtctctactaagaacgcaaaaattggctgggcatggtggtgggcccctgtggtcccggctgctcaggaggctgaggcgggagaatcgcttgatcctgggaggtggaggttgcagtgagctgagattgcaccagcctgggtaatggcctgggcaacagacaaaaaaacgg

SEQ ID NO: 536265 - DNA, 218 bp, Homo sapiens
aaaaaaacggggggggtttttttctggttttggccaaaaaccatttggggaaaggatgggggggggaaaccaggaaaaggggttttttgggacccttttttgggccgtttacccggtgccctttttccccaaggggggggaacccgctgggaaacgatgcttcaaaaaaaaaagggggtttaaaaaaagggtcaaaatttaacttttttttccttcca

SEQ ID NO: 536266 - DNA, 851 bp, Homo sapiens
gagcggaacggagcaagagtgggaggcagcgcgtcgggtccgccgcgcacggacgcaagatggagacaggcgaccatagctctctgggacagactccatcaacgtatggagcaacagggcatgagtctagcaggcccggcaaggcgtggtggctgccgtcccgctggacggcccggagcgaggcagcgaggcccgttctaggaaggggccagagaatcgtacgccaatgtgacgcaagagtcattcaatgaggtgtgcctggttgaaggccgatgaccagtcggcgcaccagcacgcagcagttcaccgaagccgtgcaagatttggcggcttcatgcggcagcgggcgctggccagtcagtgtgccgcgtctactggtgggctcctaatctactattgagcgtgggcggaggagcacgcatgcctgcccagtggcctttgcgcccctctttttgggccccacgatacagagtagcattcgagcaattgttccttggtgatctaccggttctatcgcatttgaagccagcaatcgggcttttgccttcagtggaagtatgaaggtccccccgtagatgccttgtcgactaggcttgggcctttggaaatgccaagatagaaaactccgggtggaattggcttgcgcggagtgagccgagcgtaaatcaatactaaggggttggggcgctaagtaaccccgatgtcacaacgattaaggggggccagtggccccgaggggctcaattcaatgaggtacccaaggtttggggcttgggaggggaagtgccaacgggtggtcttttccaaacgccggtcattcttacagttgggccctccttgttggccaccca

SEQ ID NO: 536267 - DNA, 192 bp, Homo sapiens
ccacaggcatatcacaagtctagtcagaaagaaatacatagaaaaacatgatagaatataaaaataattagcaaagagaagttctcaatgcttcagtactaaaatatagtatccttattagaataataaaggactaggaataacagattgtgtttcctgcaatgctgtagttactgcaaatttatcaggtgt

SEQ ID NO: 536268 - DNA, 138 bp, Homo sapiens
aatgtacggaggcgttcatggccaggtggatcatggatggatggatggatgacaggtggatgcagcggttgatgcatggatcgatggattggattggattggattggattggattggattggatcaggttggatgcat

SEQ ID NO: 536269 - DNA, 189 bp, Homo sapiens
tcattttctacactagagacagattccaccatgttggccggcctgttctcggactcctgactcaggtgatccgcctgctttggcctcccaaagtgctgggattacaggtgtaagtcatcgcactcagccgatttaggcttttgaaaaagcaatacttgatgatttcttttagtgttagtttgccagttg

SEQ ID NO: 536270 - DNA, 533 bp, Homo sapiens
ggagagagagaactagtctcgagtggggtctttcttgatttagggcagcattcgggttgagttaaatgatggggaatggggccaaaccaaacaccagacctctgcccatccccttggccttgtggcccagtggtttccaagaggccgaaaaggcggcccagaagggagctagtggggttcactccccaagtgaaggcagaccagtggtcccgtgtagacttgtggtgcaaaaatactaaagtgctaatttgggcatcagagggcccagctctgagaaagagaaggggcaatcctcgtgtgacagcacagcccaggggacacaggaacaggtacggaatacagaggccccgtggccaaggagacaaagggggatcgtgtagagcaaacgaacgacaggacacaaaaacccactaacgccccattaaacaatagtggaagacaccacaggcaacaaaggcgcaaaagattacatgaaaaaatccctcttagggcgataaaggagcaaaacactccaccaacaatgggaagataac

SEQ ID NO: 536271 - DNA, 213 bp, Homo sapiens
agttcgactggagtactctcttccggtcataggccagaccgagggcggccatgcaatcagatgaagaatgtggtgaagttgatgtgccagcggtactcactggcagagtagtcataggcgaaaggagatgggtggtagttgctggaactccctcagaccacagactccaaagtgaaaccagtggatattctccacgggggctacatggttctt

SEQ ID NO: 536272 - DNA, 271 bp, Homo sapiens
tgtaacctccgcctcctgatttcaagtgatttttcctgcctctgcctcctgagtagctgcgattacaggcacacgctaccacacctggctagtttttgtatttttagtagagatggagtttcaccatgttggccaggctggtcttgaactcctgacctcaagtgatccacccaccttggactcccaaagtgctgggattacaggcgcgagccactgtgcccggttggaatcatttttaatatagtttggctagtggaaagggcaccgccaa

SEQ ID NO: 536273 - DNA, 324 bp, Homo sapiens
tgtgccgtggtcccacgaacctaatcctgcatttctctaagagcaatggttcagtattcactaattcagtaatcagcaatgtatagaacataactactgtaaataacaagaactgactctgtttaaatttcctttctattcaagtcttagattcagggtttaagtacttttattcctgatgaatctctggtgttaagattacaactaaacatttacaaagttctggtaataatttcttccagtccttctcagatactatggttctgtgttttatgtactaatactgtgttccaaaaggaatcatagtgaaggctgatcacccag

SEQ ID NO: 536274 - DNA, 217 bp, Homo sapiens
cccatcccaatcaggaagcctgtcagcacgccactagaaccatcttcagccagctacggggcagacatcacaagtaagagaagctacaactctagtgtctgctagaggagaccacactaaagattgtcctcaaggagctcccgtcatggcacagtggttaatgaatctcactaggaaccatgaggttgcgggttcggtcccgtgcttatggatgtct

SEQ ID NO: 536275 - DNA, 708 bp, Homo sapiens
  misc_feature (361)..(362): n is a, c, g, or t
  misc_feature (367)..(367): n is a, c, g, or t
gtttccaaaatatgttactgttggtcctgtaaggttacaaagagatctgaagaactttctttttatacattagagcattttccgccgtggaatgagtatagagttaaaaagataacatttattaattaataaaggcaatttaaaatttagtgttagttggagagactgtcaaccatctgaaggtatgaaactgtgtacagtgaaataatttctcctttctccttccttttagttattcccacagaaaactcagcccagtgggaattggtcatattatgcccatgttttaagacaatattcatagtttggatcttagtgacactgtttaaagacaagcagtgttgtttcgctcccccttggnnaatgntaagaacaaaaatatttttttaatgatgtggaagtatatatttcatgttcattatgataaatctacaaaccaaatgaatgttcttatgggtggagttcttctataagagtatattaaatgctttcagagttgtattaatttggtttctagatgatataccacttatttggagtgacttaactcagtatgtaagtagatgagatttgttgattttgcccctaaaacgggcttgagtcattttaggagtgagttgcacaaaaggacctaaaatgctttgttttgtggctttcttttaaggagaatggggtctcgctctattggccaggggtggagtgccatgt

SEQ ID NO: 536276 - DNA, 144 bp, Homo sapiens
ctgaacccgggaggcagaggttgctgtgagccaagatccaccattgcactccagcctgggcaacaagagcaaaaacttcgtctcaaaaaaaataaataaatgtatccaagccaatgtacataggttatatgcattttatatcag

SEQ ID NO: 536277 - DNA, 467 bp, Homo sapiens
gggctgtagaactcagcgaggactcaggagtcatgaagggcggcacatttgcccagaagttccattgatcatgttgcactgatcggaatggcagaagtcaaacttggtcaggccggtccaattgttcacgaagtggattctggtgatgttctggaaccccgtgaacaacgtgaagaggccagaatcggagttgttgagctcaggaaataattcgaaattgtccttgaaggggaacatgcctggaaagtacttgttgatgagattcacaagggggtccttgtagccccacatgatctcacccacagtgcggttcatgaaggcacgttcgccgagggtggtgaatgccaaggtcatgatgagcttcagggtcatgggcttattctccatcatcaccgccgcacccaagaccaggatgttgtgcatgacgatgtagtcgctctccgagacgcgtgacttgtagggctgga

SEQ ID NO: 536278 - DNA, 1291 bp, Homo sapiens
gaagtctgagtcctgtcctttctctctccccgtgacgagcatgagcttcaatcaatcgctccagcttctccacgcaactaccggatccctggcgctcttgtccaagggcgcgcagactacgagtgccctggacctggtcatgcacgtcgctggccaaagcgtctattgcaaggcgcttggggagctctggttccctggaattctccagtagtccctgcctctcagccatgactgtccactggggccgtgcagtgtgggtctcggggggctctggccgtccgcggtagtatgactccgggcggttctaggactacgtgcacatttggggaggagccattccagagaaccgaggaacggacgatcctatgtggaactaagtccttgatagcttgagccagcactggccttctatagacttggatcacgagaagtagacgtgaagtcctgggagaaccgttgtaaaacctgggaagagcttggaggacggcaacacataggtccctggcggaaggcacaggcatttgagacgccaagggacaggagggaaccccgccaaggcgatacagctacgtactctggagcaaggcccattggtaccctattcaaacgcgaatccaattgcgaattgggaaccccttgcaatgggggctttcaacgagtccttgccggcccacgctagtaaacctgatggcgtaacaaaattgtcccccggcgaatacaggtactacatagcatcgtgacgttgtgggccccagcattagtacgcgccgggtaccttctgtgatttgcgttcgaagtaggagcgatgaaaggcacggctccgaacagtcattgccagaacccgtggaagcgcgtcggggcccaacttgccaggcccaagatcgtgaggggcggcaagcgaagactggaacgaaatacaccacttggcgagcttcccacgcgagaaagggttgcgagctcgcgcagaatgggaacgacccgagatttagtccaacagacgcggaaagttaggcaacagccttggggaaggacccgcgaacagaagtccggcagggagttcctttcacacacggtgcaggtgtacgcccatggctgactttgccaatttggagaaggaaacagggaggtcccaagtgaaacaggacggggaattgttcacaacaggtggaccgtaccaagagcgccggcatgtcaattgtgcccaaggttccatgggggtgttgaccccccgagcgggacaagtgtatagacgttgacccccacctaaacgattcttacaacgggaacgctg

SEQ ID NO: 536279 - DNA, 187 bp, Homo sapiens
aaccatgcgaacggactgatcagtatgtattaagctctgtaggattagaacttaacttgtagattctgtttagaacaataggcaaataggctgggcacggtggctcatgtctgtaatcctagcactttgggaggccgaggcaggtggatcacaaggtaggagttcgagatcagtccgttcgcatgtt

SEQ ID NO: 536280 - DNA, 139 bp, Homo sapiens
catctatgctcccgacaggccctggataaagttgtctctacctcagctggcgcgttcctcgtttgctgttgtctacatactccttcaggtccaccgtcctgatgccgactacaggtcctgtcccatacaacctacagtt

SEQ ID NO: 536281 - DNA, 412 bp, Homo sapiens
gaaagtgtagttgtgtaagaaccgggcttcccaaaaacttaattcctagtaattaaagggtttgccttttgggctgtccaaaaaagaagaatgataattagatcctgggtgaaagcttcccaacaaggaaaggctcatatttggggtaagaagggttaattgttcccagagtccaacctagaggaaattgtgagacttcagtacccaataacattgcttgtataatggtgctggccacgttgttttaatcagttgcctttttttaaaagacattttttatgtaaagcaaattgaactgtcatcagaaatgaagttacattgttgggaccatttctttaaagatttcacagaagttacctttggcatttgacaggacatacaccctaggtaacaaacagcacataccaatttc

SEQ ID NO: 536282 - DNA, 219 bp, Homo sapiens
  misc_feature (116)..(116): n is a, c, g, or t
  misc_feature (130)..(130): n is a, c, g, or t
gctgaaatgccagtttagagctgcctgggggatcagtgggggatgaggagcgatgtccatcagactgggtggctggggggctacatgacagttgcctcagggcataggctctgctnaagggattttgtgngttctgctttgatctggggatcactcagtgcaacatgtggtgggggtgggggccagcctcatcctcctggattcatcctcctttccctt

SEQ ID NO: 536283 - DNA, 1150 bp, Homo sapiens
agattacccagcaacttggcgtcttcccagagagcgtccgtggaggaactggggcaagcagggggaaggtgaatgtagccaagcttaggtacatgagtccgcgattgacttcagagtgctgactgcggttgaaatgggcatgaataaaccatgagagtggttccctgcggtctgattgcttcgtatagccagcctgaaacatggtggctgtaataagattctaagagaattggtgaagcgataaagcgttatagcgtgggaacgtactaaaactgtgctagggcgtatcggttgacaaatgcgtggctatgattacctagctctgaagaacgctgtcttctagacaggtagttgaagtctgttggaaaccagatgggtgtgggcaaagagtcagacatttacattgttgccaagtgaagccgggcagcagctcggactgaagctccacagactgggaagaacttcctttcgaaatctgaaaaacaagcgcgattaccacaagcacaggcacaaggttgcttggctttacttatctcggctctcggccatgaaggaattggcctatatgaaggcattatatgagaggaaattgccagttccaaaagccaagtgatgataatcgccatgcagtgatcatggagcttattaatggttatcccctaatgtcagatacatcatgtcgaagaccctgcatcagtatatgatgacgctattgggactggatagtcaacctgagaaaccatgggactggttcatggagatttccatgaattcagtctcatggttggacacagatgacacatacccagtaatgaataacggagaagtggtatccagatcccaccaaaaggcgagagcggacattggacagagacatgttaacggcatcagaaacgagctcacagggaacgcgtgaacaatgacaggagagaatacacaaccgtagggaacaagaaaagaggaaaccaacaagagaggcaacacacacgagaatcacagcacaagacagcaagtcacaggcagaaaaacaagccactgaagacaggaaaaagacacaacagacacacagaagcaagacaaaacacagggcgcaatcgagaagcacaactaaagagatgtagagaacaagaagcagcatccgacaaaccag

SEQ ID NO: 536284 - DNA, 519 bp, Homo sapiens
tgagaagcgcaatatggaccaagtttgcgatttccgcgttgtttggagttggggaagaaaagcgagttgataatcccgcacggaagaaagtacctgggctatgtctagccacgggaagcccagcgttttcatccctgaatgagaactttcaataatgtggtaaacgaactgaaaatacagggttttccgtccccgagaagtgatggacgagttaagagcctctccgtggattgacacagaccaaagcaatactacaaggaagaaatccacttaatatgctaaaatcagtactaccttatctcttattaaatgagatactacaaatgccagattggaagcattacatatttccagatgggttcagagagtcagtactgtttatgggtcgagactaataaaaccagatgaaacaagtaactacttgtttaccttcggatccacttcgttattgcaacatctacatctcgaggaatctgacacaccccaacggacctagacagcattctaacaactaagaga

SEQ ID NO: 536285 - DNA, 155 bp, Homo sapiens
acaagagtagtacaatcttcccatacacaagaataattaatacagatcttaggagaatcttgaaaagcccagaggatccaaagagcccttcgatgcacgcacgcaaggaagatccatcgcagatgtcctaatagaagaacccacgtgaacaaact

SEQ ID NO: 536286 - DNA, 194 bp, Homo sapiens
  misc_feature (12)..(12): n is a, c, g, or t
ctaaatggctgnacctaaatggctgtacctaaattgctgtgcctgtgaagcttcaggcggtttggatgagaatggctgtcactacgagggctatgttgctgattagaagaagattccactgagcgctattagggtctcgtgttgtgcgcaaggcgaatggagcttgtaataataattgcttcaaagggatagta

SEQ ID NO: 536287 - DNA, 148 bp, Homo sapiens
gctgtgattgagcagtatctgggcattgagatctgagtcgcgctcgggtgcactgtgtgcctttgagatagagataatatggacagctgtgtgttctccaatgctggagaatgggggctttcccttatgagaaaggtctcattgagtg

SEQ ID NO: 536288 - DNA, 273 bp, Homo sapiens
ctagaggatccccgaacaacccggatgatcatcaactcgtcatttaacattaagtatatctcctaatgctatccctccccactcccccctcaccacaacaggccccaatgtgtgatgttccccttcctgtgtccatgtgttctcattgttcagttcccacctatgagtgagaacatacggtgttcggttttttgtccttgcaatagtttgctgagaatgatggtttccagtaaataggcatggagttgcatggcggtgacagagccaggcgca

SEQ ID NO: 536289 - DNA, 879 bp, Homo sapiens
  misc_feature (25)..(25): n is a, c, g, or t
  misc_feature (391)..(391): n is a, c, g, or t
  misc_feature (406)..(406): n is a, c, g, or t
  misc_feature (409)..(410): n is a, c, g, or t
  misc_feature (414)..(414): n is a, c, g, or t
  misc_feature (437)..(437): n is a, c, g, or t
ttattgtgtgttaagttttcatctntgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacccgcacgcataggattgaagacagtccaggctgctgtacagagaagcgcctctcacatctgaactgcatactgagcgggcaagtcggctgtaagttcagtaaaaccctctgatgangcaaaaaaaaaaaantannaagntcacaagctgtttgtactcaaanatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttagcgt

SEQ ID NO: 536290 - DNA, 912 bp, Homo sapiens
aaatttgttatactgcccatcccctaaagccaacagagatttgtagatttaaagggatcatcgatgtgaagacaatagtgtttaacgaaagcaagcaagtcccttaccagtcaggtcataacgagggcacatttcatgaccgaaccctctcaaggcagaggaggagtttggtgggtttcatacaccctgacagaattccttgttggctctaaccctcaattacctaatcttatgctttaacacataactgcattggatgtgagagtaacgtaccgtatggtcatcgttctatatattaacattgaacactgctgcgattgctcaaggacattttcatgttacggtcttttaaaagcaaaggcaatgattattagtaaactatttaagctttctggtctttgaaaatgcaagtctcctttgacataatcatgaaacaacagtagtgcctgtggtttagcccaccaatcttgattgacctataagtagctgatgcattgtgcatatgatgcttgatgatggttttttgcatatgcagaaatcgctgcaaggtaatcacggatagatacacgtggtatttggaaacctttgcaacataagtggatgttactgtaccttggttccgcttatcacttaaacgttagtctaatctggaatcaattaaatgttgcgcaattcaactgtctgaccctgactgtgtaccatcacacctggggtaagttctgctatgatgttgctggcatatttgtaatagtcagggtcacaggttaaaggaaagaaacgcttctaacagtaaattattgtgcctaatgcaattgtactgggaattaccttcccgtcaattttggccaactgtttatcccttttaggtttccccctcatttcacggccccacttttttaacccctttacaca

SEQ ID NO: 536291 - DNA, 125 bp, Homo sapiens
cacgaggtttcagaccccatgtgctacatctggcgccagtgcagtgtcatgtttaactacgagattatcctgcatattaacgtgtcttctatagaatatatttcatgttccattcttccgcaatg

SEQ ID NO: 536292 - DNA, 443 bp, Homo sapiens
tacatccccccgctacagaggctcttccagacggaaaacctgggagcgctagatttgctgtttaaaacgatattccccacacgcgtctacattttgagagagctccaaactatgtgaaaaatactgttgcagccccaagagagtccagattcaccctgaagatatgttagtggaccgcactccgcggcaccttccctaatcatctcgaactggttttgaattttgcccctctgccgtgtctcttcgtcagggagaattttaagagagccgaagctttccatcaccgaatcagtttttcctcttaggaaagctccaggaacttcgtgggctccagggacccagccccacatccaattccaggttcccgctggctttggacagacaggaggggcctgtacagaaacaccacactgtttaataaaatcacaatgatttttattaaa

SEQ ID NO: 536293 - DNA, 480 bp, Homo sapiens
cagaaatgaagctattcatctaccaaccacctgatcttcagcagattttgcaccaatacatgatgggcaaaaggctccatagtcaataaattgtgctgggataactggctagtcatatgcagaagactgactctaaaccctttccattcaccatatgcaaagattaattcaagatggattaaaaaacttaaatgtaaggcctaaaacaaaacccaggagaaaatctaggaaataccattctgaatatcaattttggcaaagaatttctgattaagtcctcaaaagcaattacaaccaaaacaaaatttgacaagtaggacctaattaaagaggttttgcccaacaaaggagactgtcaacagattaaacagacaacctaaataatgggagaaaatattcataagctatgcatctaagaaaggtctaatatccagcatctataagaaacttaaataattcaggtactaaaagaagaaaaaa

SEQ ID NO: 536294 - DNA, 1058 bp, Homo sapiens
  misc_feature (1058)..(1058): n is a, c, g, or t
tgagttggaagctagacgacctagagggagggctgctcagtgccgtgcttcagtcatagtgtgaatgtgaattcagagatgcttgcagctgcagggctaggctgggccctgacttgtctgtgtgcagaatcttatcaaatgctgccagtaccaggcgctaggcatgaacagagtgctgtttgctgctgtgggcgtccagaactgccggcacttccctgtgccttaaggggcagtccttgcaccctgcgagtcccacgattcgtcctcgcttcgcaggcaaggagcatagtcgcgtaagggtagaatgccgagagaaatgggcctcacaagccttctcaccatgttttcataggtacactcgtggaacacgagggagcgtgtatgaagagtggagacccctcgtcaggaattcacgtcgcccccctggctcgtctcttcatctgaacccaggggctggagcatcgattggcgtgcccaaggtagagaagcgcaaggtgatgcttccattggaagatgctcgtgtttaccttcagtcccatggcctccaggaagtggacccagggctcgacccctccatggggttggaccgggtgttccttaccgccaacactgatgcacatgtggtctaatcgcggtacaccacgtgttgccaacttgattggttccaccgcccttccatcctttaagtggcttcaagttcatctcacgcgtctgtctccaaaggggcgtccttggttacacattccaaagatggtcaagtctctctatgctaggcatggtgggtgggaagaccggaggggccaatcctaacccaaggttgtcatcgccgtgggcagggagtgggtgtgccgataaggaagtgtcatggacccagggctgcagggaggggaaggcgaacaacacttggcacgcatgcgagaccacgaggacatgcgaagaaggccccaaggccacagcaggaccgaagacccgggcacaacacaaaagaccaggagcgagtaccagaacaccggaaacgcagtcacagtaggagacaagaactgcacaacgccccaccn

SEQ ID NO: 536295 - DNA, 248 bp, Homo sapiens
acaggaaacagcaccttttatagaaaaggtggttggctctcaaaagagcctttgggttttggttcgcacacattcacatgacaatttacgccctctccccaccaatgcggggagcaagctggatgtacctgggcattatatacactcgcttggcgtgcatggcgcataggttggtggactaaaacagactcaccatgaaggcctcgcaggcttactgtaatggcataaccgccgagctctgaaaacac

SEQ ID NO: 536296 - DNA, 231 bp, Homo sapiens
gttgaccacaccagactgggagatcagggaataggcatggccaggctgccaaggagccaaagcagatggactttccaggcagcaaggtgccttgggggccttcttggaggagcattggagtagacagccacggttgagacacccagagcccagacccaatcatgtgctgtgtgcctggacgccttctgtactggtggacgattagccagaatggacttgcagccttctgca

SEQ ID NO: 536297 - DNA, 123 bp, Homo sapiens
cccccatttcatgcggatttttatttgcatctgtattttgctattatagtgttactgaagtataaccaacctgtccagggcttggacaggagcaaggaacaccatgaccccaagaaaggggag

SEQ ID NO: 536298 - DNA, 1697 bp, Homo sapiens
  misc_feature (797)..(797): n is a, c, g, or t
  misc_feature (1288)..(1288): n is a, c, g, or t
ctcattatatatcactcatgggggattgtgctcgtccaatataatggaagaaaagcggttgtatatataatactaaatgtatttgatgaatgacgagaaatctctcgccgcgactgaatatttgtttcatgcccccccccccccgcttgtgttttgaacaccgccctagataatcttttcgcgcccttcttgtgcggcagtctctccccccacccgttgttttttatggagtggcgtacctccccgctccttgtgtctcaaccacggtggggacgcaaacacacagagggtgtgtgtagtagccgcgcggctctcctccccggcggggtgcattcgccaccctctttgatcctctcggcgtgggccacacacaaaaagggggttagttaggctacagacaagatattattactctacaacacgtgtgggggtttgttcccccgctacgtataaatattttaattgggggggaagacacccccctgtttattttgataataaatattgtggcccgtccaccacacacacagacaagaggggtgttttacaacaaacccgtcgtgtctctttctactctaataaacatcctggtgtttagtacacccacccagcctgcgtgaagaaaatttgttggagcatacccctcggccccccccccccttctgtagtataaagaatgaggtgcccccggcggccgtcctaccttgttgtatgagcaccacctcctgcttcctcatctatgtatcttccggcagtataagtaagtgtaccccccccccccatgttgtgggaggagncttcttgttataaagatgtggtatattatgagtaagatgggcgcccacctacaccccagcttgatacctctcttagaccaacataaccccgcaccccacgcggtgctctcttcttaaaatctatttcccccacaacaccccttcggccactcctgtaggagaaaaattgttttttcgcgcttctttggggcgcgcggagcaccccttcttcgcggagagcacagcaggagagtaccctcccacaactcctctctcggcgtagcacacagctgataccacatctgcgcttataatagagaagcttttccaacacacacagcgtccacaacaaggcgcgcactcatatctcttatatatacctccacacatttgtagatccccacacatatatactgtggtagacccacaccggcggcgtacacacacgggtgtataccccttcatcggggaggatatacacacgcgcgcacacacatctcgctcatcatttnctatagaggggtactcacatatatacacacacacacatataggggggttttatacgcagcacctccgcagatgtgttgtgagatctcacagcgagacacttcccgcagcatagtggcgcacaccacgcgctatattataaagggtttgtcgtttgtttctacacacgcagattataaagtctctatcgtggagatttgagggtctaagacccggaggtataatccacaggtctggggttttatatattatattctaaaattctcctcccctgttatcgaaaaggagacacaagagagagaaatataaggcgctatcttctaccacaaagcgcgccctttccccctataaagaaatctatttctcactttgtattataccccccccccccccagaaccccgggtttgtga

SEQ ID NO: 536299 - DNA, 464 bp, Homo sapiens
taaaaaaaaaaaaaaaaaaactcgaggagcatttgaggtcaggagtttgagaccagcctgagcaacatgatgaaaccctgtctctaccaaaaaaaaaaaaaaaaaaaaaaaaaattagccgggtatggtggcacattgcctgtaatcccaactactcaggaggctgaggcaggagaattgcttgaactcgggaggcagaggttggagtgagctgagatcgtgccactgtactccagcctgggtgacagagggagaccctgtctcaaaagagaagtggccatgtgatccagctctggccaatgcaagggatagacacttcttccgtctctttttgccttgaactaggatgtgacagcattcaggctggagatggaaagcaaacacacaagggtggcagactgagaagacaggaggaacctggatgctttttaaaaaaatttatttttgtggagacaggatcttgc

SEQ ID NO: 536300 - DNA, 259 bp, Homo sapiens
ccagccgcacggttcaaacacagaacagcgggtgtgctgtgtgctgaaaaatcaaggtagagtctgcctttcacacccccacaggtgacggtgagatggcatggcggccagacacaaagctccgtcactctacagtgcagtgtggagagtacacaagacccggtttagcatctcgtgcgggaggcacaagctccagaacaaaactcgtgacacgaaggaaacgatgtgttcgccgaaagcctgtcagtgacattggcaa

SEQ ID NO: 536301 - DNA, 305 bp, Homo sapiens
  misc_feature (256)..(256): n is a, c, g, or t
gtctcaggccccacgcaatccttttgcaaagccaagaagtgtgtgtgttttgtgtgtgtgtgtgtgtgtgtgtgtgtgtgtgtgtgtattgtgtgtagcgaggaggattgggggtgggatcccatgacgtgaccggctccgctcctggtgtatataaggggcgcttggcgcatacggaccccaagccgcagctttgaagccctgagcggccgaactcggagctccaacccaactcgggcttaactccgcctcaccngaagcccagtccaagactctgttgctccctagggtttgcaacaagctct

SEQ ID NO: 536302 - DNA, 1517 bp, Homo sapiens
gatttctgctaagacagtagattttaggagctcttgccatatgaacaaaaaaaaaaaaaaaaagggataaagtgacggggctgcaggggctctcattccccattaatccccagcactcttgggaggccaaggccgggcggactcacctggaggtcaggagctgcgagaccaggcggacacccacacgcagacacccccgcgccacaccagaacagccagacaagcacccgcagcacagggtcgtatagcgcagcgaggagtacccccctgggacacgcaccaccaacacacccacgcgagagggatcctggcacacacaaccgaggtgaccacgaacgcctgagacacccatgccagcgacaacagacccggatggcacaaacagccgcacgatgcgacaacaggcgcgcagacaccacacgcagagggaggagcgaaccgcagcgcacgtagggatcacacagggagcagcgccgaggcggaggccgaccgacacggcgcagagaccaaggggggacagacagacgtaagaacgcaacgcagcgaagcaccagacgagagcggcggagagacccgccgagcggcgccacaatggtcgagcaccacgcagaggaaaacaacgcggaccgaagctgaggaacagacacacagagacgggcagcgccgtcgcgcaaacgaagcggggggcgaggcacacgaacagagtgagtgacgcgagaggacgacacaccgaggagagagaagaacgagagaggcagacacaaagccatatgacgcggaggacagaacagacgcacagaggcgagcagaaacgagagagaaacaccatgacgtgagcgcgacacacgaccgagcgtgagagcgcacagcacgaccggacggccagcacgcatctcagcaccgacagccagtagggcgaccgacgagcggtggtcggtcgccaggcgatgacgacgcgccacgtacggacatgggagcgggcccaccagtaggtgctgctcagcaagggccacaaacgcctgcgaacacgaaggtcgagggcagcgtaggcggcgagagaagagcaaccagcggacgagccgcgacggaggccaaacaccgactgaggtagacaagagagggcgcagacagcacagaagagagcacgggcataggtgagcgcgagcgcgcgaaccacaaccgagaggtggagagcgaaagacctagcacgtgagagcgacacagaggaggaagcgacacaagcagagaatcaagacgccgggctgacgcaaacaggagaggcagaccacacagacgagcgtcaggagacggagacagacaaggtagaggggccgccgaggcagatgcgtccagatggagagagcacacaacggacagcacctctcaccacacacgaacaagcaggcagaaaccagagcgagagtgagacgacgacggcgcaggccagagcgaaggaagagagcagacgtgacgacgcaactccgaaacgagagacacacaacgacacgcacaagcaa

SEQ ID NO: 536303 - DNA, 155 bp, Homo sapiens
  misc_feature (99)..(99): n is a, c, g, or t
gatttgctgagttcaaatctgcggggtgggggagtcttccctggcattcagcaacccagaattaaaaaatccctccaagggctgtttgggaccccccanggaacggaccctactttttttccgaacgatttccagctcccagcttgcagcagctc

SEQ ID NO: 536304 - DNA, 146 bp, Homo sapiens
cctccgggtcgcctctagacggactcccctacgacgacccgtgtttgcacgtcacttacacggacgacgaacggacacgacgaacgtacacgccgacgcggcgtccttataacattgtagtacgatacagaggtaggacacggtag

SEQ ID NO: 536305 - DNA, 354 bp, Homo sapiens
  misc_feature (135)..(135): n is a, c, g, or t
aaagctgttgatgggatatgtgaaaccacagatcaagcaagtggtccctgagtttgtgaatgcatctgcagatgctgggggcagcagcgccacgtacatggaccaggccccctccccagctgtgtgcccccaggntccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaaca

SEQ ID NO: 536306 - DNA, 1441 bp, Homo sapiens
ggtctcaccgcgtgagacctggcacagcgggcgaggtctcgtgctgtgtctggacctgcagcccctggtccttccgacactcatggagtagctcatcggtatccaaggtccccgactattgttcgttgtcgccgtccgaccgggtgtggacgctcagcgaatagttgtcgcagatgaatgggacgggatcatgacaagatagtcttaagatgacgttgaaaagataattactccttgatgttgctatggaccacggcgtagggagaactctagtatcatgtcttgccatgaactattattcgggaatacaagcagtagtcccaatctgattatacatgtactcgtcggaagagtgcgacttacttgcagttggatcgtaccgctcggggaagggaatgtattagacccatgctgcaccgacccggacagaaccctcgggcgttgagcgtgcctactttgccgggacgattcggtgtaccacacgcggaataatttcaagttgtttgcaaaactcctgcgcgtgcaccttgagcttggtgtcgtcacttgcaattgcaagggcactttgaaaggtggtccaaaaggctgtgccttgcctaaatatgagcaagttgtggggagctcaaccctgggccaatgccccgtttggggggcacaagtgccactccccttgtgtgcacaaggcctccatcgcgacttaagtgcgctgccgcctttcccttgaaacgtgccttcacgttggatcgcgtacagcaaaccgatttagctacaagcaccccagaaatatttctttcaccgttgtgaaaaggggcaacgggtggacagcctccgtgtacgtgataacagtggtcgtggcgcagtgccagtccatctcccacgatagaacaggcgctaatcagtgcccatgatagggtcatgggtccaatcgtccttgtccaggctgttgttcggacatttccaatatggacctgaatcaattgggatgggtcctagtggaactcctgggtggatacaatggacgttttctccccttccacgcaacaaggaaggggggtggtccccttgaaccaatcacttggttgccctacaccctttccgccaccattgtggggccaagacgaaaacagtagtggcccatttggacttggagggcatcccctttaacaaggtttatgctttagaatccaccaaggaaaccatacattgggtaaggaccgtaatacactgagtaatttacatcgtccgaaaaggagaatacacactaattcaagagaaagattaacaacttggaacccagcggtcacgtttcagagacacgccatgggccgcacgaaagagacatcaccgggtggcagagaaggagaactccaaggttgtcgacaacttggagggatgtaccaggaagtaacaggaggttgttgtattagcacacaaaaaacag

SEQ ID NO: 536307 - DNA, 375 bp, Homo sapiens
cgtatatgctgctctaagaagatctaactttttgacaatcttttgcttctatacggtcaaacatgatctcactggggttccacatttgctcctggtctgtccattaggacagctctgaacgtccccttcccttccagagttgcttttgtttttatttttgccttacccatactcctttcagagagactggtccttagagcagaacataaattccatacaagatagcaatggagccagttgcccagagagctttgaacgggacagttatcacaccctgagtcaagtagaatgctttgggcttctaggaacagaaaacctaacccaagctcctttttatgaggtgaggttttgctcttgttgcgtaggctggagtgc

SEQ ID NO: 536308 - DNA, 514 bp, Homo sapiens
tcacagctacagcacctggctggaattagtttcaatgtagtagtatccgtgtccaccatcttggcaaagcttatattccacaaacagaaatgaatcaaactctagtcttgctttcaagttagcggacatttcccaggcctgacattctctatgcgagacttctttacgttagtgctatatgacagtaagctgtttgtattccttctacatctgtttcttgacctgcgagtctaggcatgataacgtcatatctgtgtcgctgcctggcacagtgcctggcaatattgtgcccttgaatgtctgttgaatgaattattgaacaatgtgagacaaactctggaagaagtttggtccaagagacaaagcgtagtggacagaggttttggagcatctgacctgagcaagatgtagacagaaataaggtgggctcttcatctaggaaggactgagctgccaaacaggttatggtcaagggtcagctggctgcaaggaggagaatgagacccagtagcag

SEQ ID NO: 536309 - DNA, 281 bp, Homo sapiens
  misc_feature (54)..(54): n is a, c, g, or t
  misc_feature (84)..(84): n is a, c, g, or t
  misc_feature (95)..(95): n is a, c, g, or t
  misc_feature (97)..(97): n is a, c, g, or t
  misc_feature (107)..(107): n is a, c, g, or t
  misc_feature (117)..(117): n is a, c, g, or t
  misc_feature (146)..(146): n is a, c, g, or t
  misc_feature (154)..(154): n is a, c, g, or t
  misc_feature (158)..(158): n is a, c, g, or t
  misc_feature (170)..(170): n is a, c, g, or t
  misc_feature (172)..(174): n is a, c, g, or t
  misc_feature (178)..(178): n is a, c, g, or t
  misc_feature (191)..(191): n is a, c, g, or t
  misc_feature (199)..(199): n is a, c, g, or t
  misc_feature (211)..(211): n is a, c, g, or t
  misc_feature (214)..(214): n is a, c, g, or t
  misc_feature (240)..(240): n is a, c, g, or t
agtcttatcatccgagaatacaccatcttttctctggataattatttcttacancatgcttgattcctacattttgttgggtcncaacattggcncncgaatgctgntaatatttantctgtattgataaaaagtctggcttgccnctacaagnaaancccccatttaanannncccnctttagcatagcnctgtcatnttttgtgaaaanggntatgtttatttattacaatactgagncatatataaattttcaataaaagcagaaactttcttacctt

SEQ ID NO: 536310 - DNA, 282 bp, Homo sapiens
  misc_feature (177)..(177): n is a, c, g, or t
acgcggcatgcaccttgatgctgatggtcgtatctagaggtatccccctacagcgcctttgggacaaacatgcaacattgcagaagagcaccaaggcaggttcgcagctcaactccgccaggatgtctgcacgtacagaagcgtgctgcaagtgagatgtcagagatggccatcctngcagatcacgtaaggcgctgctaggttaaggtcgctagtacgttaagggcgctgtaggcttaacggcgcttgtatcgttattgcgcgctgtatggttatgtgcgc

SEQ ID NO: 536311 - DNA, 577 bp, Homo sapiens
  misc_feature (302)..(302): n is a, c, g, or t
ctcaacgctttatacattcctacaacgctatactttctcaacgctttatacttcctcaacgctttatacttcccagacaagccttagccaaaccatttacccaaatgaagtataaagcgtggagctcaacgctttatacttcttcacctccacctcagccagctgctgagcctggctcacctccagctccagctgggcccgggcatagaccagttccagctctcggaccttctggaccctcgggagctcagcctccgggaagaggaaaaatcaatcattctttatttttggacccaggctgnaatgcagatcaggactcactgcagccttgaactcctggctcaaaggatcctcctgcctcagcctcctgggtagctgggaccacaggtgtgtgccaccatgcctagctaattttaaattttttgggtagaaacggggtctcgctaagtggcccaggctggtcttaaactcctgagctcaaagtgtttactcccgcctgggcctcctgaagtgtggggattacagacgtgagccaccatgcctgcccaaaaggtctttcatatggtgtatggtaaca

SEQ ID NO: 536312 - DNA, 364 bp, Homo sapiens
gcaatgcagaggtgcaacctcggctcactgcaatctctatatctcgggctcaagcagttatcctgcctcagctgggattacaggcgcccgacaccacgcctgggtaattattgtatcttcagtagagacagggtttcaccatgctgaccaggctcacctcaagtgatcctgccaccctagcctcccaaagtgctgggattactggcatgagccactgtgcccgggctcacgccagtatttataaatatcgggttatatacgtgcaggaaacatgatttcaggttgactgttctcacctttaacctctctatatagcacagggcaatctggccctactgccacatcatctgggctatctgtagct

SEQ ID NO: 536313 - DNA, 200 bp, Homo sapiens
agatgtcgaagcgaggacgtggtgggtcctctggtggcgaattccggatttccttggtcttcggtaggagcctggtaatcaattgtgctgacaacacaaggggccaaaaaccttatatcatctccgtgaaggggatcaaggggcggctgaacagaacttcccgctgctggtgttggatacatgtgatgccacagtcaaga

SEQ ID NO: 536314 - DNA, 242 bp, Homo sapiens
aaaaccccttaaaaaaactttttttaaagggcccttttccccttttttggggaaaaggccccaaaaaattttttttgttggcccaaaaaaaaaaaagggtttaaaggaaggggcccccttgcccttttgggggttttttttccccccgataaacaagggccgggggccaaaaaggttttttttgaaacccttttttccctccttttggcccaaaaaatcctttgggtttccctttccgggga

SEQ ID NO: 536315 - DNA, 460 bp, Homo sapiens
acccttacagcctactagaaggaatgctttacatttggcctgacggcccacatagctgtgagcgcagccgttttccctactggaaccaaaggtcaccttcttgactcctttgctcgtacagatttatgggatctaggcctagattactcgtacgggactggacatggtgacgggtctttgttgaatggacatgagggtacttgcgggctcagagagacgcagcccatctccatacagcattaataaatacctccccgattgtgtttgtgcctaatgctctggaggaaggaagaaacgtggcagatccctgacatctgtcccctttccttctcttattgcctacctcccctttttactttagactttaagaggaacagaaaatcttccgattctctcggatattttattgcaaacactcagtcttttatgattctttaattgttgagaacaaaccaagaac

SEQ ID NO: 536316 - DNA, 291 bp, Homo sapiens
  misc_feature (173)..(173): n is a, c, g, or t
ggggggtttgggcccccccccccccctttgggggggccccttttttttgggcccccccccccgggggttttttccccttttttttaattttttcaaaagcccagccccccggggccccgttggggggttttatttttccttttggtttttgggccccacccaatttttttttnccccccctttccccccggggttttgggttttttgggccctggtttttttccgggggggcccccgggtttttcccccggggttttttgtttttaattaaaaccccccgggcccccctta

SEQ ID NO: 536317 - DNA, 232 bp, Homo sapiens
taaggtattcgaggatttaacgatagccgaaggagcatggtattgagagtaggggaggaggactggtagtgaggagtagggctggaggacgggtcagtgaggagttagggcaggaggacaggtcaggaggagttagggcaggaggacgggtcagtgaggagttagggcaggaggacgggtcagtgaggagttagggctgttgggctagtcggggctgtagggctagtcgggg

SEQ ID NO: 536318 - DNA, 489 bp, Homo sapiens
tggtcctcagctatgacgactaccaggattgggagacttaaagtaaagagaggcataagaaatggtagaagtattattggggaacggataaaggtccatgaaattttcacaactcatgttcctcggccggggctccagctggtccttctgctcagggtcccggcttcccagaacattcggtatctacccaaagtaaacgaagtcattatacaaaaacaatactggcacgtgcatgtttatagcagcacaattcacaatggcaaaagggtggaactaactcaaatgcccaccaaacaatgaatggataaacaaacaataggatactactcagccattaaaaggaaagaatgaccggcattggcagtgacctggatgagatgggaggctataattctaagtgaagtacctcaagaatggaaaaaccaaacagtgtatgtactcacggatatgtgggagccaagctatagctgaggaccatcgttggggtac

SEQ ID NO: 536319 - DNA, 845 bp, Homo sapiens
ttcccgtgggtttctataaacagtttaaggatatgattgggttaaaaaataattggttataaaaattctgttggcaaattaaatggaaaagtatccagagtctcaaaaggcaatgattgtgagataatatggcatgcccggagccctgctcatcaatgaaaaacccatatgtaataatcgaattcatttaacatgaatcttggagtacgtggaccatgtgctgtgcattgtaaccttttgtcgttgtcgtcgttctgcatttttaactccagatatcctaaagctcaatggttggtctctggtttacatccttagagaagccatgagaacagacttgacaagtttaggaaatcataatgtggcagaggtggtgggacgaagaaagtgagctttttccccttgagaaacttctgcatttagtttctatctttccaggcacaacaaatgggtattcttttcatacaacattttcaaatgaacttagaaaagtcttaacatttaggtattttatgcacagaatacatttagatgtgtagggaaagaactcgtacgtggagtttgaggtaccggaaaaatggcgtgatggtctaaacccagtaaaaatgggtggcaaattgttcaaggtcagcatgtctaattggaatctacgatatagggttagattccaatgggttagactatttgctttacaatgacgtgcctgggctataatattcctaaggacaactggggggtggctaaataaggatacaggcctggttaaaaaccagagggggtaatgcgggccactgggtcacggccaattaagggggattatttgggcccattttgctcgggagacacat

SEQ ID NO: 536320 - DNA, 263 bp, Homo sapiens
  misc_feature (46)..(46): n is a, c, g, or t
  misc_feature (136)..(136): n is a, c, g, or t
  misc_feature (187)..(187): n is a, c, g, or t
gagtacagttagagacatcagtatcaaccgatggttagcgtaatanagacacagatggttacatttagaaatactatgatgtgtgcatatacacatgctaatgtatacacatatatttcctttctctgtccgctgngagggcctaaaagcaaagaaatcccagtagcaatgagcaccagatcttggnatcaaataccactctccagtaaaagaaatcttggaaaaaatagctgattctaggaatagcacaggaaatatatacg

SEQ ID NO: 536321 - DNA, 350 bp, Homo sapiens
  misc_feature (128)..(129): n is a, c, g, or t
  misc_feature (134)..(135): n is a, c, g, or t
gactctggcctcttgcctgaagtcttccgcccatggtcaagatggcgccccaatccgcaaagccgtggggctagagacgcaggcgaggggaagcagcttaagggggcggggccaaagctaagtctagnnagganngaagaggaacctcacttccgttgtcaggtggcggcgccgcagccatggagggaggcggcggcggcggcggcggcggctcgggtgctgcgctgggaggcggcggtgagaggctcgcacgcctccagcccgcccggcccccgggagggagagccgagcagccccggctctgggctacggaagaggggcgaatagatcctaccacccggcgaaggtga

SEQ ID NO: 536322 - DNA, 422 bp, Homo sapiens
tttcaagttggcactgagacagcccgtgctctgtggtcccccaggttgccccctaggttgtggcgcatgggctcctcctcccactgccatggcagtggcgacgccggaagtcgacattccaccccgccagggagactggctcccagcgtgtagcatgttgttacagtggacctgcatagcctgaaaggccctcagccggtcaaactcaaactccatctccacattgccactgcagaagctgtggttgctccatcccactattgtcctatgcctgtgtcctatgtgaaacacctgactcttcctaaagtcatccagccccaccacaccatctgccagctggcccagacccccatactgcagtccgcccacggtatgtccgtcataggtggagtcgttgaggtacacggcctcagataaaaaca

SEQ ID NO: 536323 - DNA, 286 bp, Homo sapiens
tgatctcttacggtgaaaagaaagatgatctaaggctcataacactgcagcagaatcattcattattgctttccgtggaggtgtggcgaatcagctaaatactttgacgccgagctggggactacgatgattgatcgtagcggaggtgaaatatgctcgtgatgtctacgtctattcctagtgtatatatatgctgtgcccacacgataaaccctaagtacgccaatttgtatgttcattacctttttcccttggttaaaatatccaaatggttcttttttttttc

SEQ ID NO: 536324 - DNA, 707 bp, Homo sapiens
agcggactcgtgtctcgtctaccaggtccccgtctgccctgcgctcggcgggctggcatccggtccgggggaaagcgtaccattcccttctgcaagtctgaggaggccaagtgtcccgggcggcgcacctcgttgcgtcgagaatcggtgagaaggatgagactacaaggataggcccatgtgagtaatggagtccagaatgaccaacacgagcatgatagataacagatctctacgacaatggaaaaagccaaccacgacaaatgaagatgaggagtccagttgtcttaactaaagtggtgaggcccttggtcctccctttggatgctgttctgaatactgtggtgcctagaggaactcttatgccgttccgcgattagggcagtccccagtacctgtcaggtactagactggggcatttgtaatcacagtaggccgttgggtagaacccagcaggccaaggcatgaaggagtaaaaagcaagtatgcgaatagggacttgggcggaggaagggtgcagaacacgttgtactggaaacagtctagaagggcacaacagcatcttgaagttcattagcttctggcggagacatggtcagtgagctgtatggctccccttcactcatgaccatactttatcgagtctttgcccttatgcccttgaatcccgagtggtttccctaatggttattacggacaactgaacc

SEQ ID NO: 536325 - DNA, 184 bp, Homo sapiens
gggaagatatcagatgtcacaactatagcggcaccgttcagatccagggtgagtcctgatcattctatcagcctccaattttacagaggccctactgtttctacttccactgttgcccaaaagtatcctgataaaactcctgcttgtcatatgagtgagccatagtaaccatattgatcaccac

SEQ ID NO: 536326 - DNA, 206 bp, Homo sapiens
tcctcaggcatcttcactcttcggctccccatgcccttaccctttgcccgcggcactgataggggtcaatggctcccacaggctccttgggcagcttccctctgtgccctttgcagggttcagcacattggagttgaatgcctgcgcttttccaggctaccaccggtgcagctgctgatggatctaccattcttgggtctggaaga

SEQ ID NO: 536327 - DNA, 347 bp, Homo sapiens
ttttctcattctataccctctggatggatttgaaccaaagtcacttacctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctact

SEQ ID NO: 536328 - DNA, 202 bp, Homo sapiens
  misc_feature (6)..(6): n is a, c, g, or t
  misc_feature (18)..(18): n is a, c, g, or t
  misc_feature (38)..(38): n is a, c, g, or t
  misc_feature (61)..(61): n is a, c, g, or t
  misc_feature (163)..(163): n is a, c, g, or t
  misc_feature (173)..(173): n is a, c, g, or t
ctcgtncaaattcggcanagattgaaacagcagaaganctaacataactaactccattttnttttaaggggcctttacctattcctgcacctaggctaggataactttagagcactgacataaaacgcaaaaacaggaatcatgccgtttgcaaaactaactntgggattaanggggaagcatgtaaacagctaactgtttt

SEQ ID NO: 536329 - DNA, 535 bp, Homo sapiens
  misc_feature (1)..(1): n is a, c, g, or t
ncggcagaatcacactcaaaaaaaaaagaagaggaaatggaggtcttgctgggcagggcatctgggttaagtggtcctggttcataaaactttggacagggaaaatagaaagtcctgtttaatggtctgaaataaagctgatgtgttggagctatcacccaggtagcttctagtcatggacaggtcttgttggtagctagttaaggtatctgcaaggtgatgtctctgggtagcagcctctcctcctaaggagtatacagtggtccctcagtatctacaaggatggcttccaggacccccacagataactaaaatcaacagatgctcaagtcctttatgtaaaatggcatggggtttgcttacaacctacacacatcttcccatatactttaggtcatctctggattacctatacctaatacagtgtacttgatgtgtttcctgtggttatcccattttgtttacgacatgaccttgatttgacaaaaggtctgtatgtgtccagtccaggtgcttcttttcccgaatattttca

SEQ ID NO: 536330 - DNA, 382 bp, Homo sapiens
  misc_feature (14)..(14): n is a, c, g, or t
  misc_feature (33)..(33): n is a, c, g, or t
  misc_feature (104)..(104): n is a, c, g, or t
  misc_feature (145)..(145): n is a, c, g, or t
  misc_feature (222)..(222): n is a, c, g, or t
  misc_feature (275)..(275): n is a, c, g, or t
tccgcggcgaaagnctttttcgtccccgccggnaagtcgcgatttcgtcgacccagcgatcgagttcggtcttgcgtcgcgcactgacgacggaccctttcgcnggcgcgcgagttcgatggccgatgcgcgaccgatgccggantggcgcccgttacccagggcgatgcggccggcgagctgtgccggatgggtgcttgcgttcatgatgcgattctccanggtggttgacaatctgtgtcgaagcgatgtctgatgcgcatttgatgcctcgncggcgacaaaaaaatggaacaatgacgcatttagaattcctttttgaggaattaaaatcgctttttcgcgagcatcataagggttccccgtgctgaaccgactcgac

SEQ ID NO: 536331 - DNA, 582 bp, Homo sapiens
ggagagaactagtctcgagttttgattttttttttggaaaaccgtatctgcaaacttgtttcacttttaaaaagtgggccttttcttgatcagaaaatagcttcaaaggcaattttctccctgtgaaggaaacccattctgtgcaaatgatcattctgcaaaattgccctgggctggtccttaccagtctgcctgattgacctgaatgcctgctgagtctgagcggggggccttaggggttggctcatcaaggagcttacaagtgagtggctgggtgtgggtacagagggacccttgcgcacccggcggtgcccttgcacacacccacctaatttgcagggcgagggaagagcaggttgggccaggacaagggaggaagggcagagagggctcacggcccgaccactagaagtgcagccgcgaaacggggacggattgggccccgagccaaagcaagcaaggaccacctccatcaaaggaagacccagggagcccctttgggtgacggccgcctatgaaatcccctactgcctactgaactttaagtgggatctccaacggccaaagtctttgtggcaaccc

SEQ ID NO: 536332 - DNA, 218 bp, Homo sapiens
tcgatacgacttttttttttttctttctttccttctttctttttctttctttctttctttctttctcgctctcgccctctccctccctcgctcgttttctctctctcgctcttgccctctcgctctctccctcgctcgttttctctctctctctctctctctctctgtctctcgctctcgccctctctctctctgtctctctctctctctctctctct

SEQ ID NO: 536333 - DNA, 94 bp, Homo sapiens
agagtctgaccatgacagctgagcagaaggattcagaactgaatgagttaagaaaaaccattgagctgctaaggaaacagaacgcagctgccca

SEQ ID NO: 536334 - DNA, 111 bp, Homo sapiens
gctccaccggaggggttgggatggtgtgttgcttaaaaagaacaaacaggccagggggcagtggctcacaccttgtaatcccagcacttggggaggccgaggggggtggat

SEQ ID NO: 536335 - DNA, 170 bp, Homo sapiens
atagccaggttactggattagcacacactccttttgagtagacacgactctctctctcttcgtgcttgacgttatatcttgatgtgaggttcgctcttctcccggaccccgttaactcggccgtcgggatggatacacaagaagaagcccccgtttttgcagtacagccg

SEQ ID NO: 536336 - DNA, 307 bp, Homo sapiens
ggggttttttttttttcctttaaaagggcttcccataaccggggcccttccatgggggaacccttttttttcccaggcgggaaaaaaaattttccccgggggcttttttaccaaccgcccctgttttctttaccttttttaaaaccctttttttgggttgggccggggggtgggaatttttaaaaaaaaagtttttaggcccttgatcccccattttaggttctgggatttttggggaccttttttgtttttgggcctttttccccttttttaaccattttcccccgccccctttggggccccccca

SEQ ID NO: 536337 - DNA, 331 bp, Homo sapiens
cccataacccctttttgctgttttcccctgatcccactgggtaatttttgggccgtgattcccggttttaaataatttggaagggttccgtttttccccccctttttcctcccctaagaattttaaaatccccttctctgttccgctgttaatgctggggccccaatttagttttataagcctttccccgtttttaagttttgttttggggtttttggcccctgaattttttttttgtttgtcgataaaaaatgtaaaaggggaatgtttataaatttccgttttgttttgtaatgtccagaattttaaaattaaaaaacgggttggttta

SEQ ID NO: 536338 - DNA, 347 bp, Homo sapiens
  misc_feature (238)..(238): n is a, c, g, or t
  misc_feature (241)..(241): n is a, c, g, or t
  misc_feature (246)..(246): n is a, c, g, or t
  misc_feature (251)..(251): n is a, c, g, or t
  misc_feature (281)..(281): n is a, c, g, or t
  misc_feature (287)..(287): n is a, c, g, or t
  misc_feature (290)..(290): n is a, c, g, or t
  misc_feature (302)..(302): n is a, c, g, or t
tatatagtcacgactgctccgatctcagaatcactacaaacgcgattggtggcataattgaatccatttcgatgtcagatcagttgccacattcgagatggtcgtctttgttgcctgcggtgatacaactgtcacatacgacatgtctgaggatacctccgaagccaaagtcaagatcccaacaccaccgtctattgctgccaaagcacagctggctcggcagcagtcccatcgcccntangacantcccnttccccggtcagacacgtgcggcacgaccncatctncgntcagtccgtgtntccagcagcaggatttccacattccatcagtctgtaggctccatt

SEQ ID NO: 536339 - DNA, 1115 bp, Homo sapiens
agtaccccggttctggcgctgctgggtctcggttcgggttcgttgccccgtgtgccgggactgggcggtctctcctggcgcccagccggtgcgcagcagccggaggtgtcgggaccctctggagccaccctagcgggccccgccgtgctggtctggactccgtgtcctgtggctcccaggtcgctgcctgtcctcgccgccccagtggagtcccagtgctgactactcgatgtacttccctggcctgtgcctgctgcctgcgctgcgcgggatgctggcagtgggatcctgtggcctggtacccgtggcgctgcccctggcgcaagccaatctgtactttggtgggatgacttgtcgcgtatttctagctggcgtgttggcgctgcccgggtgtgccgggttgcgggaggtccgtggcacctgggggtgcggtgcccgggcgcctttgagcgctccaggagagacgccctgtggcacgacacttgggcaaaccgagcccatgggccggcaccttggccatacggtcaaggcgccggcgacggcccgggaattgccggaggagtgggcagaacaggcagccggccgacgcaaggggaattacgggaaagcccccccaaaggtgggcaaagaggcggaatcctagggcagcgctagcgcggcacataacgcgtacccctgacgtagccttgccaggacacccaccgctttccgacaacccccaacggggcccccggaggcccctgggataacccctcccagggggggggcgaaaggccgaaccccaacaggggctagcagggcgaggcctaatggggcacggcggcacaacccgttggggcccaccaacggacaacccgcgcaaagtgcaccgcccgccgcgtaaggacctgaggacaaggaacgcccttagcaatgcgcaccaacgcgaaagccggccacgacgagtttgaaaacaaactgtggccccgcggcaatccattcaacaaaagggggcgccaaccaagggtgtctgcgaccaggtgcgccctgtgcaccccacttgctgagagactgtggcgcttcacagtaagagccactcaccttaagcgcacccccctttatttcgacccccgaaa

SEQ ID NO: 536340 - DNA, 374 bp, Homo sapiens
ctcccactcatcgtaccacagctgagaaatacaccagaatgagcatggaagccagtgtgatgctgcacagatgtgttcctgtgatatcatgcccgactactgaccctcgactgggatcactaatggatattcaaatgatccaactccacacatctgccaaaaaagaaaaagtcatcggtgcgagcagtctcgattcaagactccctagctgcagaaaaccaatgttgtcagatgtcacaggttaatatattatatatgccacacaaaacaggaatagtacaggcaatgatcttccaaagaaagtctttacggcatctgtaacttctgggaatttcagggttatcatcttgccagtcagctcccactaaagtact

SEQ ID NO: 536341 - DNA, 325 bp, Homo sapiens
gaaagaataaatttgcattctttataaattacccaatctggccaggagtggtggctcacgcctgtaattccagcactttgggaggtcaaggagggcagaccacctgaggtcaggaattcaggaccagcctggccaacatggtgaaaccctgtctctactaaaaatacaaaaattaaccgggcatggtggtgtgcacctataatcccaggtactcaggaggctgaggcacgagaatcgcttgaaccgggaggtggaggtagcagtaagccaggatcataccactgcactccagcctgagtgacagagtgagactccatctcaaaga

SEQ ID NO: 536342 - DNA, 1405 bp, Homo sapiens
ggtagttcagcgccggcgctggtgttgcgaggcggggcgagagtgaggcaggctacccgaggtgcgggatcgtactgcgggagagctgaggcccgctttatcaccagggttgcttatcaggcatgactgacgatagtgcccggtcgtcgtagtcacggcatggctcctgacaggcctgagagcttgtctcgtgatgtccgttcgtgtggttgtcgataatggaagctggtgccatgaccaccagtggtggtccggagcaagaagcagctgtcgagtggcagaagagcggagctggggagggacgataggcatggcacgggggggcctggatggacagcgagagacagaagtagcccttgatgtgctggggtggagctcgcgattgctgtaggaagcgcagggaactatggttcagggttggggttgcggtgctttgcgaaccgttcggggcctacagagaacatggccttgacataacagatctagccgagttgaacccactggtgagcccggatgggaccccagtaccaggaaggacgcgcgagtcgggctcgcacggtgatagctttcgacgcaagaacccagggctgtgacagccccgcagggtacaacgatccactcccttcacgtccgcgagaccatcccgagcacacaacgtacacgacggcacgaacccgggcacgggctcggccacacaccccaagaacacgatccagggacagacagtccacatccaacttggcctagcaccaaattttacacggcgtggtccctcaaggatttccaaccgaacacgaaactcttacccattggttgccccgacggcacaattcccgcggtggcaacccgcttctcccaatttcacaacaacactggacgacaactcgccacacgaccccttacggcaaagctacaccgacatccaagggatcccccacttggcacaacacacccgcgctggcccgcacggccccattcaagggagcaacgacggcgaacgaacgacgcaggacagcacgacaccacaaacaccaacgagccacgggcgcaacacaaccaaacaccaaacacagcacagcaacgaaaacaaaacacagagacacggcacaccagcggacagacgcaacaagaagacacagacaagcgcacaccaccgcagcgacccaaaaaacagaggaacacacggcgcgagaaccgcgaccggaagccacgccagaccgcgccaggacgcgacgagacagcagcgacaaacaggccagccccagcggacggacggaccacacaagggcgcacaacacaaccgagagaagagcagaacagacgcagagcagcacacagaacgggagcaaccgccccacacacgcacaaccccgacacggcccgacgacgcgcgcgaccacgcacg

SEQ ID NO: 536343 - DNA, 247 bp, Homo sapiens
cttacgggttaaagcgattcgtgctcagcctcctgagtagctggattacaggagcccggcacacagctggctaatttttgtatttttggtagagatgaggtttcaccatgttgaccagacttgtctccaattcctgacctcaggtgattcgcctgcctcgtcctcccaaagtgctgtgattataagcgtgagctaccgcacccagccagattactgaattttgatgtaagaaataagatctttcggt

SEQ ID NO: 536344 - DNA, 110 bp, Homo sapiens
  misc_feature (12)..(12): n is a, c, g, or t
  misc_feature (59)..(59): n is a, c, g, or t
  misc_feature (84)..(84): n is a, c, g, or t
ttctaagtgccnttcgagggctgtgaccggcgcttcgctaacagcagcgatcgcaagangcacatgcacgtgcacacgagcganaagccctatctttgcaagatgtgcga

SEQ ID NO: 536345 - DNA, 287 bp, Homo sapiens
tcgcgacgtgtcatccctacttaaagacagatagcctacggtgtaacagcgtacgtacaagaaagttataaaatgtgtccttggttttactaatgataagatgaaaaacattcaaattctccaattgaacaaggtatgcaaggatttttatgttgttgttttttttttggttaaaccagtgcagcacaaaataacttacgggcaatataaagataagagctgaatgagcatgccactacgggcgaaggggggtcatttcacagcaatcagtatttttccccaatccg

SEQ ID NO: 536346 - DNA, 215 bp, Homo sapiens
atattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaaggcatcctccatggtgctga

SEQ ID NO: 536347 - DNA, 289 bp, Homo sapiens
  misc_feature (47)..(47): n is a, c, g, or t
  misc_feature (263)..(263): n is a, c, g, or t
actctagagtatcccccgctctcatcatcctaatcttacatcacttnacacacttcggtccttaacttgttaacttattttacagcgctgatggctgatctatgtaaaggtttcacggtaccaaaaacacttcctgcctataatacatcaaaacatgttcctgaatgtgtgtgaatatcatcaatgtctctgtcccatcttcttcagggttccgattaagctcctcaaatttgtggatctcacggattaagaacatccccatnacgcctggcgacctttgtgtccgcta

SEQ ID NO: 536348 - DNA, 714 bp, Homo sapiens
ccagcactgaagctcttggtatttattcaaatgaattaaaaacatgcccatagaaaaacctgcacaaagatgtttacaacagctttattcataattgccaaaacttggaaaccaccaagaagtctttcaataggtgaatggataaactattcatctagacaatggagtattattcagtgctaaaaataaatgcactattaagccatgaaatgacatggaggaaccttaattgcgatattattaagtgaaagaagccagtctgaaaaggctacatactatatgattccaatatgacattctagaaaaggaagaactatggcgacagtaaaaagtggttgccaaagaaagatcatgtcctttgcaggaacatggatggggctggaggccattatccttaacaaactaacataggaacaggaaaccaaattttccatgttctcacaagtgggagtgaaataacatggacacaaaggaataacatactggggccacctgagggtggagggtggggaaaaggggacgggaccggaaaagtactatggggtactaggcttagtacctgggtcactaaataatctgtataacaaacccccttgtcacgagtttacctgcacatgtaccccctgacctaatttttttttaaagtggttgcaggggatagggacataatggagattatatacattggctaagcatacatgacacaccgagtga

SEQ ID NO: 536349 - DNA, 416 bp, Homo sapiens
tagcatcttcatctatcagtcatcatcttcatcaagctccatcatatcattcatccatcctcatcgtttctcgtgttcctcatcttctccttcttcgtcctcctcctcttacatccacaccactccacctcggcatctgagtcaggtgcttcctggtcctctcggtcacagctactctccgttgttaaactggggcaggagcttgaagacactctctcggtagtcattcaggttggtaacctcacagttaaagaggtccaggcttttcagacattctaactttttcaaaggttccaaggtgctgatatctttcagtttatttccacttaagtttagatgtgtgagatttggaagtttttcagctaacatgtccagacctccaaagattctattttcactgagttcaagctttttca

SEQ ID NO: 536350 - DNA, 139 bp, Homo sapiens
aaatcgagctcgcccgtttaatatcacacaatactaacccttcccctctctgatgtcttacatacctcccaggagatgaagtgtattcttcactaggttaggcaattgggcaggtccccaagcgtggaacgtgtcctga

SEQ ID NO: 536351 - DNA, 168 bp, Homo sapiens
tgtaatctctcctaagatggaagtcccccaattgtgtttccccatagtggaatccctccaaatggaatcccccaaatggaattccccaaatggaatcgcccatatggaattccccatatggaatcccccatatggaatccctcaagtggaatccctggatgactactt

SEQ ID NO: 536352 - DNA, 741 bp, Homo sapiens
  misc_feature (119)..(119): n is a, c, g, or t
  misc_feature (156)..(156): n is a, c, g, or t
  misc_feature (177)..(177): n is a, c, g, or t
  misc_feature (182)..(182): n is a, c, g, or t
  misc_feature (190)..(190): n is a, c, g, or t
  misc_feature (193)..(193): n is a, c, g, or t
  misc_feature (198)..(198): n is a, c, g, or t
  misc_feature (214)..(214): n is a, c, g, or t
  misc_feature (253)..(253): n is a, c, g, or t
  misc_feature (264)..(264): n is a, c, g, or t
  misc_feature (278)..(278): n is a, c, g, or t
  misc_feature (294)..(294): n is a, c, g, or t
  misc_feature (297)..(297): n is a, c, g, or t
  misc_feature (299)..(299): n is a, c, g, or t
  misc_feature (324)..(324): n is a, c, g, or t
  misc_feature (350)..(350): n is a, c, g, or t
  misc_feature (387)..(387): n is a, c, g, or t
  misc_feature (408)..(408): n is a, c, g, or t
  misc_feature (453)..(453): n is a, c, g, or t
  misc_feature (464)..(464): n is a, c, g, or t
  misc_feature (519)..(519): n is a, c, g, or t
  misc_feature (636)..(636): n is a, c, g, or t
  misc_feature (646)..(646): n is a, c, g, or t
  misc_feature (663)..(663): n is a, c, g, or t
  misc_feature (691)..(691): n is a, c, g, or t
gcctcgtccccttctctctgtctcccttgcctcccccatcacgtcccctgacaccgacaccccattgctcccacagtctccccagtctccactttggtccccagcgctgtctgcccgangatttgcctgaaggctgcccccaactctgcacccgcnccccgagggccaccgaggacnatgantaaaaaanatnctgcnccgatggccccgccancccgaggagaggaggaagaagaggaggaggaggatgaanccgtccccganggccccagccccanccaggagcgccggcanaancntgttgtgcacccctcggcacctgcncccctccctaaggaataagctttcancttctttgataccaatgaaccggcgtgccaggagatnctgtttgaacctcagaacaanatccccgagctgtttgccattgtgcgccagtgggtgccccaagtncagaaaaaganagaagtaatcggaaatgagattctgcgccgaggctgccatgtgaacgatcgtgangggctgaccgaaatgaaactgctccactatgcgtgcaaagatggggcacacggagtcggggaccccgcggcagccgtgcgcctctcgcagcagctgctggcgctgggcgcagatgtnacgctgcgcnccgctgggaccaacatnaacgcgcttcactacgcggcctattttnatgtgcccgacctcgtgcgtgtgctgctgaagggtgcgaggccgcgagtg

SEQ ID NO: 536353 - DNA, 218 bp, Homo sapiens
aactacctctacgagaacacaaaaattagctgtgggtgatgccacatgcctgaagtcccagctacttggcaggctgaggtgcgagggtcgtttgagcaccctgaagcagaggttgccactgagctgtgattgtaccactgcattccagcctggtcgacagaatgagacactgtctcaaaaagaaaaaagaaacataactctgtcatcagacaatgtat

SEQ ID NO: 536354 - DNA, 122 bp, Homo sapiens
ctcaggagcttgcacctagtcactcttctgagattatccctggagaacacggagaacaggatatcttaaatactcaacagagaggctgagcagagcaaatggggggttgacctcatcccgta

SEQ ID NO: 536355 - DNA, 188 bp, Homo sapiens
agggccaaatggtctgaacacagctccgtgaagacctggagctgactgaatgaattattcgggacccataggatggctgcgtcacttctggtgccttcgtgttcgaggccagcacaccaagaccactggccgccgtggccgcaccgttggtgtgtcctagaagaaataagtctgttggccttatcgag

SEQ ID NO: 536356 - DNA, 359 bp, Homo sapiens
agataaacataatttccattaagaaaatcttgaggccaagtattgtggctcactcccgtaatctcagcactttgggaagccgaggtgggaggatcgcttgaggccaggagtgcgacaccagtctgggcagcctagcaagactccgtctctacaaaaaattaaaaaaatgagccaggcacggtggcatgcgtctgtggtcccagctgctttggagactgaggctagaggatcgcttgagcccagaaggtcgaggttgtggtgagcaatggttgtgccactgcactccaaccttggtaacagagtgagccactttgtctccaaaaagaagaaaaaaaaacctgaaagatttaacgcataat

SEQ ID NO: 536357 - DNA, 955 bp, Homo sapiens
gggcggggtgtttttagcagagggggaaggggtgttcagggaaactctacattctcgagtatgaagaaactagacagtcagacctccaggactaagatgaagtgagcctagaggagatcgggtgtgggagtgcttctgtcgttagccgggtgcagtgctgtgtgtatctagttccagctacttgagagggtgaggcatgaggattgcttgagtccacaaagtggcagttgcaatgagtggagatcgcgccactggtctccaccctgggtggcagaggggggcgctgtctcaaaacatagacaaaaacaaaatgcttctgtcaggtaacaatctttattacagggcttgtagtctttctttctcagctggatggtaaggtggcgtggcaaatggaaataaacggtgtttattatccttgtcgttgtcgagaaacgcaaacgaaatgggcctcgaggtgcctaggcgggggcagctcgtggggcgcggtcgccgtttaggtcggggtgaactgcgatgatgcttcgactccctgcctgcggtcgggccgtctgctcttgccggtaggagcgactccgttcagctacttttaaagggcggtgatcccggtatctccccggagcggcgggatacgcactggagagacgtcgtcgatatgacgggcccgccaggggagaaactcgagagcggccgcgcgggtggcgtagttgcgtgaggtagcgcgccgctggcagatgtatcgaatacgctctataaccacaagtccgtggtccccagcgcggtgctggctgcccgaccgactctcacggccgctgtggtgtgcacgggtacgtagaacgtgatgcgaatgcgcgccgacaggtattttcgttgcggacgcagcggattgtgacgccttctctgtcgcgcggctcgcggcgcgcgccatcggatggcggtatgggtcgcccacgccgct

SEQ ID NO: 536358 - DNA, 234 bp, Homo sapiens
acggatgatggatagagggggtctccttctcattactcgccttcattgcgcgctggtgacgaacgactgcttgggacacctgtgtgatctgcctcgtctctggctatgtgtggagtcgtgagcctaacatgcgtgtactggcgccttggtacttactaccctttctacatctccatgcaaagccctaacaagagtacggggaaagtactaattttattattattggaaacagag

SEQ ID NO: 536359 - DNA, 136 bp, Homo sapiens
aaccttcacaggcttcttgatttacccctgccacagccttcccttttcatttacctgaggggagaggctagcctcttaccatagtaggatgctatatgtttagcccaaggacagctatagagactggaactgctgt

SEQ ID NO: 536360 - DNA, 313 bp, Homo sapiens
  misc_feature (54)..(54): n is a, c, g, or t
  misc_feature (64)..(64): n is a, c, g, or t
  misc_feature (132)..(132): n is a, c, g, or t
  misc_feature (192)..(193): n is a, c, g, or t
  misc_feature (205)..(205): n is a, c, g, or t
  misc_feature (236)..(236): n is a, c, g, or t
tgtattttttgtagagactgggttttgcccggctggtctcgaacgccctggctncaagcagtcntcctaccccagcctctcacatggtgggattacaggtgtgagccagtaatcccagcactttgggaggcnaagaagggaggattacctgagcccaagagttggagaccagcctgggcaacatagtgagannccatctctatanaataccaaaaaagttagccaagcatgatggnatgctcctgtggtcccagctacatgagcggctgaggcaggaggatcacttgagcctgagggttcagggctgtagtga

SEQ ID NO: 536361 - DNA, 260 bp, Homo sapiens
  misc_feature (42)..(42): n is a, c, g, or t
  misc_feature (48)..(48): n is a, c, g, or t
  misc_feature (52)..(53): n is a, c, g, or t
  misc_feature (61)..(61): n is a, c, g, or t
  misc_feature (184)..(184): n is a, c, g, or t
  misc_feature (220)..(220): n is a, c, g, or t
  misc_feature (231)..(231): n is a, c, g, or t
  misc_feature (258)..(258): n is a, c, g, or t
gcgttcctaggtggtcggtctcagctgcctgggtgtggccgncctagnatannaaccaccnacagtactggaatccccgctgctgctccaggcaagttctggttgattaatgagggatggggtggtccctcaagccttcccctaccttttgtggaaccagtgatgctcaaagacagtgtccccnccacagctgggtgccaggggcaggggttcctcagtntagccggtganccctgataccaggagcctgggcctccntg

SEQ ID NO: 536362 - DNA, 179 bp, Homo sapiens
ctgagagaataggagaatgtaggactgctgtgattaggactggatcagacgaagaggggcgtttggtatttgggttattggatgggggttttatatttgataatatgtctgtgtatgaaatttgattggccctctaatgatagatggagacaccatgctagggtgtaatggatgaagat

SEQ ID NO: 536363 - DNA, 259 bp, Homo sapiens
ggtgggagggagccaggttgtgatggagggagttttacaggaagcagacagggccaatcgtcgaatccgaattcctgtgtctgaggcaacaacgtcatcggggccacatcgatgatgggcaggcgtgacgtcttggtggttatgttttcaatcactgtcttgccccaggctccggtgtgagtcgtgcagcctgtcgactgtgaccgctgtaggtgaacgtctgcgctgttgccctcgtccgcggatctcgtactctcga

SEQ ID NO: 536364 - DNA, 292 bp, Homo sapiens
accggattgttacgtgtggcggtgagcgcctgtgaagcaggcgaatctcttgagcccggggaggcggaggtagcggtgggccgagatcgcgccattgcactccagcctgggcggcgagagtgggattccatctcaaaaagaaaccaaaaaaacacaaaaaaaaacatgccgttggagtactgtgtttaaggtgttgtccacggacacttacaaccctgtagcatgaataatgtaggttttacattatcgaatctggtgactgtattatatatttcgcttctaaaagacggaa

SEQ ID NO: 536365 - DNA, 413 bp, Homo sapiens
  misc_feature (210)..(210): n is a, c, g, or t
  misc_feature (385)..(386): n is a, c, g, or t
  misc_feature (394)..(394): n is a, c, g, or t
  misc_feature (397)..(397): n is a, c, g, or t
accttgttatgtgcagccccaacatataaaggcctgtgcctagattttggctttgttgtcattatctcgctgcctcgcccagagctcagtttgctgtcagaaccattgctggtgttgagctggggttgaaagccagctgagatcactgtcttaggggaatgcaatcatcagcatagagtgtcttgagcaggacagacctgggtagggctnccacagcaggggctgttctaggggccaaggaaaagaaggaattcacagagtgaagggaagaggctaagaggaaaggtttttgatgaaggcaaagtttaccttctttacatatctgtctagggattggtcccaccattatatgttagaaatgtgaacaatcagttatttccttttnnaccataanttncaatcacatgttgagt

SEQ ID NO: 536366 - DNA, 961 bp, Homo sapiens
  misc_feature (326)..(326): n is a, c, g, or t
accgggtggccgagcgggcgttctgttggtgctatggtgttcttgtttgttctttcggttcggtgctttttgtttgtctttgtgctgtttgtctacgttgtgtttagctcggtgtcggtgggttttgtctcctgtgtccgggtttcgctgccgggttacagtttctccctcctcgcctgtcccgcccgtggcatcagttttgggggttcctgccgttccttcccggtccccgttttccctgttgtgcgtctttgctttgtcctagtttgtccttttgcccatgttatgatctgttcttctgtatgtccctcgccggggaagcagtngcttatcagaaccctggcccagtggccgccagactacggggactacgatcttcgggatgctactcccgggaacaacccacgggtggcaccagtacaccgtagcccgtgtgaccccgaggctcccggaggcccctgccggcgttctcttccaccaagcgccttgccctctggccccgtccttcttgcgccccgccagagtcgcccttggtgtcttggggaatggggtctaatccccggggctgcctcacctctctcgcgccctcatgctctccccattttgaggggcttctcttctccctccataagggcccggcatattgtgtttgctcggattcaacacggcgaccatgaccttgttgattgttgctgttgtgtgcccccgctcacccagcctgtccacctcctcgtgttgttcctgaccttgcgttgcctgtttgtgaaatagatgccccccctgcccttgatgcatgaccatggagggctacaagtgactgaggggagaatcccctcctgttcactctccccaccctgctcccgacccctcagcttccccgaccctcatgccgttggcttgtaaattttccccggagctgttttactgtctacttttcaggattaaaaaaaaatccaaacgt

SEQ ID NO: 536367 - DNA, 533 bp, Homo sapiens
gcatagttgttcttgtgtgccattgtcacctgcaaagagctattcattgaatactttaattattatatcttcctaataataaagttccttcacaccctcctatcccatcagtcttgtcttttccttcctctttttttatttggaaatgggttcttgccttgtctcccaggctgaagtgcagtggaccgatcttggctcatggcaccctctgcctctgggatccacgcatttctgcctcagctccccaaattgctgaaattacatgcatgacgcaccacacccagcctgaaatctaatactcaacatcacataattctaagcagtaaatgaatgcccattaatttgcttaaaaatttgtccctgtaaaagtcaaacacatggaacggtccttgcaatcatcacttaatccaacataatttggaagtgttctgcaccatacacccctagggacacctattttaccaatggtctaaggattgaaacaacaccatggatatgatccagtgcccctccagagaagaaccatccgggca

SEQ ID NO: 536368 - DNA, 955 bp, Homo sapiens
gctcacgtagctacgactgatggagtctgcctacacgtgacgccgtggaccagacgcgtacgtcccactactgatctgtggcgcgtactgggggagttctcagacactacgttggctacaggcgttgcaggatacgaattacgcacttgcagggccgcctatgctgggcgctggtatgcatggcatagtccggaattagaccagacttagttagttactaaatatagagagccgtggtcatgtaggactcattgccgtagttgcaacacaccaatatgacggcgactcatcacgccgtggaactcctagcaggatccagtaattgttgtcagcacagacgactcctacttctaacacttcctctgtgcttatcgaatgcggagagcagcttgttactcgccccggagttccgcctatggagcaggtcatagagcatccctatggaatgaagttgcgtaccgacatcaggcgctaaggcacttaggttgaatattggaataatgtctttccgactgaccgcatatatctaactcgtccagtcgagttcgcccgccttgcaagagcccgtatcaaaactgaatcaatacaacaaatacatcaagggggaacaaggaacacaactgcagagggattgtagtgtgaggcgtgtccctggcatccggtgaaaccaaggaattggctgccacaattgacccaggaaagtggacgaatgaaagcaaggacagtggagccacccgtgggggaccattggagtgagcttagcggggcaactacgctggtgttgttgaaaataccgacgcggacttagaggtaccatggtcactcgcccttcaagacgctccgggggaggtgaattgccgtggggcccgacaaaaccctaggcgacaaaattcatgggcgtgcaaagtccctttgccgagctacacacaaacaggccttactgggtggtcagaag

SEQ ID NO: 536369 - DNA, 856 bp, Homo sapiens
  misc_feature (620)..(620): n is a, c, g, or t
  misc_feature (673)..(673): n is a, c, g, or t
ggggggcctctctagcttgcggctgtgtctatggtcgggccctctggcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatggggacagtgtacaaggcccgtgatccccacagtggcactttgtggccctcaagagtgtgagagtccccaatggaggaggaggtggaggaggccttcccatcagcacaggttcgtgaggtggctttactgaggcgactggaggcttttgagcatcccagatgttgtccggctgatggacgtctgtgccaacatcccgaactgacccgggagatcaaggtaaccctggtgtttgagccatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacnagtggtggaaacagtcaagctggctgactttggcctggcccagaatctacagntaccagatggacttacacccgtggttggttacactctggtaccgagctccgaagttcttctggagtccacatatgcaacactgtggcatgtggagtgtgcctgactctagcaggttgttctcgaaactctctacgtggaactcgacagcgacatcgccaactgacctatgtgtgcacaggtgc

SEQ ID NO: 536370 - DNA, 179 bp, Homo sapiens
tcaaaatgacttcagaaactcactgtgcttcagacctactaagataacaaagtacatactcctggaatggaagaactcaagtcaatgaaataaaaagcacaactgagagcttcaacaatagactagatcaagcagaatacagaatttgtaaaaccgaaggtatcttaacccaggcagac

SEQ ID NO: 536371 - DNA, 903 bp, Homo sapiens
  misc_feature (667)..(667): n is a, c, g, or t
  misc_feature (720)..(720): n is a, c, g, or t
ggggggcctctctagcttgcggctgtgtctatggtcgggccctctggcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattgggttgttcggttgcccctcattgggggcaaccaaggtttgggtttaaccaaaaaggggggccccccccgggtttggaatttcccccccaaacagtggcactttgtggccctcaagagtgtgagagtccccaatggaggaggaggtggaggaggccttcccatcagcacaggttcgtgaggtggctttactgaggcgactggaggcttttgagcatcccagatgttgtccggctgatggacgtctgtgccaacatcccgaactgacccgggagatcaaggtaaccctggtgtttgagccatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacnagtggtggaaacagtcaagctggctgactttggcctggcccagaatctacagntaccagatggacttacacccgtggttggttacactctggtaccgagctccgaagttcttctggagtccacatatgcaacactgtggcatgtggagtgtgcctgactctagcaggttgttctcgaaactctctacgtggaactcgacagcgacatcgccaactgacctatgtgtgcacaggtgc

SEQ ID NO: 536372 - DNA, 476 bp, Homo sapiens
tgatttcaaaacatgacagatggagtggaggtggtttacaaaaacgtttcccctttacatgtcttacttattctggaatactgaagggtgaagtacattgaaacaaataatctctccctggatttctcatcaatgacattattgacattgggcgtgacaatgctttgttgtggaggacccccttgtgcattatagaatgtttagcagcatccctgtcttcttacccactagataacaggaacatcctgcaccccatccctaactgtgataatcaaaatgtctctagcatggaaaatatcttctttggaggaagaatttcccccattgagaaccgtcttgctcttaacggttcctattaggtaggttggaaataatttgccaataaaaataattattttattggcagggcgcggtggctcatgcctgtaatcccagcactttgggaggccaaggcaggcagatcacgaggtcaggaa

SEQ ID NO: 536373 - DNA, 197 bp, Homo sapiens
gaaattttttattgaagtaaattttgaaatgatggagaaatttcagaagcataataaagttcacaataaggataatactttatataatgtataaagtatatataatataattgcatatgcgcatataaaccgcacattcatattcaaacttaaaattgacgctttttttttaaaggcccaaattgtacagtgataca

SEQ ID NO: 536374 - DNA, 105 bp, Homo sapiens
gtcgatcacgtatcttcacaccctccgccttgtagatgacgttaggtccacttcatcttcgcctccagctcctgacgccttcccctcatcctggccgcgcacgaa

SEQ ID NO: 536375 - DNA, 201 bp, Homo sapiens
agtcgcacgcactgggtcaatattactgtgccgcagtactcttaaaactaggcggctatggtataatacgcctatacactcattctcaatctcccctgtacaaaacacattagccctaccccgttccttggtacttatcccttatcacggctataatttattatcaaagctccagtctgccgtacgtacgatacaggaccg

SEQ ID NO: 536376 - DNA, 447 bp, Homo sapiens
  misc_feature (6)..(6): n is a, c, g, or t
  misc_feature (26)..(26): n is a, c, g, or t
  misc_feature (48)..(48): n is a, c, g, or t
gggaanaatttagggatgggaatacngggtgaaaagacatagatgtcntttgcccctttaacttttcccagaaagatgtgccagatttaccatggctatccagcactgtgagagggatctgggttctgacccagttgcactacgccccacgtttttgttttacttcatttttttaaatccctaaaagtcaggtacagggtctttagcctgtaatactagcactttgggagactggcgggaggattacttgagctcaggatttcaagaccagcctgggcaacagagtgagacccagtctctccaaagaaaaaaaaaaaaagaaagaaagaaaaataggcaatgctcatgcctgtaatcccagcactttgggaggccaagacaggcagatcacccgaggtcaagagtttgagaccagcctggccagcatggtgaaaccccgtctctact

SEQ ID NO: 536377 - DNA, 1391 bp, Homo sapiens
  misc_feature (184)..(184): n is a, c, g, or t
gcactactagtgaggagtgtaccagccagtcagcggagagatgctgggtgggcatgccatccgcattctgggctcgagggagtcggagaatggacacagccctacctgtcgtggtttggccaaactctcctggacatcactgcacatgcgaggtgtacgaaagtggctgtctttgagaattagntcagtacgtgacaggatgtcaatctgatggcaatcgacctcacgacagtggtaggctggtagattccacaagcacctgatgtcagtcactgggcaaaagagtctaatgtctgccgtgtgaccgtggtcggtgccaggatccatggagtggtcgagagtcgtgggtaaggaaatatgcagtttttacttctgtataaagcttcggcgtaagggactacacaggttctcactgacctacgtggtccctgaagggaactgggagttagggcctaaagacgaatcagtagcctggtcgtgttcccacagggaagagacgcgaacgtcccgtagggcttactagtcctcgaagcgcgttgctgtggtctaaccaggtgtgcatggaacgagtggcgccgaccggttggagggcacagcccggaattgtccctaggacagccaatggaggaccgttccctatcgccgccctcttggtacacgaaacgttacgtgttggccccaggtacgcgaggacgattaacactttgggcttgcgcggcccataggctttgaagcgtagattgaggtgccacgcgcattctcagaatggaatacgcgaattcccaattccgtttccaaagggggcgaaaacaaaggaaccatggagagagcacaccacggggagaattggacaataggtcgtaggaggttcccctaaaagcccatagggggacttgagaagagaggtcttgccaccccccccatagtcagaaggttttctcgaccacagccgaaggataaaggcggattcaccagcgaggctgagaagaggatagagggccgttatttccgcgaagcaattttgtgggtgtccacgacgcgataacacttccaaggatgtgggaacgcacgcgaacatgtgggatgtgtttcggggggaacggccgccccatatgtgtggaagaaaaaccggggccaaggggtccttcccccaagggggccccccactataggcgaaattcatacagtacgggacggtttttgggcaaactggggttcacacaagaagcccgatcatttccttgggacttcttttgggctgacttcccaagccacattggacgttccttactaaacttaagggaacacagtgagagcaactcttacataaccggggtgggcaaccatcctatggacttaaagtttccaattggttggggtttgggaagccc

SEQ ID NO: 536378 - DNA, 434 bp, Homo sapiens
acttggtgaagttccacttgatggcatttcccaggatgccctgtgcccttgggctggagtcttcactccacttccacagcgggtgggcgtcgtccccgcttcacgcagatcttgctgaacatatcgcactttgaccgttgtagcccgcggcgcaactctctgatctcttcgttactccctggctcctgcttcccgaactggttacaccgggacggccaggatccgcaaaccacactcaccgtatcgggcgtgcaggtcgacgagctgacgtgtacgcttcacttcggtctcgcctcactgggaggccacgttggtgacgatgcccacgacgccccggctacttgtccaggcttaccatgtgcccgtcgactgtcctcggcggacaactcgtgcctggagcgcgcacagcgccagtcgtcccgaaactgagacag

SEQ ID NO: 536379 - DNA, 548 bp, Homo sapiens
ccttttgttggtgtgttcttctctcacaaacccccgtgccttccccccccacccccccgtgcgcgcgcgcgctcctctttttttccccctttccccccgcccctttctcttttggaggcccccttccccttctctttcccccccgtcgcctctcccccccccccttggcgccgccccctccctcccccccatctctcccccctccccccttccccccccccctttttctctctcctggcccccccccctccccccgtgcgccccgtgcgtcccccctcccgcgggcgcctctggggccgccccctctacgccgccgcccccccccccccggcggcgctcgcctttctcctccctcctcctcccgcccccgcgtctcttccccccccccccctgggcccgccgcctctgaagtccctccgccctccttccccctccccccctgctctcctcttgccgccgcccgggccgacccctcccccctctcgccgccccaccctcttctcgtcgcgtgcctctcctccccctcccccaccgctgcccctttctcg

SEQ ID NO: 536380 - DNA, 503 bp, Homo sapiens
atttggctgccagacgtctcctctcagccaatcctccgcttaggcccatttgatgcctcactggggctgggcacacatcctgcagacacagttggggtaccgtgggccggacgccggcaagcagagggtggagaatggatgctaggtcggcagaaaggctgtggccgccaaaggtggagactgggagcaatgagaacccgtgtctggcgctcagagtctgggtagagcagacatgagaaaattgagtgaagtgatcccggggtgtggggggctaaccccaggagcaaacaggtgggcggctattggaaagagcaagcggaggaggtaacttgaacgggctgatgagggaaggccccactgagaagaggttgctgagctgaagaggaggccaccaggcaagggcccggggcgccgcttagagtagggtagctagtggtggggtggagggatcctgaaggaattgctgggatgggctggctaaggcctgggtggcaggggatgca

SEQ ID NO: 536381 - DNA, 1030 bp, Homo sapiens
aaaaaaaaaaaaaacccaactttcttgtaccaaagttgtgcggccgttcgcgagaactagcctgcaagaaggagcgtctgattcacctcgggacaatgtcagtgtgcgggtgctgcccccagttgcccacggaagggctgacaccagaatgacgtcccagttctggctgacagagtccggcactccattgctcactgtttcccgggaaatctccactgtatggccggggttggtggtgactatctgaagaagcctgggggcggtgggtgaaccctggctctgagctcttccttcccatttgtccccattttccttccccaaccttacccacccagttgggcccttgaaagcagggccaaaccctacttccttgtctccccttcttccccgattattctcctcttgggaatcttcaacttctgaagtgaatgtggatacagcgccattcttgccccctatttggccccatccatggactcttgccatcggtgcagtctcaagtccttgacccccagctacctacgtgtctagtctgtagggacagttgcctccccctacaatctccaagtgactcaagccttacacaaagggaggggacacattccaatccccaagatggaagtactcataacctcatgtaggtcctaactatacccctttaaccccacatttggccagtggaactcataccataccttggggaacaaaatcccgccacaagtcaaaggttcccatggattccaataggacatcataccattatgtagaggaggcacttatcagaccctcatggctgggaaagctgataacctgaagcaactcccagagtcatcttggagaagcaatacacttaagaactatcaaacttaccgcacccaagtgaaggccttcctgtcacggtgagggtatgacaccattagtaatacagaaggtctcacaatgcgtgcacagtggtccagcatgcccccagggtcggtgccaatcgtcgggaatacaagtccagactccacacttatgggtgcagggaccc

SEQ ID NO: 536382 - DNA, 1009 bp, Homo sapiens
cagaggcaggactgtggccaggaccaaccttcaattccattccaactcagccttatgcattatgttaggatctcgtaggcttctttattaatacttattgttggggattagtttcatgctgcacataatgggcgtttgcacttggtactgacccaggacttttggagccacaccacacatgcggaacgactaggcctagagcaaggtcgagtcattactaaggagctttcgtcaagccaccattagcgacgcggtgttcatcctatgaggactcaccaccaacggggattcttgcgacagacggcagctggcacagcaaggccactgaggcagacggcgctctccttgaagccaactttgtccaaataggcaacacggacgtgcggccatcgcgcctgacaacaggcaacacaagccacacggatcgctggcacattaggcttatcggcacatggcgctgatactacgggttccagcacagcgcacggtacctgggaatgtcgcttggaggagcccctataaccgcaccaggggttctctcgcagcgttactttgtctcagttccttgcgtacaacaaattgttctcagtacttggcgcccctctacagggcaccttggccaattttgcgaaccacttttacaggcaggcacaagcggcttggccacgaacgtggcccatgggagcttataaccaccgatggcaccttggaacgatcataccaaatctcgttgacgcgaaatgggcacacttctttcattggccctacagagtcgaaaaacacagcggtcgctgcgcctgttgaaactagctaagaccattgggggccacaaacaccattagagagcacgcccaggattagccatatcctaagagtccaattcgacattccacacctatcacttacaagcgaggcggaacaagctacgccaaattgatcagaaaacaccctatgtgaacattcacaccggtcgcacggcgctgaacgacccaatccacacggttccttg

SEQ ID NO: 536383 - DNA, 2378 bp, Homo sapiens
ggaaacaaaataaccgtaccgcgacgccgagacaaaccggacccgcaaccaccatagaacagcacaaggtacaatataccaaccacagccaatcctaaccctagtagcaagcctacctagggcaataccacgtaataaccctacagaacctatacccatacctatacctacagcgctaccacccctaataaccgtatagctaccaccctagtcctaactacaccaacctactaatactgtaccgcatgcctatacagtagacaaccccacgcggcgcctaggcccaccaagtacccccccaacccaatagctcaacagcaacagccccatattccctctagcacaccccctctaacctaccttaactaaatacctatcacccataaatagtctccacccctactctttcctagacttcctaccctagcatatcagcgcgtactacttattatcaatttgcttataccaccaactcaccacataccactgcacctacttactttcctttactactctcatgacatctatcccccaacctcttacccgcgttctttctccccccatataaccctacacttaccgtctctaccctccttatggctgctctattaccccgaacactcatggttttatggctctatatgctgcttagcgcgcaactccgcgcccaacgcgcacggcccctacacttaagccccacctcagccccaccaacacccgccctagagccccccatatgttcccacctaccacactcgcgccccacggcccccgctacgcgcaccccccgcaccctcctacaacccctctaggccacccctaaggtacgtcccaccagccacgcctcccaccattaccaagctccgcaagcataccactcctaccctctatatctctccaccttacttcactccccacttattccactatccatcactaatacgctatactctacacccccattctgtaaccacatccatcctctcatctcttatttcctaacctcctcatataataccataactctaatgactactactccctcataactgcttcgacctcatactcctactccatatcttcctctctcactattatcttatctaccatcctccacactctcttcccctactctccctgccactatcatttaagttcatctctaccactactctaccctgatcgttccaaatactacttcccctgcactcccacatccactaacctccactgctctctcatctcctcccaccctacctatatctccctcgcacctctattatccaactcccatcacctctttcccatcaacctctctctcttctctactgctctcctactccaataccttcctcgttcctccatctccacatctctctcctctacttcttccacctcccatctactctcttctcccaattatcttttatccacgatctgctctacattgccctcctccctattctttcctcatcattctctataatcttatctcactatctacctttatgtagcgtacctctcctctctttcatctcctcctctcctacctcaccccttaacttctactcttccactctattgctccccctccttatattgctcacacgactccctccccacccaatctctcacctccctcccatctcatctcttcctcccctcctcttcactctcatctccatcttcactcccttatatacttcctactttcttcatcaccatctcttctctcctctatcctagcctcttctctacctccctcttcctcactcacttcctctactatattctctacctctcctacactcatcttcatatcaccaaccctccctcctttcattattaatctttctctatgtttattcactgctttatccatcaaactatatatatcatacccatctatccacttacactccccataacactactctctttcttgctaattcatctctctctctttctatatttctatcctccctccctcgtatcgtttcttcacttatctacttctcgctacccttctataatcactttctttctattaccaatatccccctcctcctatttcctcactatctctttcctcctttactatctagctctccctccactctcctcttactacctcatacactccctcctcaatacactcctatctcgtacccctacttctatcccgcatcacaattctctacacatatactatgttacttactctccgcccccttcataatctcgctcctactcaccccctcactaccctcactctcatctcatactacctatcccagccctttcattgtctccctctcctcactctaaataacttctctctccctctttcctcctctctactctccatctctacttac

SEQ ID NO: 536384 - DNA, 408 bp, Homo sapiens
ctaaggtgatgctacgaagcatgcactataattaccaaactaccatttaagacaacgaaactgacgcttagacagatccacgttgctgtgctacaacgtcatacacgcgagcaggtgcagagctagagatgtgaagctggaagttctgcctttggagcccccgctcttaccgctatccagcgccaccactccacctgctccgcggaggcatccactcacacatgctgccatgtgaacagaggcctctcgggttctaaagcatagtaacaggtcacagtgatatctgaggtatgacattgtgcaccatttagcccgagccctcactgtggaaaaccataggccaggacagactctcgggtggggacatcacgtaccagcatcttcctcctctgttggcgggtgtggctg

SEQ ID NO: 536385 - DNA, 82 bp, Homo sapiens
ggacttcttaaccatctttttgtttttctttttcgaactgccatagtcactatcgtcatcatctcccttctgtcgtcttctc

SEQ ID NO: 536386 - DNA, 859 bp, Homo sapiens
  misc_feature (63)..(63): n is a, c, g, or t
  misc_feature (65)..(65): n is a, c, g, or t
  misc_feature (90)..(90): n is a, c, g, or t
  misc_feature (106)..(106): n is a, c, g, or t
  misc_feature (108)..(108): n is a, c, g, or t
  misc_feature (138)..(138): n is a, c, g, or t
  misc_feature (151)..(151): n is a, c, g, or t
  misc_feature (154)..(154): n is a, c, g, or t
  misc_feature (157)..(157): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (172)..(172): n is a, c, g, or t
  misc_feature (174)..(174): n is a, c, g, or t
  misc_feature (195)..(195): n is a, c, g, or t
  misc_feature (216)..(216): n is a, c, g, or t
  misc_feature (219)..(219): n is a, c, g, or t
  misc_feature (221)..(221): n is a, c, g, or t
  misc_feature (233)..(233): n is a, c, g, or t
  misc_feature (252)..(252): n is a, c, g, or t
  misc_feature (280)..(280): n is a, c, g, or t
  misc_feature (283)..(283): n is a, c, g, or t
  misc_feature (285)..(285): n is a, c, g, or t
  misc_feature (303)..(303): n is a, c, g, or t
  misc_feature (319)..(319): n is a, c, g, or t
  misc_feature (322)..(322): n is a, c, g, or t
  misc_feature (340)..(340): n is a, c, g, or t
  misc_feature (349)..(349): n is a, c, g, or t
  misc_feature (351)..(351): n is a, c, g, or t
  misc_feature (354)..(354): n is a, c, g, or t
  misc_feature (371)..(371): n is a, c, g, or t
  misc_feature (393)..(393): n is a, c, g, or t
  misc_feature (397)..(397): n is a, c, g, or t
  misc_feature (401)..(401): n is a, c, g, or t
  misc_feature (403)..(403): n is a, c, g, or t
  misc_feature (409)..(409): n is a, c, g, or t
  misc_feature (413)..(413): n is a, c, g, or t
  misc_feature (427)..(427): n is a, c, g, or t
  misc_feature (442)..(442): n is a, c, g, or t
  misc_feature (453)..(453): n is a, c, g, or t
  misc_feature (489)..(489): n is a, c, g, or t
  misc_feature (536)..(538): n is a, c, g, or t
  misc_feature (550)..(550): n is a, c, g, or t
  misc_feature (555)..(555): n is a, c, g, or t
  misc_feature (565)..(565): n is a, c, g, or t
  misc_feature (567)..(567): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (585)..(585): n is a, c, g, or t
  misc_feature (588)..(588): n is a, c, g, or t
  misc_feature (595)..(595): n is a, c, g, or t
  misc_feature (598)..(598): n is a, c, g, or t
  misc_feature (605)..(607): n is a, c, g, or t
  misc_feature (609)..(609): n is a, c, g, or t
  misc_feature (633)..(633): n is a, c, g, or t
  misc_feature (684)..(684): n is a, c, g, or t
  misc_feature (721)..(721): n is a, c, g, or t
  misc_feature (808)..(808): n is a, c, g, or t
ggcgggcaacacaagcaccagcggcggggactccaacagcatctgcccggccccctccacgangnccaaggccgaggaggccaagaagcnggcgggccgcgcggcngnggagaaccacgtgaggaataaccaagtgcngggaattggaagnggntcnacaatngnccangcngngcagcgaatagctgaaagggngaagcaagagaatctgaaccncgncngtattcccactnccttccaggcccgccagcncatcctgcagtatggcttgaccctcagngancnggatcgacacccagagancgaccttgccatcganggngctgatgaagtagatgcngatctcaancncancaaggggggcggaggcngcctgacccaggagaagattgnggcnggcnangcgagncgcntcatcgtgatcgcngatttcaggaaagantcgaagaatcncggggatcagtggcacaagggaatccccatcgaggncatcccaatggcctatgtcccagtgagccgagctgtgagccagaagnnngggggcgggggngaacntcgaatggcngncaacaaggcnggnccngnggngacaganaangggaatnnnancttggactggaagtttgaccgggnacacaaatggagtgaagtgaatacagctatcaaaatgatcccaggtgtggnggacacaggcctattcatcaacatggctgagagagtntactttgggatgcaggatggctcagtgaacatgagggagaagcctttctgttgaccctgcaagagcagagtgtgttcaccttgagtntccagcccacagccaaggtggacgtacctctccaggagcctttgccttaat

SEQ ID NO: 536387 - DNA, 106 bp, Homo sapiens
tgattcttataaatcagctgagttaatttatagataaggtaatcttaaattctctcaaattgttctaatactccatgaccttaggtgaggattttaccttaatcac

SEQ ID NO: 536388 - DNA, 509 bp, Homo sapiens
catggaagtgcagatccaaacttaccgatgcaaacctgtcatccgaatcagacccgattcttgaccacctgttttccaagagcatctggttggagggagccagggccaagggccatctcctctggttacctggatactgacaaccgttgtgttcacattggcaggtgtgcacacagttatccgcactgtattatggtgctggtaccatgagagggtgcgttcacaccaagggcacgttaagatgcgaggtggggctaagacctgcttctgagattatgaggtggctgaccctcacagggcctgaactctcacagcagggctcacccccaagcctgaatgcttagctatgactctctttggacaataaaataaagtgcattactgaacaaagagtagctcaaaaccagaatcagacaaatcgccaatgcttttcctttagctaaaagacaaaagataacatgaatgatgtgaatgccgaaacttaagattaagggaaatgcgtgtggagg

SEQ ID NO: 536389 - DNA, 319 bp, Homo sapiens
cgactcccggcaggcgccgcagtggtgaaatccgttctccaatagaatccataaaatagaacctcaatcgctaatcccggtatcgggatcactttatgaggttctcccccatggcattcactccccttgtccaggcccatctcgacgcgtgggttgcctgcgccgctgactttggcccatttctctcgggccaggaaaccaccctcaccctcaacgagcagcgcaaggcttatgagcaggtgcttgttcccatccgattcccgccggtgtcagctttgtgacgtcgatatgggtggcataccaggcatgatgtcgacgc

SEQ ID NO: 536390 - DNA, 576 bp, Homo sapiens
aaaaatatataaatatgaactgtgttacgagatgattgctgtgacgaaaaataaaagcagggtaagaaggatagagagtaacaaaataggggatgattgctgttttgggaatattatggaagtattgtgatgaagtagcttttgagcagaatcctaaaggaagttttctaggcaaaaaataagaactgagtgtaaagcttgcatatctgttgggcagacggtggttagtctgtaagcgtttggggttgtggggaaagggtgagtgaagggtctttccctccctactcaggaaggtggaggtacagagtcagtgttgctaggaacacatggagctctgtgggctctcccctgcaatccgacctgataatagaaagatgcagtgacaagacagatggaatatctatttgttatgcctgcagtgggaggtcaggaaatcccttatcaaggatgtcatgctttatataagaagaatgaattcaccaggagaatcgcttgaacccagcaggcggaggttgtagtgagccgagatcgtgccattggactgcagcctggaaatagagcaagactccgcccgct

SEQ ID NO: 536391 - DNA, 519 bp, Homo sapiens
aatgtaattgcattttatagtgaacactgttgtccacatatgctgtgaaaatagaacgcaccctaagtaatttaaaaataataacaaatctgccatggcttgaaatttgtctgagtttacatggagaggagaatttcacaaatttaataagggagtatataatgttatcctgttgcaatgttaaagctttataatgaatccagaaaaaacatggacttaacaattaataatatatgttttttaagagatgcgtaaataatagtactctcagttaccttctcactttttgataactagttcttcaactgctacagaacctggtatcaatatcagcagcaactcataattatggggtactgcctgcctatagagtaacatactaacaatgcataacatctaaagtctctattgagctacttgcaacaaaatatcctagatagggtggcttaaacaacaaacattatatctcacagttctgaaggccagaagtccatgatcaaggtgacaggtgattttggt

SEQ ID NO: 536392 - DNA, 463 bp, Homo sapiens
gtggagtactgcctcttgccactgtgtatctctcgtattctgtccaacatctctctacatagtatgacaccgtcggacatgctgtctattgttgtctcgggatagtgaaatcccgaacacatcaatagctcatgtcctgcaggttatacagcgtaaggatgtgcgagcaactacagagaacacatggtccaggagccaccccatgctccccattgttggggcctggctgcgcacccactgcacggatcctgtagctgtcctcgtttgtgctgcactgcctgcatagcgggtgcgtggcttgaggaccaggacagaccctggtgtgggcaagcagggtgtggcccacctgataggacaggtggggtaatactgacagaacgtgcgtgctcctaggggctgcctcctagaggtggctcttcaggactctgccccacaccggcccccactacctttgggtccagtt

SEQ ID NO: 536393 - DNA, 82 bp, Homo sapiens
  misc_feature (2)..(3): n is a, c, g, or t
  misc_feature (6)..(6): n is a, c, g, or t
  misc_feature (23)..(23): n is a, c, g, or t
  misc_feature (59)..(59): n is a, c, g, or t
tnnatnttttcttctttagcatngcactgtcattttttgtgaaaatggttatgtttatntattacaatactgagtcatatat

SEQ ID NO: 536394 - DNA, 228 bp, Homo sapiens
  misc_feature (107)..(107): n is a, c, g, or t
acgagacagatacgaatcgagccggtacccaactcacagtggggaacctttcttggatagttcaggtttgaaacactcttttggtagaaactgcaagggggataatngcacttctttgaggcctaccgtagtaaaggaaataacttcctatagaaagaagacagaagctttctcagaaaattcttggggatgattgagtggaactcacagagctgaacattccttgcg

SEQ ID NO: 536395 - DNA, 328 bp, Homo sapiens
  misc_feature (69)..(69): n is a, c, g, or t
  misc_feature (80)..(80): n is a, c, g, or t
  misc_feature (83)..(83): n is a, c, g, or t
  misc_feature (87)..(87): n is a, c, g, or t
  misc_feature (92)..(92): n is a, c, g, or t
  misc_feature (97)..(97): n is a, c, g, or t
  misc_feature (117)..(117): n is a, c, g, or t
  misc_feature (128)..(128): n is a, c, g, or t
  misc_feature (133)..(133): n is a, c, g, or t
  misc_feature (150)..(150): n is a, c, g, or t
  misc_feature (162)..(162): n is a, c, g, or t
  misc_feature (170)..(170): n is a, c, g, or t
  misc_feature (181)..(181): n is a, c, g, or t
  misc_feature (184)..(184): n is a, c, g, or t
  misc_feature (214)..(214): n is a, c, g, or t
  misc_feature (311)..(311): n is a, c, g, or t
aattaattgatgggaagaaatgatgataatcataaactgctaataacctccattatttaaatattcagnccttgccctgnctnattntactnatccnccaatacaggaaaggccctnccttatttagntctgntttacggcataaagggnacttgggccggnacggtggntcacccctgtnatnccagcacttagagaggctaaggtgggtggntcaactgaggtcgggagttcgagaacaaactcaggcctgggcaacatggagaaaccccatctctactaaaaatacaaaattagctgggcgtggtggnacacaccccttaatccc

SEQ ID NO: 536396 - DNA, 472 bp, Homo sapiens
ctgatctagaggatcccttcgatgtgggtcagaggggatgcttgtggaagctgaaaaatccatgaagctgttctctgaaattttctcgcctggggcagcctcactacccaggagccacttgtccttcattagcctggggaacgctggtagttggagaaagctgtggactgctaattcagaagaagaggtagaattctctagagcctcagtgtatttccagcaggtgtgtggaccagagttggagtggggatagtgagtgcaggagtgggatgacccagcatgcttatctcgtttgacagtagtgtacaggggtgggctctgaagagctctcgtctagacatggagtgaggagtgggtggggaaggagtgagaagccaggtgtagggcatagactcaaagcgagcgagttctgtctccagtttcccaacatggacaattcacatgtccgtcagatctgagcctcagcatcgaa

SEQ ID NO: 536397 - DNA, 169 bp, Homo sapiens
  misc_feature (116)..(116): n is a, c, g, or t
  misc_feature (128)..(128): n is a, c, g, or t
  misc_feature (152)..(152): n is a, c, g, or t
gggaagcctataggaccatcacagacactttggataactcttacagtgaaggtgtctggagtttcccctatggacgctgtctcctgccaccatacaaaaaagcgccactgcagggnggaatgccaggntcccatagagggagaccgacagtnaagtggagcctgccatg

SEQ ID NO: 536398 - DNA, 912 bp, Homo sapiens
ctcgcgccaccactggtccgccggccgcatctccaggtgtctagccgcccagcctcgacgccgtcccgggacccctgtgctctgcgcgaagccctggccccgggggccggggcactggtgtccaggggcgcggtggtgaagtcggcttcctcgctagggccgtgactgggcgggcttcagctcattgaagactccttcatagccgtcttactccgggcttcctgcgctggtgagcgtcaggccgaggtttgacccgtgagccatcgctctccacgggaggaccgttgcggctagtcgccgccgagtgggtctcggcgagatcgcgcgcgccacttggaatcccagcgatcctctccagtcctcgcatggacctcgttctctggtcaccctggcgtccagtaggtcccaagtggtggacaagacgcgagactaacgaggagtccatcatcgaggtagctgccagatagagagtcgctagtgctcgtgtccctatgtaactaggagacgatggcgctgcaaccgtgcccaatactcgtcaattgattacaagtaatttcctggcaacgtcgattcgcttggcctccactcgccgtgctggctcctaacgtttcatctattggcccgtggctgctcttgacctggcaaacaacagcccaataaaaacggtgagccatgggacgggctcacaagatgagaagttccgacaatctgcgagccttggatgttggggcggacctaaacttgtttccgaacgaatgaacgtttatacaccatacgcgaaggcgtgcgttgaaaagaacagcgaacgaaaagccttggcttgaacccaacccaagggaacacataatgatccttctgggaattaccaaacacccgcaatgggctcattcgatggaaacctggatgtggccg

SEQ ID NO: 536399 - DNA, 423 bp, Homo sapiens
ttccccccccttccaaagcaggaccaaggtgggcccgccccttcttcccgccaaatcctgtccccaaggccaggatccaaaaggggttgtttttaatccagggagggagaagatgatggtccctttatggaccccagttttttaagaaaaaaaagaagataatattttttatgggccttgggaacctgccaggttccgggaaaatgaaaatggttccagcttagaggttcccgtttaagattttaaggattgtttcctgagccaaaccccctaagtaaaaaatttttaggtccccgacaaaccaaagccttgattccccctggttttttaacccgggtggtgtagtaaaagctttgtttccaaatccctcttgagtaaaaatttaaataaagcccccctttttccttttttttttctaatgga

SEQ ID NO: 536400 - DNA, 163 bp, Homo sapiens
cttgtgaccagaagcggagtggtcatggttgtgcccactgtggtcgtggccgctgtgggcatgacggtccgtcctgggttgcaggctgcagacgttctcgtcggcttccgagttccagtcgatcccgaccgtggcgtgttcgatgctgaattgctcgtcgacg

SEQ ID NO: 536401 - DNA, 501 bp, Homo sapiens
  misc_feature (466)..(466): n is a, c, g, or t
  misc_feature (491)..(491): n is a, c, g, or t
aggcatattcctgagtccaaacaaccgcatagtacacactgtatgaattgttgaaagcttttcctgtaagatcagcaacgggacgggtatgcccactctcaacacttgtagtcaacacagcactgaatgttctagccagagcaattagacaagaaaaagaaataggaggcaatcaaaaaggaaaggaagaagggaaatagtctgtttgctaatgacatgatcttatatgcagaaaactccaaagactccatgaaaaaaattgttagagctgacaaacaaactcagtaaatttgcagtgtgcaaaatcaatacacaaaaatcagcagcatttctttacaccaacaatcaactatctgaaaaagaaattaagaaatctaacgcactcacaacagtcccaaaaagaaaagctaaaatacttaggagtagccgggcacgatggctcatgcctgtaataccagcactctgngaggcccaggtgggtaaattgctgnagcccagagg

SEQ ID NO: 536402 - DNA, 151 bp, Homo sapiens
cgcgtctcctaggtgatggagatgtgtacgtaatattattttaactgctgcaagggtgtgagatgttccccctgctgtaaatgcaggtctctcggtatttattgagcttgtgggactggtggaagcaggacacctggaactgcggcaaagt

SEQ ID NO: 536403 - DNA, 328 bp, Homo sapiens
ggcgaacagcagctggtaccgaaggcggacggtggagcccgagagggaaccagcggtgaaactgaggctcggggtggagcgcaggattgtgggacgcgccatagactgctgtctttcccagcagcatgcggaagatgtcgtgatcagcgaggatcagctaatcttttccgacggaggaggacacgtcgagcgcacgcagtgacggcgaggaggccgaggtagacgaagagtcggctggatgtgcagcgggcagtgagaaatgatacgaagagcctcgcaggacagaacgcatggcaggcgggacacacggagggaagtgagatctcgt

SEQ ID NO: 536404 - DNA, 164 bp, Homo sapiens
gatctagaggatcccgggctcggtaatatttgatgaacaaattatagatggctggagataggcctggatgagcagctgctgaactccatcctctcttattcctcgcaaggctgcctccagctggcttttgcacctcatttctagaggcattcctggagagtcct

SEQ ID NO: 536405 - DNA, 123 bp, Homo sapiens
gtttgcttccaaattaaaatgtccacaaaggatcaaaagtttattttgccatcatctaaaaagaaatacagtctggccgggagtggtggctcacgcctgtaatcccagcactttggaaggcca

SEQ ID NO: 536406 - DNA, 215 bp, Homo sapiens
  misc_feature (135)..(135): n is a, c, g, or t
atgtaatcacggaggccagtatgtacagccaaggggggaggtttatttctgggtctcttcctccttggtcacgtcttgatgatctcctcctttctgggcctgggaggcgctcttcagggcggctggcgtgcttcnctgggtcttagacctccggggcctcagcctgggtcagccagggagcttctggcggggccttatctgggggggtaccgagc

SEQ ID NO: 536407 - DNA, 404 bp, Homo sapiens
gattcttcatagacagattcagaagtagtctcatccatgagattttctggaatgaatgaacattagtctaatattacttcaagtaagtcataaagaagtccatgcttccttgcatatcttaagaaaaggaactttcacagtagcatctgtgtgtctgccatgctctactttcacttgtcttatgaatgtattacatttcatagtttcgggtggctgtacatgattgcctgagaggggtttcttccttcctctatttctatttcactcctgaaaatttagctaaaaatataaaccatttaaaaattggaatccataaaggaaaagattactctttgactacatgaaatatacaactcatatgccaaaagtttttacaaagtcacaagatatggcaaactacaaca

SEQ ID NO: 536408 - DNA, 105 bp, Homo sapiens
tagctgttccttgattaacacttgatatcgcaaaatattggcagaaggctttcgcaagaggagcagcagctgaccgccatgaaggtgattcagaggaactgcgcc

SEQ ID NO: 536409 - DNA, 431 bp, Homo sapiens
tagactggatggatacggtcatgtgtatcttcagagttatcagaatttaataacattatgttggaggaagtaccaagccttgtacggaataaacaactgtgctggtgagtagattatttcgtaagctgccagaagggctggaactcgctgtcatcgaaaacatctgtataatcttcaaactcttcgccttcttctctttcggtatctgcataaagttaagaaaaattagaaaccatcggctagtgtccttacttcaagaaaatggttgccagccggaaaaacacttaaaagcctgattgtctcaaaatgttaattagcctttgaactctgcatagaaatgactatctttcgcacttacattttacatgttatgcaagaatagagtaactctaacaaggtatgtagagccctccaaaacgcggggaccccct

SEQ ID NO: 536410 - DNA, 234 bp, Homo sapiens
gcccccccccccccccccgggggtttttttggggggggggccatttttttttgggtgcccccggccccccccctcccccttgggaaaagaaaccccccacccttttttacccccccgggggttttccccccccccccccaaaaaggaaaattggggggccccttttttaaaaggggggccccgggggttttttttaaccgggggggaattttggggaaaaaaaagggtttttta

SEQ ID NO: 536411 - DNA, 1358 bp, Homo sapiens
acctgggctgacctactagccgatctcgtggccaggcgtgacgtcgtgctgctcaacactgctgcagacggcctgcaggttgatgacggcgtcgttccacagcttgcccagaggttggagcgtgccgctcaatcgattgattcgggagcggcacacgaccatctcgaccgttggatagctgctacccaaggctgattgctaatgccatccaggggcccgcccatagggctgggccataggcaaatgccgacccccatggtgaggggcgatgtttgcgaacaagggtgacgatgacggccacaacggctccgaggatggtggaggagagcaaagtcgtcatcccggcgcggacgaaatctgggtatggggagagtacggccgtcgtcgctcccaggaagccggtgcccgccgcaagcctgacatcgccgtatccgagggatgaattgagtcgccacatgagccagaagaaccctgttgacactgccgcgatcagaacacacgcaacgagccaccgtgcacgtggcggcgcgtcaggacgattccgcccaggagcgctaccccagcctcggcgacgcagcgacgccataacttcagtggtaggaaggtcgtcgcataatcgacgatgaccagagtggtcaccgatcccgaccagatccaccaacgccccatgcccatggtggcgcgcagaccgatgcggccccgcatacggctgctgtcatggcgacgacgaaggtatgcgtcggagtggtgagggaggcgtatgtgggcttgattgccaggaccgcgtcccccacttcttcgacggttggctcgacgagattcgggaccgtgacgcgtagatgccacagcgccaggccgcacgccaccgcggagccgaggatgatccacatgggctcgactcacatggacgccatggactcggcagtggagagcaggccgcgagcttcgcatgcggcccgactgcgtagtcgcgtcatctcagtgcacatctgctcttccccgctcatgaggttcgcggcgtaggacatcgttacgtccagcatggtggcgatctcagcgatgtcacagccggccttgtggagggcgaggagccgagcgcgcgtgcttcctgctggcacgatgcgttcacgtgctgcgttgatgtcgtcgatactgatatgcaggatgcgcacggcgtcgatgacgcggatgcggtgaattggacggtccccctggccagcgagtcgttggacgattcgactggggacatgcgcgagcagggcgacgacacgccacggaacgcggcattcatggacgagggaacggacatggagcgagaaaaagcgggcgtcgacccatgcagtcgacgtcttcgagga

SEQ ID NO: 536412 - DNA, 86 bp, Homo sapiens
gagctctctctgtgggggaaggcagagtatgtaaagaaaaagttaactaaaggtcttcaggccttcaaataaatatggactaagtg

SEQ ID NO: 536413 - DNA, 972 bp, Homo sapiens
cgggacaccaaactgtcggggggggggtgttttgtggaatatttgagttccaaccgtggtctggatatgaccaagagggtgcctccaactggaggccttggcacgtggaaagctcacttggggagtgtacttgcatctggctgtatgtgatcaataacctggagggttgtgggcaagaaccgaacgtatgtggcgtgggacttgggttgttaacacaagggtttgcacgagtatgagggaccccctgtgtctcttattgtgagaaaatgttgcccctgggaaaggaaaggactataagtttcggttggagaagaagaagagtgaagggcgagggatgcacgagggaattgggaagttgatgttcaaagtgcccaaccaggagagaattgtctgtgttgacgccttgggaagtgctggaacttgtgttagatggcagctggaagaaagtgggccctctgaacttggggcgtgaagttgtgttgttgttgccaactgctgcatgataagagaatatagtggcacagcctgggaaagtggtgtgagccacatctgatgcgcacgcacaccactgggattgtggtgcccgtgagatggtctgcaattgaaccaagcatgtctgttagaaaactgtggtgaggctgatcctgtcacaaaccaagtgcgctggtgtctggggtgtataatggctgggtgaatgatgcaccctctgttgccacgaaaggcctcggctaggctgtggacttgagccactgagcacagtggaaccatgggcacgtgtgttgggctgttgaaaatggaaggggtgacacctttagtgagcttagcacaacgggattataaccagtcctttaacccagcaccagcccagtgtaaagaagccagccatcactgcttcaacgccagatgttaatgtgtaccttaaatatataaccttggcacgttaccaaaccaaagtaaacctgggggtggact

SEQ ID NO: 536414 - DNA, 349 bp, Homo sapiens
caccatgacgcagagtgacaggtgtgtgcatatgctggtcctcagccctgcccaggagacagttgtggtgtctgtgggtctatcagccctgcccaaggatacaggtgtggtgtgtagcaggtctatcagctgtgcccaaaagacagttgtggtgtagcacaggacctacaagaccctgcacagagtaacaggtgtgctgtgtgctgatcctcagccctgaccaggtaacaggtgtgtagtgcacacgtactcagactataacacaggtatacaaggcgtgatagcgtgtgggtcctcagacctgcccaggtaacaggtgtggtgtgcgcgggtcctcagccctgcccag

SEQ ID NO: 536415 - DNA, 526 bp, Homo sapiens
cctcgatatctgtcaaggcttcattataagtcatataaagacacacacacacacgagctatgggaaagctggcttcagcaaaataaaaaataaagctaaggaattatttgtaacttggttgctaagtgaatgaaatggtaatattataccgatcttaatcatttagcaacaataataagttctgggtcatgatcaatagctagaagactacttaagcaaattaaaactcatgcacaatcctcacccatcagacaagttctactttcgattccattatgactctagaatggaaaaggtcaaaaatgtttactggttcacataataggaaagattgtcacatttgagtttttcatcctcttacagggaatcaagacaatacaaaatgaaggctaaagtaaataatagctgattaaaaattagttgatttgattttattgatacatcaaactatagacccattcagtgtatgttaatactagaagtgtgtcagaggccctcagttagagggcattttatttctcccaca

SEQ ID NO: 536416 - DNA, 172 bp, Homo sapiens
tcggatctcacttaccaggatcgcttccagtcgctggaacataccttcaatgctccagcggcggggatacagttcggcgatctgttgcgcactgacgctctcaggcaggttgctccagaacatcaagctgctgtcgccggagtccgttggcgaatgaagcgtcagttcgaca

SEQ ID NO: 536417 - DNA, 310 bp, Homo sapiens
  misc_feature (10)..(10): n is a, c, g, or t
  misc_feature (26)..(26): n is a, c, g, or t
  misc_feature (134)..(134): n is a, c, g, or t
  misc_feature (160)..(160): n is a, c, g, or t
  misc_feature (234)..(234): n is a, c, g, or t
  misc_feature (282)..(282): n is a, c, g, or t
gtggtcgtgntgtccaagcctcctgncatgggctgtaagttgtacttcttccagtagctgctccggagaacgtggtcctccaccccaaatcacatctctgcctcaaacatcgtgttgtccctaccttccgcagncctggcccctcctaggaagcccgggnccacaggcaacacctaagtggccaacccctctgcctgtcctgccccccagacgatgactgaaggctcctttganaccttgagatgattctgctactttccagacttttcttacaaagcaaanacttttattttctatgcaaaaaaaaaaa

SEQ ID NO: 536418 - DNA, 1371 bp, Homo sapiens
ctaccagacaaccttagccaaaccatttacccaaataaagtataggcgcatcagcaaatgcacaaccgtggcgcaatcagcatcatcagtcaccgccacagggcaacagcatgcaacagacattcatcaacccaagccatcaatcatcagccaaggcactcaacgccctcatcacctgtctgcatcacatgcacattcaactcagcacacatcacactatgagcaagggcagcagccaaagagcctcaagcaccccgcgcaacacccagcacgcagctcaccatcaagcaaccagcatcaacacagcagccacaccgccgtcgtcatagtcagcaaacacaataagtagggcacagcattttacatcagagtcagcaggcagcaccaacacactcacctgcagcctatggttgcatcagcatgggttggtcccacagcatcagcacatcatatcaagttccacacgttatcacacatcttagcacacaaacaagcaaacccgtactcacaaatcgcccatgtgttacaaacattaatcaacgtagtatacaggtgtcccagaaggcagcgcacacgcagcatcctattaggaaccacatcagagcacacaacacaccctgtgggttaagcagccagcaggtcacacacacacattttcaaagcgaaaggcaccaatagagtcagagggcactcacaacacgcaaggcaccacccgaacattcacacgacacaggacagttaccacagggcatccaaacaagccgcaacgtaacccttacaaacaaagtcccacaaagacgataatacacacgtggacacatccacgttcgaaccaacgcctcaaaaatttggggacgccagaactccatcagtccagccacccttactcaggcacagccaacctacaagtggatgaagatcatcaaaggtatacagcaatgtggaaaaaccaccacattatcttcccctcccgggacaattaaaaggaccctgggacgtcacacgcatttacaagacacaccacaggacaaccgtggcaccacaatgataaaccaagggaccccaaaagtaaatactaaccacacatccaaacacaaaacagacagggtcatctaaaataaaaccacccatccaccgtggatcaaaagcacacaaacacaacaagggcacgtgggcgtcccacataaaagagcaacaagggtcaccacagcaaaaaggatcaaacacgggaaaccaccgaggcaacaaacgcataaacaccccgaggcagaggtcgaaaaccagaaaaaaaatgtcaaaccacaaatagaaatccaacacagaaaataaaaaagaggacaccagaccagaccccaaagggcaaacaaagac

SEQ ID NO: 536419 - DNA, 136 bp, Homo sapiens
cgacacacaaccgatattgtgatggtgatgactgctacaccttatgggatttcgacccctggggccagggaaccctgatcaccgtctcctctgcatccccgaccagccccaaggtcttcccgctgaagatgatgtt

SEQ ID NO: 536420 - DNA, 423 bp, Homo sapiens
  misc_feature (20)..(20): n is a, c, g, or t
  misc_feature (44)..(44): n is a, c, g, or t
  misc_feature (54)..(54): n is a, c, g, or t
  misc_feature (90)..(90): n is a, c, g, or t
  misc_feature (345)..(345): n is a, c, g, or t
  misc_feature (366)..(366): n is a, c, g, or t
  misc_feature (406)..(406): n is a, c, g, or t
  misc_feature (412)..(412): n is a, c, g, or t
ggcttgcaggcgtgagcagnggcacggtggtcagcgtgcagcgngacgggactngccctgcccagccatgaatcgcttggccatgctggntctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctgggattttcagttgggaggtttttggttttggagacatccaaagcctgaagccagggtgggttttgggcaggggntgcatttttattgaaaactgncccagcaagctgcgttccctgggggccccaggattccacntaattnggcttgggaac

SEQ ID NO: 536421 - DNA, 159 bp, Homo sapiens
  misc_feature (28)..(28): n is a, c, g, or t
ggggcacttaatgcaaaatcaaatcggngcaccacccccccagcaaaacttcagtgatccaaaaaaaaaagcgtggctattccagatcatcacgattgtggcggtggtctcgttgggctggtacctgttcaacaacacgcaaaccaatcttcagtcgac

SEQ ID NO: 536422 - DNA, 407 bp, Homo sapiens
attaatgagaactgtgcattgaaataccattctggacataggacctggcaaagatttcatgatgaagactcaaaaagcaattgtaacaaaaacaaaaattgacaagtgggacctagttaaactaaagagtttcttcacaggaaatgaagttatcaacagaataaacagacaacctacagaatgggagaaaatatttgcaaactatgcatctgacaaaggtctaatatccataatatctaaggaacgtaaacaaattaacaaccctatttaaaaaatagactggccaggcacggtggctcacacctctaatcccagcactttgggaggccaaggcaggtggatcatgaggtcaggagatcgagaccatcctggctaacacagtgaaaccccatctctactaaaaatac

SEQ ID NO: 536423 - DNA, 800 bp, Homo sapiens
gaagcagctgggccctctgggaaggctgtgttcagcttaggaacataccgcctgtatctgctgtcccatccccatgaccccacatgaacaccccccaccgcactatcactattattccctgtcttcctgtaaagtttcactcctgaataaagacttcactattgcctatagaaaaagaaaaaaaaaaggggggaacgccacataaaaagtacatcccccagaaggaggccaagaagacaatacgacgagtaccccacgcttccaatggatacaaaaaggggacccccaaatacggtgaccgtacagtacatctacatacgcgacaaaggaacagggagcccgcgcagcggcaccacacaacacacggctcggaaacgacaacggccagaaaaccacgcagcgaaaagccacctatgacgagaccacaatgcagcggcgacgacacacgcgacaccccctaacacactcactcgcgtccgcacgcgcgcagaccccaataacccgtgggagaaccaaacacccaaacccccaaacccaggcaaaaactccacaaaaaagagcacccaacaacgggcgcaacaacagctaaaaaaaaactctcctaccaacagcgtgccaccacacaaaccgagagacaacacaaaaacccacagcccgcagcaaacagaacgccaaagaacagagccaagagaacaaaaagaaaagagccaataacagagacagcgaaaaggaacacacacacaacaccacaacaactacaaacaacccaaagaagggagaaaaccaaccagcaaacaagt

SEQ ID NO: 536424 - DNA, 399 bp, Homo sapiens
ggagacaggttcctggtgtcgtaatcgactgtctgaacgctggagccgttgctggtgaagggagtgaaggtgggtttgctgctcatgctcaaagtgaccattagcagcaggttgtcctggtcgataatgcgaggaagcaacaccatgttgaacccgctggtgatcgttgcgggagtcagcgatgtggaagatccgaccgaggccgctgtggtagtagagcttgaggcaatatagctttgcacgttaccgacttggataggtgcaggctgtaaattcaaagttgtgatcgagggcgaacggatgtttgaaacgcgatactgttcagatagcgctttaatgatcagattcgagccagcccaaggtgacttggaggtatctaaaacattgaacgagctggag

SEQ ID NO: 536425 - DNA, 88 bp, Homo sapiens
gcggccgcctactactactactactgctcgaattcaagcttctaacgatgtacggggacatgaggaaataaatgtgggttgtgctgcc

SEQ ID NO: 536426 - DNA, 228 bp, Homo sapiens
tctctgcgatcctatcgatcggtgatccagcacctccgcctccgggttcaagcattctctgcctcaccctcctgagtagctacgattacaggcacccccataccctgctcatttttgtacttttagtggaggtggagtttgaccactttggccaggctggtctcaactcctgacctcaggtgatccgcccaccttggcctcccaaagtgctggatcagcggatcgagt

SEQ ID NO: 536427 - DNA, 309 bp, Homo sapiens
  misc_feature (41)..(41): n is a, c, g, or t
ggtgcgtaatgaggtgggacgccatgtacaaagaaagaaanaaaatcctgagtgcctacctacgtggggatcattccttacatcacagaccaaccttcacttggaagaagcctctgaataaaacctgagcccggggggcttctgtttatctttgggagacgcatttattaaccaaagttattctttctggatctgccgggtccttataaagtggatgaaaaatgttttgtacccatctggaaaaccaacaacttgaaatctcaggtatttcatgtcaggggggggaatttgaaaatatatctatctgta

SEQ ID NO: 536428 - DNA, 910 bp, Homo sapiens
  misc_feature (239)..(239): n is a, c, g, or t
tgcgtctgtgatctgtaggttgtgaggagttgtgtatatgtgtctgtttgcttgtgcctgtgttggttctgtatgtctcgggtgtgtacgtgcgctgttgcgtatcgctctgtctgctggctgtggttgttggtggtgtctgctggcttattggcttggcgttggatctgtcgcgattgtctggcacaggttctgtgtgtgcgtccttctccaagttttttcccccggtttccgcccgnttcccggggggggtaccccgttctcccccctctcgccggggttctcccccccccccccgttaagtttggtggttaccgcgcctcctaatgggcgcttttttgccccgccatctcgtgtggactcgggccccgccagatctctttttggccggaggaactcgcgcccccgcaaacccttcttgtgtgaccggcgccccgtagatttccaatgttctcccgttgcgcggttcccggagcaaattcctccccgggattttgcgcccctatcttgcgcgccgggggaacacacctgtgaaaattggactcaacttctccttcctgcgttgaaatatgttatggccgcgcccctctcctatgggctttcttctctctcccgggggcgcgccaaaattcttttggtggggcccccccgctgattttccgagctctgtactctccgcctagccacaacactcctggggcagcagccccctagtctcagtactcctactgggagggcgtattcccgcgtattagccactgcccccccctcacccgcggtttttcttcacgccattgactattttgtttggtcccgttgcaattgttgctgtcgccctcctgcacgcccgccccccccccttttttccgcgacgggggccaccacccccctgggaaaccccaaaaaaaaa

SEQ ID NO: 536429 - DNA, 518 bp, Homo sapiens
  misc_feature (157)..(157): n is a, c, g, or t
tctagaggtcccgtacaggccgcgttcaggccttggtcactcaatgactccagttctttaataaacagtaagacaggaagtctcagccatgggactctggagacaggtgggaggaatggaggatggaagcaggacagccaacttcagaaggccaggnaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggggcttgtacgcgtacaaggcccggccttagagccaatccttatcccgaagttacggctccggcttgcagatttcccttacctacattgttccaacatgccggaggttgg

SEQ ID NO: 536430 - DNA, 319 bp, Homo sapiens
atctgtctgtgattttggaggctggcttcaaataactgatatatgactgcctattcatatttaaggggaagcactacaagctcattgaaagctctttggatggtctagattagttgactggtggacttccctcgtggggaattgttatctacctggacttttgttgggggacctgaaatggcggggttttggtaggggttttttcgagtcatttactttagagaaaaatcctccaagttccttcttggaggatatgagtctattgccactgtactgagaacaaattctgggaagggcatatcttgagagagggaaggat

SEQ ID NO: 536431 - DNA, 463 bp, Homo sapiens
  misc_feature (28)..(28): n is a, c, g, or t
  misc_feature (64)..(65): n is a, c, g, or t
  misc_feature (78)..(78): n is a, c, g, or t
  misc_feature (99)..(99): n is a, c, g, or t
  misc_feature (121)..(121): n is a, c, g, or t
  misc_feature (129)..(129): n is a, c, g, or t
  misc_feature (218)..(218): n is a, c, g, or t
cgggaggttcacccggcattaaagaccnaaggtagattaattccatggaggggggggaaaaccnntgccaaaagggtngaaatttccaaaaccaggaancctttttttcttgcaaaggatnacaattcnttgccagcaagagaacaaaactggatggagaatgagtttgacgaatttacagaaggaggcttcagaaggtgggtaataacaaactcctntgagctaaaggagcatgttctaacccaatgcaaggaagctaaaaatgaaaaaaggctggaggaattgctaactagaataaccactttagagaagaacataaatgatctgatggagctgaaaaacacagcacgagactttcgtgaagcatacagaagtatcaatagctgaatcgatcaagcagaagaaaggatatcagagattgaagatcaacttaatgacataaagtgtgacgtcaagattagag

SEQ ID NO: 536432 - DNA, 978 bp, Homo sapiens
ggaagaggaagatgaagaggaagaaatcgacgtggtcactgtgggccttgtggtcgcctcctctgatatcaatggtgtcaccagatggcaacatcggtgtgcgtgccacgaacgcagtcctgggtcccgggagggctcgagtccacacgaggtgatcctcaaatggatgccttgccatccaccagcagcacaatatgccgccccctctccctacgtgtgagagtgaggatgctagcccgctacagaagatgataaagagcgaggcgtccccacgtccgctcaagagtgtcatccaccccaaaggctagagagcttgagcccccgaaactctgactcggaggacagtgagcgtcgcagaaaccacaatcatcctggtagcgccagcgttcgcaaggaccttcggtccctgctttctcacgctcagggaccgacgtgccggagttggtcacacgaatgagaaggccgccaaggtggtcgttttgaagacagggcacgtgagtatgtccactccctccaaggccgaggagacaccagctttttgctggaacaggaagaattgcaggcgagacagcagcagttggtacttgaaaattgagcagcgctcggacttgctagaggcttctcaaactgtgcagtcactgcaacttggcacatttgatattgtcgagccaaacgttgtggttgccttaaagaagtgtgggtttacttcaaatcggtcccgtgtcagagtccggcaccgggtgggcagagagcaccaagtggggtctgtggaacgttgggcagctgaacccatgtgttgtggcctttcatctcaccttactcctgatatgggctacgtggacgagggaccttggggtgtagagcctggtgtccagttcgacacaaggcgtcttttaaggcaccgggagcaaggtgctcccggaattaacggccgcttacggaagagggggaagacaataaacaggaatcagactaaca

SEQ ID NO: 536433 - DNA, 888 bp, Homo sapiens
agcggaactctagagagggactgggagcagcagagatggagctaggtaccgcctcttcagagagcccaagccttagtttgtgaagccgagatatccgatgatgccacaggggccggtagctgatccgcgtcaacgttgcgtgtatggtgcaagggcaacaggagaaaatgtagagaaccccgagtgagcatggctatgggaggggaggggatggctgggtgcttgatggatcgcaagtgtgggggtgcttaggtccatgggaagttgtagtcacgttactggattgtatggactagattattcgaatgacagcgcacgtattgaactgaacttaactcgggaggagacgggcaaagcaaacgtggaccgagagttaaacagagggacacaatggtgtaattgcccgaaccagtcaaaccatagctgaccgtgtgcctatccagagagtgctaccgaatgagaactccagaaaagtgtgcgacagggatagcccaacagtgaccaaccacatggagacactacgcaagacaagggggagcgccccaccagggagtaagacagatctatcaaagtacgctcaaacgagggctagagagaaaaaaccccacatggcattagccacacgaaaagcacgtcaggcaatttgcacggggaacacctgagaaacaggcccacactcgtgctgaacaaacaagaacgggtctcccagacatacccatatcacacacaagcgtagacgtgtcagagaaactcacatatgatgggagaaatggaaaccgccttagggcgtcaggcacgacacttacgaatacaaggaccaacctgggatacacgacaacatcgatgaagcagagtgaagcaccttgtgacagatgagggccaacacag

SEQ ID NO: 536434 - DNA, 259 bp, Homo sapiens
ttgaccccgacgagatcgccttcccgggttaagtgacatctttacgcaataactctgcgaacaacggcttgtcactggctcaggttgatcccaaggtcgtcgaagaggtgtgggactttgccgagcaagcatcctggtgagcagctcaccctctccctcgagaatcggacgattaaccttccgggtcgcacgacctacccgttccatattgatgacgtcacgcgtcagcttctgctggccggtcaaattccatttcaaa

SEQ ID NO: 536435 - DNA, 246 bp, Homo sapiens
tcaatttctacactctaacgaacatttaaatatgaactaataccaatcctactcaaactactctgaaaaacagaggaggatggagtacttccaaactcattctttcaggtcagtatgactgtgatatcaaaaccagacatctttgaactggttttggtaacagggtcatactgacccgaaagaatgagtccggaagtgtgtgtgtgtgtgtgtgtgtgtgtgtgtgtgtgtggtgtagaaattgaa

SEQ ID NO: 536436 - DNA, 370 bp, Homo sapiens
  misc_feature (68)..(68): n is a, c, g, or t
  misc_feature (73)..(73): n is a, c, g, or t
  misc_feature (77)..(77): n is a, c, g, or t
  misc_feature (80)..(81): n is a, c, g, or t
  misc_feature (85)..(85): n is a, c, g, or t
  misc_feature (93)..(93): n is a, c, g, or t
  misc_feature (106)..(106): n is a, c, g, or t
  misc_feature (125)..(125): n is a, c, g, or t
  misc_feature (152)..(152): n is a, c, g, or t
  misc_feature (168)..(168): n is a, c, g, or t
  misc_feature (173)..(173): n is a, c, g, or t
  misc_feature (175)..(175): n is a, c, g, or t
  misc_feature (185)..(185): n is a, c, g, or t
  misc_feature (211)..(211): n is a, c, g, or t
  misc_feature (230)..(230): n is a, c, g, or t
  misc_feature (261)..(261): n is a, c, g, or t
  misc_feature (300)..(300): n is a, c, g, or t
  misc_feature (326)..(326): n is a, c, g, or t
  misc_feature (333)..(333): n is a, c, g, or t
  misc_feature (357)..(357): n is a, c, g, or t
  misc_feature (366)..(366): n is a, c, g, or t
ctcactccttaaattcacactttgccacttaactccagtgtggatgacagagcgagaccctgcctcanaaaanaaanaannaaanatttgttngccacacttattnttttcagtaacctgctagngcacaggctgtactttaggtacttaanatatgcactagaatanttttncnaggccctaanatatcactgttatttttggagtaatncagtataggttcgtttaanagagatttttataacttcagacatgcatcantaggaaataacttgagaaattcatatggttatttacaanttcatattctgttactacagtaaacnttaaggnttttatacagttaagattgtacanttttttttntttt

SEQ ID NO: 536437 - DNA, 289 bp, Homo sapiens
catttcataccattttattgctgaacagtattccatggtatgggtgcaccacagttattttaaccattaactcatggaaggacatttggattgtttccagatattgaccattataaaataaactgctaagaacattcacgtacatgcttttgagtggggataagtttttgtttctctagaataaatgcccaagagtgcagtggctgggttgtataataattatatgttggccgggcatgcatgtcacgcctgtaattccagcactttgggaggcgacgacgggtggatc

SEQ ID NO: 536438 - DNA, 125 bp, Homo sapiens
gaggaagcctgggaaggaccggtgtgctcggagatgatcggggaaagcatagtcccctgtctgcggcaccagacacttcttgttgcttcgctgtttctccccgcccagccagcatttttttccag

SEQ ID NO: 536439 - DNA, 144 bp, Homo sapiens
ggtagtcctaccgagtatatagtactctatgatgtctaatatctaggattcataaaataacatttctggtaattctgacatactaatagtcactcaagcagtaccatttagttacagttgggatatattttcgactgtatggaa

SEQ ID NO: 536440 - DNA, 136 bp, Homo sapiens
aaaattattttcacagtcccccccaactctcattgcgtcgttaaagtccctccaatccttttttagttgtgaaaaaataaggggcctttaaaggaggaggaggaaaaggggaaaaaaacccataatgggcctaaaa

SEQ ID NO: 536441 - DNA, 461 bp, Homo sapiens
  misc_feature (166)..(166): n is a, c, g, or t
accctgagcactggcaaagcccaaaaccttcaccctgaaaggttcacggttagagcccggcagcaacaccggccctttaagtaccttccctttggggccggcccccggaacttcctcggggggggtctaaggctgctttaggtcaaatttaccctgctccccgtgntgcccaagtttcggttccaaacctgcccttaaacccagggccccctgcagctaaaatcccaatttgccctaggtcccaaaaatggggtttatatccaaattgtattcccctttcccaaaaaggtttcgggtgggggggagggccccccccaattcaaaaaaaaccctaagtgtggatgttcaaaattttggaaaaatgtcccttaagtgatttaaaaagggcctggcctgcaaggataaaaggtttttttcaaaacctttcctaaaagcttaaaaaacgtttgttgcccttggga

SEQ ID NO: 536442 - DNA, 528 bp, Homo sapiens
ttgggtctccattcggggtgtaccatggggtgaccgatactcgggtggcagactcaggcaacatcagagagaaggaccggtgctgcgtcagcgtgtgccaggggtacagtgcactgagggcccaggaaaccttcatgcaaggggatcagggccggcggttctacaacttcctcagggctgacaacatgaagaagatcatcctctcgcacaggcaagctctttggggagaccatgtaaagaaaccccagagccggaaagacacggactggagccggctctacacagaaacatccctgatgcagatggatgacaaggtgatgaggaagtttcagggttataactccctgaaggaatactatgaggaagaaagttgcatgcggtacctgcacaggatttatgtccctctcatgcgggttaatgcagctgacgatccgtgggtgcatgaaagtcttctaaccattccaaaatctctttcagagaaacgagagaacgtcaggttggtgctgcctctgtgggggctccattcag

SEQ ID NO: 536443 - DNA, 124 bp, Homo sapiens
tgtgtggtatggatgcttagtgcctcacttcgttctgtctatactgccccatctgagcagccatagctcaccatcagatcaacctttgattttacatcgtaatgtattcaccactggagctcac

SEQ ID NO: 536444 - DNA, 208 bp, Homo sapiens
  misc_feature (166)..(166): n is a, c, g, or t
tcatgctgcatcgaagaagctggtgatcgttggggatggtgctgtgggagacctgcctcctcatcgtcttcagcaaggatcagttccggaggtctacgtccctacttgtctttgagaactatattgcggacattgaggtggacggccagcaggtggagctggctcntgtgggacacagcagggcaggaagactatgatcgaatgcggc

SEQ ID NO: 536445 - DNA, 360 bp, Homo sapiens
  misc_feature (22)..(22): n is a, c, g, or t
  misc_feature (25)..(25): n is a, c, g, or t
tcggtacccgaggatacatgtncgngaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgggctgtcgggtctagtcggggatcacgatgtccgtgttactattatccacaataatattacacccggacgtgagtctctctgcaaatcaccgtaactgta

SEQ ID NO: 536446 - DNA, 717 bp, Homo sapiens
agcggagtctgcatctgagtaacatggcggcggcggggtatccaggctgtggtggggcgggatcttgggggcgctcggcgctgaccgatgggactgggcgacctccgttctgttgctgccggtgaggcgggagagcgccggggtcgataggcgccccagtgtcagtaccacggaatgatgtggccgcacagagtcagctctctaggcttgatggaagagtatgtggctgagatcttgtgcgcaagttatgtccacacaatgttcaggtgtgccttgcttcggatgatgttagaaggtctgtatccatcctgatggcgtcatcccagtgctgagtttcctcagggatcgcactcagtgtccacagttcatacatctctggttgattgtgacagtagtggacagtcccaacgtctggctaaaaccgtgttgtgacgatttgtctacaaccatgttgtctctgcgcattcaagtcacaggagtccgtgtgaagatgctacagcgagatagagacgtgacagcccattgagtctgcgtgtctctgtgttcagaggcagacaagtggtatgaaagggagatctgggagatgttgggagtcttcttatgtaagcagcctgatctaagaaggatcctgacagattgtggcttcgagggacattctttctggaaagactttcctctatctggctatgttgagttacgttatgatgatgaagtgag

SEQ ID NO: 536447 - DNA, 942 bp, Homo sapiens
actctaccatcttgcaggcacactcatcacagggctaagctcgcactgaattttttacctgagtaggccatagaaataaacatgctaagctttttattccatgttctaaccgaaaaaaataaaccctcgttccgacgcgaagctggccattcaagtattatccgtcacgcaagctagaccgatccatgatccttcgtaatagctagtcctcttcaacaatatacatctccggacgaatgaacgcatagaccaataactaccgaatcaagtatctacagtcattaataaatcatgaatggctatagcaataaaactaggaatagccccgtttcacttcgtgagtcccagaggttacccaatggcgacccctgctgacatccgggctggcttcttctcacgatgaagaaagactagcccccatctcagtcatataccaaatctctccctcacggtaagcacgtaagcctatctctctgcacctctctcaatctgatccatcatagcaggcagtcgaggtggattaaaccaaaaccagctacgcaaaatcttagcatactcctcaattacccacagtaggatggataatagcaattctaccgtacaaccctaaataaccattcttaatttaactatttatattatcctaatagtaccgatttcctactaatcaacttgaaactccagcaacacgacctaataacgatctcggcagctgaaagaagctaacagtgaataaacccttaattccatccaagccttctctccctaagaggcctgcccgataacgggtttggccacaatgggcattttcggagaattcgcagaaaacaaagggttatattccacgattataaaccagaactcttagctctatttactagcatacgtcgcctcacaagaagagcccactcacacaggagaaaagagcgcggggcaaacccc

SEQ ID NO: 536448 - DNA, 162 bp, Homo sapiens
  misc_feature (22)..(22): n is a, c, g, or t
  misc_feature (25)..(25): n is a, c, g, or t
  misc_feature (144)..(144): n is a, c, g, or t
tcggtacccgaggatacatgtncgngaggatcacgatgtccgtgaggatcacgatgtccgtgaggatcacgatgtccgtgaggatcacgatgtccgtgaggaaaaattacctgtcttgactgccatgtgttcatctctaagtanttgtaagctgctatgtat

SEQ ID NO: 536449 - DNA, 687 bp, Homo sapiens
cgattgtcataaccccgataaactccggttgcctggtttgtgcaaatagaaccccgacagcgttgttctttcttacaaagaaggtaaaaggatgacttcaacaagaatgacattatgtgcgggggaagaaatgacaccatcgcgttaacaacgctcttttcggtgcagcgatgaatcgatggggcacccgccccttgcccccgctgttggagatacttctcctgtgctgtatactcagcccaaagaggagcctccacgcttttcggatgggccccacgctagatggtgtgttccccggaatttttcccactctgctaaataatttttacatcggccttggcttgtttttagaataaattgttattgtttttatggggagaagcgtttaaaaattcgtgtaataggtagcatccttcgtcagggcgaggtttattagaagggggatagataacattcacctctcgataagctactaagtaatagcaggctctccgtctagacaccaagtctctattaaaatatgtctgtaggccactactactatttagcgaaatatatacctactaatatttatcctattcacttttgagaaataattgtaaattaatcgattactcccttcttccaaaaataataaaactctcttttttacaccctcttctcgcccaacaaataacaaaacaacat

SEQ ID NO: 536450 - DNA, 743 bp, Homo sapiens
  misc_feature (22)..(22): n is a, c, g, or t
  misc_feature (25)..(25): n is a, c, g, or t
  misc_feature (478)..(478): n is a, c, g, or t
  misc_feature (494)..(494): n is a, c, g, or t
  misc_feature (511)..(511): n is a, c, g, or t
  misc_feature (549)..(549): n is a, c, g, or t
tcggtacccgaggatacatgtncgngaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgaggatcacgatgtccgtgttccttactaatgttagtaaggaacacagacttgattagagttcttatctcacttagcttttgtgagatcttagcctccatttagaactgttttgaggattaagtgaggcaacataatgtaaaacacaaatgtgaggtaatataagtgtatatacctccggtttgtctgaattagaaacccttggaaatgggcgccgggcgccggtggctctacgccntgtgatacccagcgcntttgggaggcgcgaggntgggaggatcacacaggtgcgggagatgcgagaccatncctggctaacacgggtgaaaccccgtctctactaaaaatacaaaaaaaaattagccgggtgtggtggcgggcgcctgtggtcccacctactcgggaggctgaggcgggagaatggcatgagcctgggaggcagagcttgtagtgagccgagatggcgccactgcactccagcctgcgacggacatcgtgatcct

SEQ ID NO: 536451 - DNA, 280 bp, Homo sapiens
gttgattgaaacatcagaggatgttgtgatcaaatattcgagatcaatctccacgagatgtgagatgcacgatggtggtcgtcacacggcggagatctggcccactgcagtgccaactgctgatgcagacacgcctggagaacaaagcagtccccagcccctgggtctgtggcagcgaggtgtccgccctgtaccccagggatgtgtcggcactgcacaggctcagggctcctgagtggggtgacacggggaggctgggccagggctccaggctccagtc

SEQ ID NO: 536452 - DNA, 852 bp, Homo sapiens
  misc_feature (2)..(2): n is a, c, g, or t
  misc_feature (20)..(20): n is a, c, g, or t
  misc_feature (76)..(76): n is a, c, g, or t
  misc_feature (99)..(99): n is a, c, g, or t
  misc_feature (119)..(119): n is a, c, g, or t
  misc_feature (341)..(341): n is a, c, g, or t
  misc_feature (444)..(444): n is a, c, g, or t
  misc_feature (590)..(590): n is a, c, g, or t
  misc_feature (629)..(629): n is a, c, g, or t
gnttgggggggggggcgtgncttttatttttttttgggtgggggggggggcgggggcgccgccctcccctctcaanccaaaaaataacacctaccactnatatgttatttctttttttnttcactcttgcgaggtgttggggcgtacacccccccaaaaacaaaaagcatttattattatatctatttaacccttgttgtggtagaagtataaaggaaaaaaaaaaagatcaccccacacttgcttctttgtttgtttgttgtatttataagcgaggcgccggggggctgacaaaacaaacacccaaaaaaagagagaagagaaaaatacataataatacncctgtcgttgggtccggggccggggcgtctctatttatcataacaaagagtaacgtccattactgttctctcttttttgtgtggcgcgggtgtggtggcctcnatggcacccaaaaaaagataataaaaataaaaatttcacttgctctctccgtggtgtaactagatttgttttctttctacccctcctaagtgataaaacaaacgtgagagcgggcggggcgagcccctgtcgtcgtttagctggtngtggtgtgatatagccaacaacggccctcctcttgtgcntctttttctaacaaaaatatcaacctattatttcttttgtttttgtaataatgaaagaagaaagaaaaaaataaatacagaatatatatttgtttagataatgaagcgtagggggctctctctctcctctctcattaaagaaagataaagaggagtaataggagcggagtaccaaccaatataagagtgagggatgtaggtttctcagctatcctctcttccc

SEQ ID NO: 536453 - DNA, 934 bp, Homo sapiens
  misc_feature (6)..(6): n is a, c, g, or t
  misc_feature (76)..(76): n is a, c, g, or t
  misc_feature (94)..(94): n is a, c, g, or t
  misc_feature (102)..(102): n is a, c, g, or t
  misc_feature (119)..(119): n is a, c, g, or t
  misc_feature (122)..(122): n is a, c, g, or t
  misc_feature (152)..(152): n is a, c, g, or t
  misc_feature (198)..(198): n is a, c, g, or t
  misc_feature (306)..(306): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (431)..(431): n is a, c, g, or t
  misc_feature (433)..(433): n is a, c, g, or t
  misc_feature (460)..(460): n is a, c, g, or t
  misc_feature (466)..(466): n is a, c, g, or t
  misc_feature (535)..(535): n is a, c, g, or t
  misc_feature (548)..(548): n is a, c, g, or t
  misc_feature (567)..(567): n is a, c, g, or t
  misc_feature (589)..(591): n is a, c, g, or t
  misc_feature (598)..(598): n is a, c, g, or t
  misc_feature (601)..(602): n is a, c, g, or t
  misc_feature (606)..(607): n is a, c, g, or t
  misc_feature (609)..(609): n is a, c, g, or t
  misc_feature (647)..(647): n is a, c, g, or t
  misc_feature (653)..(654): n is a, c, g, or t
  misc_feature (663)..(664): n is a, c, g, or t
  misc_feature (671)..(671): n is a, c, g, or t
  misc_feature (674)..(674): n is a, c, g, or t
  misc_feature (695)..(695): n is a, c, g, or t
  misc_feature (700)..(700): n is a, c, g, or t
  misc_feature (712)..(712): n is a, c, g, or t
  misc_feature (716)..(717): n is a, c, g, or t
  misc_feature (733)..(733): n is a, c, g, or t
  misc_feature (739)..(739): n is a, c, g, or t
  misc_feature (744)..(746): n is a, c, g, or t
  misc_feature (752)..(752): n is a, c, g, or t
  misc_feature (756)..(756): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (773)..(773): n is a, c, g, or t
  misc_feature (783)..(784): n is a, c, g, or t
  misc_feature (794)..(794): n is a, c, g, or t
  misc_feature (804)..(804): n is a, c, g, or t
  misc_feature (806)..(806): n is a, c, g, or t
atgttnttcaaccccgaggagtcggagctggacttggactacggcaacagatacaagaacgtgaagctccctgacncctacgagcgcctcatcntggacgtnttctgcgggagcccagnatnttcgtgcgcagcgacgagctccgtgaggcntggcgtattttcaccccactgctgcaccagattgagctggagaagnccaagcccatcccctatatttatggcagccgaggccccacggaggcagacgagctgatgaagagagtgggtttccagtatgagggcacctacaagtgggtgaaccccnacaagttctgagccctgggcacccacctccacccccgccacggccaccctcntnanaaccgcccgaccccgagtcgggaggactccgggaccattgacctcagctgcacattcctggccccgggntntggccaccttggcccgcccctcgctgntgctantacccgagcccagctacattcctcagctgccaagcactcgagaccatcttggcccctccagaccctgcntgagcccaggagntgagtcacctcctccactnactccagcccaacagaaggaannntgagggngcnnattnntntgtcccagagtttattggccactgggtttcactcctgngtgggnncagggtggnngggaggnacnagggggaggaaaggggcgagnacccncgtgagagaatntgcnngtggccttgcccgccngcctcngtgcnnnttgacnttcnttgtcaccngcnacntntcgagccccnnggatgtcccntgtcccaccnantctgcactccatggccaccccgtgccacccgtaggcagcctctctgctataagaaaagcccggacgcagcagctgggacccctccccacctccatgccctgcccatttaatccgccaaccagcccaca

SEQ ID NO: 536454 - DNA, 174 bp, Homo sapiens
ttcctttttaaggttttgtaggcaaggggggccccctgacttcctgggcccgggaatttaacccgtttttaaggttttgcgggaaaggccctttttccaaggggtttttccaaatggcccaaggggaaagcccaacagggggaggacccttaaaaaaaaaaaaaagccccttta

SEQ ID NO: 536455 - DNA, 183 bp, Homo sapiens
agctgatcgacgaggcggcctggcccaggcggtcgccatgcgcgccgtctcaggcgtcggtctggacgtgttcgagaatgagccggacatccaccccggcctgctgggccagcccaatgtggtgctgttgccccacctgggttcggcgacgcttgaggcgcgtcaggacatgggcgaccgggt

SEQ ID NO: 536456 - DNA, 461 bp, Homo sapiens
tagctgggtgtggtggtgggagcctgtaatcccagctactcaggaggctggggcaggagaatcacttgaatccaggcgggggcggaggttgcagtgagccaagattgtgccattgtactccagcctgggcaacaagagcaaaactccgtctcaaaaaaaaaaaaaaaaaaaaacgcagaggttgggcacggtggctcacacctgtaatcccagcactaaaaaagcgcagaggttgggcacggtggctcacacctgtaatcccagcactttgacaggccaaggcgggtggatcacctgaggtcaggaattcaagaccagcctggccaacatggcaaaaccctgtctactaaaaacataaaaattagccaggcatggtggcacacacctgtaatcccaagtagctgagattacaggcatgtaccaccatgcccggcccacagagttttctcttaaataaattt

SEQ ID NO: 536457 - DNA, 549 bp, Homo sapiens
gtgttctagaggatcctgaaaggatccctaaccagaccttccaaaactatgtggaataggaggggggggagagagcatcgtggtctggtggtgctttgcaaagggaatgtttcaaggcttttggcccattcagtatgatatgggctgtgggttggtcgtatgtgtctcttttaatttggaggtatttccttcaatacatagtatatggagagtttttaacgtggaggggatgttgaatttaattggaagaccttttctgtgtctatggagataatcatgtggttttggtctttagttctgttaatgtgatgaattacatttatggattggcgtatgtggaaccaaccttgcatcccgaggataaagccaacgggatctggggggataagcttttggatgtgctgctgggttcagctggccagtattatatggaggatttttgcatcaacatccatcagggatatcggcctgatgtttcctttccggcagtatcttggctaggtaagggaatcaggatgtcgctggcctcataacctgagtcagagacca

SEQ ID NO: 536458 - DNA, 363 bp, Homo sapiens
tgggtacgaaggtctacaaggatataaggacttgaaaatcattaggagagcctatttgcaatatttaaaaattataaaacaggaccaggcatggtggctcacatctgtaatcccagcaccttgggaggctgaagtgggcggatcatgaggtcaggagtttgagaccaacctggccaacatggtgaaacctcttctctactaaaaatacaaaaaattatccaggcatggtggcgggcacctgtagtcccagctactcgggaggctgaggcagtagaagcacttgaacctgggaggcagaggttgcagtgagccgagatcgtgtcactgcactccagcctgggtgtcacagtgagaatctgtctc

SEQ ID NO: 536459 - DNA, 404 bp, Homo sapiens
atataatcaaaattgctgaactctgttcaatcttcattgtaaaaagcagcttcaaagctgagtagatatctatagtcaaatgtataacgaagctttatacttatcaatttctttttagagcagggggcatgggctgaaatacatcttgtgctcaataaacctccccacaccaatatttcaaagcactttctaggttacaataatgacatttcaattccatatacgcatacatagaatatatattattaaacagagtgggtcttaagagtatacttggaaccctcggagtcctccatggacaagaacagggtggcccttggactatccagccaaaggctccactgtggggctagctttggggagagactcacagctggacttctctatccgaccatgtacgagaa

SEQ ID NO: 536460 - DNA, 135 bp, Homo sapiens
ccgcacggcgcataggcagtggtccccggcggctcctgcacgtagaggtgtattcaagtcgcagtcaaagtatatcttgcagtgcatggcaccacggtgcttcgaggatgaggcccgggcagccagggccggcgg

SEQ ID NO: 536461 - DNA, 1200 bp, Homo sapiens
  misc_feature (146)..(146): n is a, c, g, or t
  misc_feature (216)..(216): n is a, c, g, or t
  misc_feature (233)..(233): n is a, c, g, or t
  misc_feature (884)..(885): n is a, c, g, or t
gagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaanctgtgaagtcatccaaaggtggtcccggatcagcggtgagcccctatcctaccttcaatccatcctcggnatgtcgctgccttgcantaaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggtgttttagctctgctaaaaatctccagcgcaatttgatgctgatgaacttcgtgctgccatgaagggccttggaatctgatgaagatactctaatggagatttgggcatcaagaactaacaaagagatcagagacattaacaggggtctacagagaggaacttgagagagatctggccaaaggacataacctcagacgcagtctggagatttcggaacgcttgtgtttcctctgtgctaaagggtgaccgatctgaggacttgtgggtgtgaatgaaagactgtgcgtgattcagatgccagggcttgtatgaagcaggagaaagggagaaagggggacaaggaacgtaaacggtgttcaataccatccttataccagaagctatccacagattcgcagagtgtttcagaaatacaccaagtaccagtaagcatgacatgaacaaagttctggacctgggagttgaagggtgacattgagaaatgcnncacaggtatcgggaagagcgccacaagcaaaccagctttctttgcagagaagcttcatcaagccatgaaaggagctggaactcgccataaggcatcgatcaggaatatggttccccggtctgaaattgacatgaatgatatcaaagcattctatcagaaaatgcatgggatctccctttgccaagccatcctggatgaaaccaaagggattatgagaaaaccccggtggctctttgggggggaaaacaaacaaccccttgaagggctcaagctaggatcagaagaacctaaaataaataatcccatacccagaag

SEQ ID NO: 536462 - DNA, 694 bp, Homo sapiens
  misc_feature (146)..(146): n is a, c, g, or t
  misc_feature (216)..(216): n is a, c, g, or t
  misc_feature (233)..(233): n is a, c, g, or t
  misc_feature (378)..(379): n is a, c, g, or t
gagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaanctgtgaagtcatccaaaggtggtcccggatcagcggtgagcccctatcctaccttcaatccatcctcggnatgtcgctgccttgcantaaggccataatggttaaaggtgtggatgaagcaaccatcattgacattctaactaagcgaaacaatgcacagcgtcaacagatcaaagcagcatatctccaggaaacaggaaagcccctggatgaaacaacattgagaaatgcnncacaggtatcgggaagagcgccacaagcaaaccagctttctttgcagagaagcttcatcaagccatgaaaggagctggaactcgccataaggcatcgatcaggaatatggttccccggtctgaaattgacatgaatgatatcaaagcattctatcagaaaatgcatgggatctccctttgccaagccatcctggatgaaaccaaagggattatgagaaaaccccggtggctctttgggggggaaaacaaacaaccccttgaagggctcaagctaggatcagaagaacctaaaataaataatcccatacccagaag

SEQ ID NO: 536463 - DNA, 580 bp, Homo sapiens
gcaggaagccagagactatagatagtatgtaagttaaaaggagaagaaggccaagattgcctgggtccactcttgtaaagttgtagaagactggaaatctccctagctcctctctttcccttcgccctccagagcccccaagccccacccccaaatacttgtttcctttggggtatctccatcctgactcttgcagctggggtactctctaggagtatgttttaatgtttgtagcctcagctcagaagaaggctcaacccaaacctactccctgcctttctgcctggggctgccttctctccagagcctccttccattgcacccaggaatcattgctgtgaaagaacatcatagcttggaccccatgtaagccctaaccttggtccacttgtgggagttctctgatagctctttttatttttttagataaaaaaaaatgttttaaggcaagttctcactatgttacccaggctgagacaggagaatcgtttgaacccagaagacagaggttgtggtgagccgacatcgagccattgcactacagcctgggcaaaaagagtgaaactccatctccagaaaa

SEQ ID NO: 536464 - DNA, 852 bp, Homo sapiens
gccgagccctcttggtccggcgctggccaaagccgtgggtcgtcgccccggagccgtggcttagggtcctgggcggttccacccgtgggggagcatccaaggcccagccccggtgggccgttcacgcaccgtcgtgcctcgtggggcaactgctgtgcgcgtgggcgccccggagtgttgtttgtgccagggccaccgggacgagtgttcgacccaagcgctgccggcgccccctgtctgggccctgtcgtcccaagccccaagtgcggtcccccgtggcgccccgggcttgttcccccggtcccccccttccggccggtgatgtctcgccccacaatcccactgggtgtcggccccgacgacccgtgccgtgcgctccagggttcttgttgccccccacgggcagtattcccctcgctctgaggtgttggagagacaacccccatcgggcctcacccgcggaggtgcgactctctcgaggccaccggcctctgctcgcagtgtggtgcttcccctcccgcgcgcttgttctttgcgtccaattgccgagcggctccgctccgcggtacctaggaccacggggcgacaacaccagggaacagtttttacccacggtccctggacgaccgtagggcttcttgtgcccccccctgctgcccagagagcctccttcgcctgtcccgccggcagtactttggggcggcgagctcgcgggtaggctccccgctgtgtcccagggtttcatcctgtgtcccggggagctgtctggagcctagcccccgtctggtagaattcttccccgcgcccccgcggggcaagtatgcccccccccctccccccccaaccaagaca

SEQ ID NO: 536465 - DNA, 606 bp, Homo sapiens
  misc_feature (8)..(8): n is a, c, g, or t
  misc_feature (239)..(239): n is a, c, g, or t
  misc_feature (381)..(381): n is a, c, g, or t
  misc_feature (420)..(421): n is a, c, g, or t
  misc_feature (537)..(537): n is a, c, g, or t
aacgtccnacataacgaatgaacgggcggggggcatgatttatcctcttccgtcgccatgacccgcgataaccagcgtgagctcgcccgccagaagaatattaaaaagcagagcgactcggttaaggtaaagcgccgagatgacggtctttctgctgccgcccgcaagtattgggacgctgagatcatgcagcagaagcagaaaccctcttgccattcgcctgtgaacctgaagccagncctaccacggtcatgtttccttctgcagctctcacagcgtcccaggacccgttggctttctttttagacttgagatctgcagccgagcccctcccgggctggggttgcccttatataatccgctcttcttatgtcccactcnaggaccgcactccctttctcctcccctctctatttctgnngccgacagccaaacccctattattagaatcctccccccaccccccaaactccttcaagccttccctctgcttcccatccggctctaatgcagagtgtctctctacccagccgtccnttcttaaccacactctcttccccgcgacctgtaattcttttgtgagggcttctcctgttggcggatcat

SEQ ID NO: 536466 - DNA, 478 bp, Homo sapiens
cctcacagaagtgggtagaggtcagtccattgcaggaatatatatcgggagagcagtcccttggggctctgtatgctggtgtaacccagaggtaatgtgggtaccctttctgaagctgtcagtggctgtgactagcacccttatcatccctcactgccttggtgggaatagtagaggttagttttcctccagaccccctggcctgtgcctttcttatctatttactctccatgccagacagtaagctttgagggaaggaggagagagagaggtggtgaggatgactccgatgatcaggagtgggatattcctctgtcagagcacagaggggggtcatatcatcttttccctctcctatttggcccaggtgcttggaggaccgaccccatggctgagaatatgacggccagaggaacagagttggctccaagtgggaaagggtccaagcagtcagagaagatgtctgtgtggtttccct

SEQ ID NO: 536467 - DNA, 345 bp, Homo sapiens
ttttttttttttgagatggagtctcactctgtcacccaggctggagtgaagtggtgtgaccgtggctcactgcaacctctgtctcccggattcaagcaattctcctgcctcagcctcttgagtagctgggattacaggcacacaccacacacccagctaattttttacatttttggtagagacaggatttcaccatgttggccaggatggtcttgaactcctgacctcaagtgatccacccacctcagcctccaaaagtgctgggattacagacgtgagtcacagcacccagccaaaattaacatattattgaaacactaagtaacatctacagaacaatagtaa

SEQ ID NO: 536468 - DNA, 286 bp, Homo sapiens
ttcagaaagtttaagcatataaactttttatttttaacctgcctaaatccccggattcccaaacccggtgcctcctaattaatatatctttatatatttagcccaaagccgggaattttttatttccttttttaaaaaattatatttgtctcttagaggtaaaattttctttatataatattgtcatatgtcatagttttaaacccattcccatgatttctatgtttcttaatgatattttgttgtgtaaaattgatcggattgattaaaaaaccaattctctgga

SEQ ID NO: 536469 - DNA, 426 bp, Homo sapiens
tcacgccctgtaatccccagccacattgggaaagtggaagtttgggggggaatcagctgaggtcacgggttcgagaccagcctggctaacttggtgaacccctgtctctactaaaaatacaaaaattagctgggcgtggtggagcgtgcctgtaatcccagctacttgagaggctgaggcagaattgcttgaacataggaggtggaggttgcagtgagctgagattgtgccactgtactccagactgggcaacaaagtgagactctgtctccaaaaaataaaaaataaggccgggcgcagtactcacgcctgtaatcccagcactttgggagctgaggccagcggatcatctgaggtcaggagttcaagaccagtctgaccaactgcacccactccctaataaattcattctccttgggagcctcc

SEQ ID NO: 536470 - DNA, 848 bp, Homo sapiens
agcggaagtgcctggaagcggaagctggacagacgaggagaggccttgggtgtgacatcaacggaacctgagggaagcaaaactcagcaaggacgcgcccggtctgctggcctgtgggctttggcctttcaggttgcccaagagcaaagaaaagtggtatcaggatagcacagagcaaagaagataaagcaagatcaaagaacccatcaagggtgtccggtccccgggtgcagacggcaagggcccacatcactgggaagtacgcgtcccaatcgcagcgcctccgggtgccccttggtggccaagatggcagaaaagacgggtacctgaatggctcccagttctcctggaagtcggtcaagacggaaggcatgtccttgcccaagccaggggtgcgacgagtcaaggccaccgtcagcggcagctttccctcaaacaccggcagcttgttccaggatgcccgagagccacgtcaagcgatgacagaaggtaaagctttcttggagagccagatgcttgaaccattcaaacagcagggccaaggcaacggtatagaacaatgctgacgacaatcaaaacaggttaagatgaacgacaattcacagggacgctacatgacatccaattcccaagatggaagccggatctggattaaactccagaagtcagggtaacaatttaccacagatggagagcaacctgaagaccatcgaagaaggagaacaaagtggactgaggcagaggacacgagtttctcctccacgaactggggaacttgagaccagtctctgattcacacaggctggataaaattcatgttgcgaaattggatccaatccatgcaagaa

SEQ ID NO: 536471 - DNA, 596 bp, Homo sapiens
  misc_feature (388)..(388): n is a, c, g, or t
  misc_feature (450)..(450): n is a, c, g, or t
  misc_feature (537)..(537): n is a, c, g, or t
  misc_feature (559)..(559): n is a, c, g, or t
  misc_feature (568)..(568): n is a, c, g, or t
cggtccgggtgctcatgtgcatcccctttctttgtcttcagtgtaggcccaggatgcagtgctctcatctcaacgaacctaatttagacttgcctcccagatgagcctagaggtaacctagtggtggtttgcctaagtatggcccacagaggctcctgtatgtcctaatacttgatccctagttggtggaattgtttaggacagattgggaggtgtgccttgttggaggaggtgtgtcactgggaatgggtttaaggtttcaaaagtccattccaggcccaatctcccccagccccccactctctgacgaaactttggaatcagatgtggactgtcaggtattgctccagagctgtacctgtcttcctgtcttcctgtctgccgtgcntcctgctgtgacgaccatggactcaccctctgaacttgttaagcacatttcctttataaatncctaagtcatggtgtctcctcgcagcaatagaaacataataagacactagctagtccgtctgtaattaatgccagaagtccttttcngggtaatccaagcctgtcaagntgacaatantaatcccacagtatggaaactattatag

SEQ ID NO: 536472 - DNA, 756 bp, Homo sapiens
taattctagatcgcgagcggtcgccctttttttttttgttggtttttttatccataattccaactttaatttaaaatccaggggatccccgtgcaggttggtgacgggggtaaagttccttgggaatctggttttgggcccagggaatagtcttgtggccctgtaccctttaaaaaaacggggcatttaaaggtgcgcgtgagtaaaatagttgaaaatagctggggcacaggggcccaccgtgcacgacaacacataaaaaaaaaaaaaaaaaaaaaacaaaacaaacaaaaaaaaaaaaaaaaaaaaaaaaaaaaaaaaaaaaaacaaaaaaaaaaggggggggggcccaaaaaaatacccccggggggggccacaacacgcccacccttttttaaagaggggccccccaataagggagggccgtcctaaaaaacaacagcaaagaaccgcgggcggcgcggaattaaacacacaggccgcggggggagggaaacaaagcgcgcgacggcggtgcccctgttgaggaggcaaccccacctccggggggggggggagcaaacatgggggaacacaccacacccacagaagagttttaacgccgccgccaggggaaaaaaaacaacctcagagagttatacagggggtaaaccccccccgggaatatcagtacgcgtggacgagaaaaaaatatcgcccacagcagtgtctatttgcagacaaatttaaacgccgggaagcgtaaaaaaaacttgt

SEQ ID NO: 536473 - DNA, 902 bp, Homo sapiens
tgtttttcccgccctccaaaaccatatcttaagttgtgtgtttgccagcctggtatatttagtgattaaaaataaacccctttgcaagagacctggattatctgttctagtgttaactgttcaactttggtaagtcactccctctctctgaccctcaattttctcacctgtgaaatatggctgattccactttcctaagtaccttttcaagactgtgtgaatcttaaatgatatactttatatgaaatgttatgtagttactacatttttcaccttaaaagaagattatagtagagcttctttctgatacttatcttgaatacaatttgatataatgtctatgaggctgtagctctatgataacagggactatatctgtcttgcttgttattaattcgtcagatggcatatggtagcactcaaatatttatggaataaatgactagacaatgtggttatgtaagaaattcagaaggatgtcatattaaagtatagggagtaccatgatgtggcctgtctggaaaactgatcatagagaaacttttgcagttattaatatcaaagtaatatatctatgaacattatatagggcatcctggagatctttgctgtgattatttagaaagaaatattatttctgtggtctctgggtgtcagttattaattacattaaatctatttgtttgataaatacacttactgtggtgttatgagatggactaggatgggacagtggtcaggctgcatttggaagcgaagtaaagaagttaggcagaatatgaatacgaaggggatgaaaagatcatctggaaagaagacttaaaaaaagctgatgggggacttgaacagtctgaaacgagacagcagacaaaccgacgacacacgtaaacaagggggacaag

SEQ ID NO: 536474 - DNA, 302 bp, Homo sapiens
acaggaacaaagatgagtgtggcagagggagaggacctctcatgtgtaatactcagtacctgtataagaaaaaacaacaaggaagtacaaccaaagacaggcaggcagctggcgctaggccgaaaccaggcctgcgcctgcctggactaaacccagtagttgaaaatcaattcataacttagaaaccgatgttattcatagattccagacattgtatagaagaacatttgtgaaactccctgccgtgttctgtttctctctgaccgccggtgcatgcagcccctgtcacgtaccgcctgctt

SEQ ID NO: 536475 - DNA, 770 bp, Homo sapiens
  misc_feature (5)..(5): n is a, c, g, or t
  misc_feature (79)..(79): n is a, c, g, or t
  misc_feature (108)..(108): n is a, c, g, or t
  misc_feature (125)..(125): n is a, c, g, or t
  misc_feature (127)..(127): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (142)..(143): n is a, c, g, or t
  misc_feature (150)..(151): n is a, c, g, or t
  misc_feature (154)..(154): n is a, c, g, or t
  misc_feature (172)..(172): n is a, c, g, or t
  misc_feature (177)..(177): n is a, c, g, or t
  misc_feature (180)..(180): n is a, c, g, or t
  misc_feature (185)..(185): n is a, c, g, or t
  misc_feature (191)..(191): n is a, c, g, or t
  misc_feature (197)..(197): n is a, c, g, or t
  misc_feature (222)..(222): n is a, c, g, or t
  misc_feature (236)..(236): n is a, c, g, or t
  misc_feature (251)..(251): n is a, c, g, or t
  misc_feature (257)..(257): n is a, c, g, or t
  misc_feature (263)..(263): n is a, c, g, or t
  misc_feature (266)..(266): n is a, c, g, or t
  misc_feature (270)..(270): n is a, c, g, or t
  misc_feature (272)..(272): n is a, c, g, or t
  misc_feature (275)..(275): n is a, c, g, or t
  misc_feature (288)..(288): n is a, c, g, or t
  misc_feature (295)..(295): n is a, c, g, or t
  misc_feature (302)..(302): n is a, c, g, or t
  misc_feature (357)..(357): n is a, c, g, or t
  misc_feature (382)..(384): n is a, c, g, or t
  misc_feature (386)..(386): n is a, c, g, or t
  misc_feature (388)..(389): n is a, c, g, or t
  misc_feature (395)..(395): n is a, c, g, or t
  misc_feature (404)..(405): n is a, c, g, or t
  misc_feature (414)..(414): n is a, c, g, or t
  misc_feature (419)..(419): n is a, c, g, or t
  misc_feature (423)..(423): n is a, c, g, or t
  misc_feature (426)..(426): n is a, c, g, or t
  misc_feature (433)..(433): n is a, c, g, or t
  misc_feature (443)..(443): n is a, c, g, or t
  misc_feature (445)..(445): n is a, c, g, or t
  misc_feature (455)..(455): n is a, c, g, or t
  misc_feature (461)..(461): n is a, c, g, or t
  misc_feature (464)..(464): n is a, c, g, or t
  misc_feature (470)..(470): n is a, c, g, or t
  misc_feature (476)..(476): n is a, c, g, or t
  misc_feature (505)..(505): n is a, c, g, or t
  misc_feature (509)..(509): n is a, c, g, or t
  misc_feature (529)..(529): n is a, c, g, or t
  misc_feature (542)..(542): n is a, c, g, or t
  misc_feature (744)..(744): n is a, c, g, or t
catcnctttggaaggggacttactatactcagctcttacgctacccaaacagagaagccttctttttaaaacccaaggntaaggaccagtgaagaatagctccaattngacactagacacaaaanancttangnggnaaagnnagggggnngcngggggcggggggggaagngaganggnggagncccccngtcccngcctcactgttcctgcacgtgacanacactttccttgcnaacttattaataggngcgggngcatcnggnaaangnggncgaagcggcgaangccaggngtgaaanagtcctcccactgacttgcgactccttagacttctaatatgtacaaatgcttganacagcaaattcaacaactaaaaatnnnangnnattgcnaatttttgnntcatgaggnaaagnggtngcnacaatcngtggggactnangtgagaggangtgagngtntccgcncctccnaagcgccgactaggactgacctctgcgcnaacnacggtttaaagaggatttcnctttgaggcagcngtctatggaaggaaatttcttaaggtaatataggtgtgcacaaaaagggaaaacaccctatttcatttttcaatttgttaaagattatagttttgagctcctctcctaaactagaaatccactaactctaacttagtattctactccaagacaaagggtattatgtttaaggaatgataggatctattgggaatgctaaaantataaatttaatacatcaatgcgagt

SEQ ID NO: 536476 - DNA, 265 bp, Homo sapiens
ctgtggatcacagtactagccaggggaggaatttcataagaatcagcagaacaaacttctactcacgatgtttgcgaccaggcaccgtgtctcacccctgataatccagcaccttgggaggccgaggtaagtggatcatctcaggtcaggagttccagaccagcctgactaacatggtgaaaccccatctctacaaaaatacaaaaattagccgggcgtggtggtgtgcatctgtagtcccagctactcaggaggctgaggcagg

SEQ ID NO: 536477 - DNA, 1736 bp, Homo sapiens
  misc_feature (278)..(278): n is a, c, g, or t
  misc_feature (921)..(921): n is a, c, g, or t
tgggcccatagcgccgtcggcgcgggtaataaggggggagagaaaatttatgtttaaacctaaaaatatcattataaagataacatctggaaaaaaaagggaaatatctaaacttgggatttccaactgggattatgggcaatggtggaacactggatatcggtccgggtcctctatgggatattatggggatatgggactggacatccactggaacacatgttctcccgcgcaaaacacatactcccgaggtggagaatttatagaggggaatatcncaacagagagaggtgtgtacacgaaaacccgtgtgttgagacgccacctttctcacaacactccagagtgtgtcaaaagtgcgaacgtctccgagccgtgtgtttcaaacaagagggagatcacgcgtgagacaataagtctctcacatgtgtggcgaactctcccaaacaagatatataaagagacccagcacaagagacaaagaacaccagaacagagacttgtgtgtgggtcacagtgacgatgtgtctctctctcccgaggtgggcgtgcccccaaagggaaagtgttatatacacagagaacatattataaaagatattttcctctaccagagaaagagcgcgtgtggatcctcgacgagagagaggagggggcgaaggacccagcggcggggatgacaccgctatagggatgacaaccttccccaaaagtgggggccgtgaccatgttgtgagatgagaggtttttccccaccaaacaacaaggcggtgggcgacgaggccccactgctgtggggcgccgaggaacactaacatttcaccaatatacgaaggtggtgattcgacagccccctaaacgacgttcattaaggtgcggacagatgtgtggtgtctacaaaattaacacgagggaggggangacacctcctgttgttcctccccccgaagaggaatatcaccgaagaaaaatgtcggaccaacagagtgctaccggggtgtgttgcacaccaaaaggatacctcgcgaggggggaagaaaaacctccccgaagaagagataatgtgggggccacccagaagagatttatcttcacctataaagcgacgaggtgttctattccccttcccctcataaaaaaaggcttgtggtgacaaagagaaggttccccgagggaaagaaaagcccctttttcggcttattccccccaagcgcggcggagaagattacaactaagaaaggagggccgccctacattaactactcccctataaagctctctgaggaagtcccccccaatttcccccggacatctcgaaagaagaattccaactccaaaaggcccaaacgagaaaatcaaacaagcgtccgaggaggagcgacgaaaaaaaacacagagggtgggcgcgcggtcttaacaccccgcagctacggaggagagaagacgtctctcccccccaccaagatgagacacacaccatctccgtccgcggtacagcggacgaagagggtgtttcaccactggacacttcgagtgagatcactcaattgagtaaaaacagcaacggctggtcagatgtcaccagaagggagctcaaaaaaacacaacccagagagtggaagagacatcacacaaaagcgatggcgcagctcgaggaaaacacaactctcacttgcagcaagacgaaagaagcaaccaaacgacaagatcaacggatggatgcgaccgagcaacta

SEQ ID NO: 536478 - DNA, 230 bp, Homo sapiens
  misc_feature (77)..(77): n is a, c, g, or t
gtggagctgcctaagacctgggagctcacccctgcatcaagtggctaaatgtgagacgccagtcaaggagattattnggaactttaagatttaatgactggcctgctgggttttggagtttgatagacccagagcccttttgctttgggcaaattcttcccttttgggaaagagggaatatttaccccaaatggcctgcacattgcattggttattcttgaaaagtaaac

SEQ ID NO: 536479 - DNA, 384 bp, Homo sapiens
cctcctactagctctgaagaatctgggcgtccagatgcatggtttccccccagagcagcacaccccctccaccaaaggatagccaaagtacttcattaaatgggtcctgtttcccatgccaagttggtgagaccccccaaaagaggttgtcagatgccctatacagaagcattcctactggcatcaggtgggtgccactcaaggtcagagatcccagaggaaacagcagacatccatctttgctgttctccaatctcctcaagtgacgtttctaggcatgggagcatattaatagggcctgaagtgaacccccagcaaaccacagtagccctacagaagagggacctaactatgaaataaaaaaaaaaggatgaaagctaaaaa

SEQ ID NO: 536480 - DNA, 149 bp, Homo sapiens
tctacacaagagaaacagagctcacagacatagagaatatatttgtggttgccaagaggggagggtacaggaaaaatggactgggagtgtgggattagtagatgcaaaatattgcatttagaatggataaaccataacaccacacaatt

SEQ ID NO: 536481 - DNA, 245 bp, Homo sapiens
ctcacaacattgcacagacatgcatcagtgtgaccccgtggagagcgatgaaagtgcgcccatgcttggttccagcttggatcagatccccttcaaggacttgtggcccgatgacagctacgggtttccactcttgcttcagaaagaagaaattccacgtggtacttcacagttcgcagggtcagggacaccattcctgtggactacacagctccggggttggttggacactggtcatagctggg

SEQ ID NO: 536482 - DNA, 216 bp, Homo sapiens
  misc_feature (4)..(4): n is a, c, g, or t
cccntaagagaccgtgttgcaatgtgttagccaggatgttcttgatctcgtgacctcatgatccacccacttcggtctcccaaagtgctgggattacaggtgtgaaccaaccacggcccggcccaatggagcacacatatctaagatgcagcagttccaatgtacatagacctcaggagatatgtaccaaaatgtccattgcaacacggtctctca

SEQ ID NO: 536483 - DNA, 523 bp, Homo sapiens
  misc_feature (30)..(30): n is a, c, g, or t
gacgaattagatagggttcttgctcttcanaatctcagaagctgctcagggagatagccatataataagtcactgtaatccaatataataataatgattacgagaacaatactaatgatactatcatactaatttttctggattattttttccagagtttgcagggacagttagagtcaatatgaattctcagaataagcactgccagatagtccggaagccctttacaaggaaagtgacatttttgctgtgttttgaatagtgaacaagaatgtgcaggaagagaatgaaaggatatcactagcagaagaaatgcctctttgtaaaaccatagaaaataactctgagttgccatataggacatatgagaatttcagtgttactgaaacaaaagcttttggaaaaggtatggtgattaaattgggtatacaatctgaaaggtaaattgaggacaacttgtgtgccagtttgcatacctactatactgtaaagcagtgtttgattttataatgaagacaatggc

SEQ ID NO: 536484 - DNA, 293 bp, Homo sapiens
acttttattgacaattttcagcaatagactataaaggtaaaattgaactagtctaacgattctgctttgcctatatagcttagaaaagtcgcctcctttagacagtaaccttaattttatattcttcgatagagacaaacatgttgacaattcactttggaggaacattaaaacactgttatactgagtcccaggtagaatcaaacttagatttgttcattacatgtaggccgggcgaggaggcactagccagattaccctactcaaagggttgccgtcgcgggaggtactct

SEQ ID NO: 536485 - DNA, 234 bp, Homo sapiens
cgaccacacactactgtcgctgctcagttccggggacacgtgcgtcatactgttgttcctaagaacacttgtacaaggtgagggtgtctatactacataatgttcgtgtcttcggctacaccgcatagggcgaaggggcctgcggagtatacaatgttgaagcctgagactagttcggactccccttcggcaaggtcgaagggggttcggttggtctctgctattccatttaag

SEQ ID NO: 536486 - DNA, 336 bp, Homo sapiens
  misc_feature (12)..(12): n is a, c, g, or t
ttagcacaaagngagcactggagtagaaacagtgagtaaaactttactggtgacagttgatggtacagatgggcaggggagataagcctggtaatgatcaaaacaattaatgtatataaaaagtacttagaggctaccatgggatgttctgcttctggggataatggagtaactagcaggtaaactaaattctgctgagaaatagaaaaacttgaataaaaataagtatgtttaaaggtatctagagctgctcaagcaatcaggacaaaaggtcacaagattctagagaatggagaacaacctaaaggtgggctgacatttcatgtcattacagaa

SEQ ID NO: 536487 - DNA, 727 bp, Homo sapiens
tccggatgtttgtcgtgaacgaatgttgtgggccccccaaagtgggtgtaaagtgccaggccggtgttgcgttaatgtggttggcgcccccctggtggttgttggtagcggggggtatcctttgccccccctaagtggctttcctacacgcgtgaattcgccgcggtatccactcaaaatggaaggggggcccccacacaattttgtggggaatatccgcactgcatgttagatcgcgtgagatagacactgtcggttggctccaataagtagtggccccctcccccgcgcaagtgttccacccacgggcgtgttcaatagtgatctccacagggtgcgcgcgcagagatgtttagagaaatcgattgctgtgttcgaaagtcgcgctccgtgtgataggagagttgtccacgcacgcctctgagtgtgtgaggagaagtataagaggagttcactcagcacagtcgggtgtgagaaagatagagtgatactgtgtggacccacgtgccgcgcgcgtatagaggtcgtagaccccacatgagagaaaaggagtgtgagagagatataatattaactcttttatgggaccgctcttgtggagacacttcacgccacacacttgtttaacacaatatgtgtctggttgggaattccccggtacgaggcgacgacgtacgagagcgctctacgaattaaaatacccccactagtacgaaaatatacatac

SEQ ID NO: 536488 - DNA, 120 bp, Homo sapiens
cggaggcccccttatacttcttcattctatagctatacttattgtatcactgtctgataaagcagagataatgcaaactgttgcctgtggtgcaaatctaactcatagcctctatttgcg

SEQ ID NO: 536489 - DNA, 486 bp, Homo sapiens
cacgaggtgcacctggcgggccagccggtcgcgctcttgcgccgcggcggtcaatcgggctgcgcgttgcagctcgtcgtgggcgcgccgcgcggtctgcgcggccatcccgatcgccatgccgatcgccagttcgatgatgacggtggcgttgtgcccgaggttgagcgcgaagtagttcttgacggcgaaattggcggtcatcaccgccaggcccgtcagcatgccgcccaccggaccgaactggatggcggccgagatggtgggattgctggcccacaacgtcgtcggccaggtctggttgtcggccgcccagtgcgggctcgcgacgaggtggttcgaccacatcagcaacacgacgaccaccagctcgggcagcacccacgccggcctgcggccgaagccccgcagataagccagcgcgcagggcgggctccagccgatcagcccggcgaaaagcacccaacccagcacggggcgaagcag

SEQ ID NO: 536490 - DNA, 243 bp, Homo sapiens
gaacaaggaaccagtagaaattaaaggctcatagaaacacaagagggaagacgagaacctcagagaacaatgccaaccagtgacagtctgaaactagagtgcttgggccgacacttgaagggctagaagagaaaatcacaaactgtacgttggatctttgagtgcggacgcttgtggaggacaagcgtgtggaaacccaaccacattcgtctttgagcaactggacagtcacagcagactcaa

SEQ ID NO: 536491 - DNA, 131 bp, Homo sapiens
ggcacgagggaaactttcctgcctatgctccagcacatttccaagaacaaggacaaaggcacctatgaggacttagtggaggggatgagggtattcgcaaggagggcaatggcaatgtaatgggtgctgag

SEQ ID NO: 536492 - DNA, 213 bp, Homo sapiens
tagagatcttcttattatcagtaaataatgattactaaagtcattctgactggataattctataaggttcagtctgtaccattaggatgtttcagtattagtaatagagcatctaaatcaatgtgttaaaataagttagtctctcacaaaagaaacagtcccaaggaggagtggctaccaggctgcttgggttggtggctcaaagacatcatc

SEQ ID NO: 536493 - DNA, 159 bp, Homo sapiens
  misc_feature (40)..(40): n is a, c, g, or t
tcagaggatcccctgttgctaggctggagtgcagtggttnatcatggcttgtgcagcctcatcctccctgggctcaggtgatccctacacctgagcctcctagtagctgggactactactctttgagcccagtgagtttgacgaccatgcctgatgcaa

SEQ ID NO: 536494 - DNA, 144 bp, Homo sapiens
aagaacaccatgatgcgcaagcatccgagggccctggaagacaacccagctctggagaaactgctgcctcatatcaggtacggtggctcagctgatagttcttagtgatcaattgactgtgggctggaacctcaggggaggtgc

SEQ ID NO: 536495 - DNA, 752 bp, Homo sapiens
taattatctattctgcgttccgtaccccatttccaacgtttcattataggtacttcaatatgcactcccaccttggaggccagtatattgctaatacaatctcgttgtctagtttatatatatcttcgtacacaggctgtaagaattgttacttgttcttgttgactataactaatttataagttaatgcttctatatgtatacctgtagtatttctattaggcgtcaatcttaacacaataacgttacattaccctcagtaactttgatacagacatttgcgtaacactatgattagcagcctgtgtctctttcgtgtctgtgtgaaacttcttacctggtaagccaagattaatagagactctgctatattcctaaagggaatcaagaccgacgatttgtgtatcttttgctgggtgccatcctattgatgagtaaagctctactgtcactgtttatgttggttctttcacaactgcagcattcttttccccttttccttatgtttttaatctgtctaatttgtcacatgaagatgataatacatggcttatgaggaatgagcattttagaagtgcttgattggagatgaaacatatttatatatatatggactaggaatagttctattttcgtcatttaataaatttattaaatcattacttttcccttgagggatataattttttaagatgtcgactactatgcgtacaggtaataatcgatcgtataattaactctggtgcatacat

SEQ ID NO: 536496 - DNA, 624 bp, Homo sapiens
ggtccttctaggcatgcatttttctaacatcatgtgctcattttgtgtctgtgttacattttggtaaatcttgaaatatttcacactttttcattgctattatatttgttatgatctgtaatcagtgatctttgatactactattctgattgctttggggcaacactatggtgaacttaataaatgctgtgtgttctgactgctctatcaaccagctgttccatcatctctctccctctcctcaggccttgctgttgactgagatacaataataaagttaggccaattaatagccctacagtggcatctaagtgttcaagtgaggggaagagtcacatatctctgactttaaatcaaaagctagaaatgattgagcttgatgaggaaggcatcctgaaagccaagacgggctgaaagctaggcccattgtgccaaacagccaagttgtgagtgcagaggaaaagttcttgaaggaaactaaaagtgctactccagtgaatacacaagtgataagaaagtgaaacaaccttgatgatatggagaatgttttagtggtctggatagatcaaaccagccataacattcccttaagccaaaacctaatccagaaatctcacgggggga

SEQ ID NO: 536497 - DNA, 119 bp, Homo sapiens
ttacaaattctgtgcagaagtactggccgcatacaaatttcccactgaaggggatcccgttttgaggagcagaaagacataaaactctgacattggcacacacagaggggaggagcttg

SEQ ID NO: 536498 - DNA, 907 bp, Homo sapiens
gcccccgccggggggcccgccagttttctctcagcgcgctcctcccgccgcgagctcttctttgtcccccctcttcggggccacccccgcgcgggccggcgcgtgttgaacaccccacctgcgtgttttcccacaccccacgccgcgtgacaccacggctcttatttgtggccccaccctcatgggggccgccctctcttttatgtggggggtgacgcccacccccatcctattgtgaccccccgcactctgtgttgtagcccacacaccaaaagtcgcaccgcgcgctcgtaggtgatgtcccgccgttgtctccgcggcgatttctttccctccgcgcggagatatattttcgtcttcgcggagcccgccacgcgcggtgttctcgccccccgcacgcgcgtttctcgcggggggctctatctcactctcttgtggcttcccgccgcggggagaattattttgggggagagagagaaaagacagggggttgtttttttggtggccccccgcgccgtctctatagggtttggttggggcgctcacacacactctgtctgtaattccccacacccacactctctctggagagagagtactcttatgagagtgtgtgtgtgtggagttgttgtctcttgagagcccccccggagagtgttgagagagagcaccccctcttggccacacactttggcccaaaaaccccctcttttttcccacacaaaaaataaaaaaaaaaaaaaaaaatttaagctgggcccggttggtggttggctatagatttgagctactcaggaggctgatgtatgaggatcacctgagtcccggaggtcgaggcttcagtgagcccagatggcgcccctgcactcccgcctgggtgagagagtgagacactgttccccaggga

SEQ ID NO: 536499 - DNA, 392 bp, Homo sapiens
gagccttctccctctcatactggccagtctcctcatccccttgctcagggtgtgagagcaggttcactggcccctgccggtgtctggggtccacatagagccgctccccgctctgcccaggcagtgtcagcatggcagacacattcatgacactagacacagctggatcagcatttgaggtggctggtggtgctgaagcaggcaagatggccagacggcgagaggggtggtaagcagcatggtcaggaacatcaggaggtcttgggagtccaagttgcctggagctgagaaccccaggtgtgaaattcatctgggagccagcagctccagctgagtggacattcctgtttccactttcgccttccatgggcttctcagcaacttcagtctgt

SEQ ID NO: 536500 - DNA, 102 bp, Homo sapiens
cctcacagaccctgtttctactaaaaattcaacaagattagccccttgtggtggcgtgcacctgtaattcccagctacttgggaggcctgaggctacgacaa

SEQ ID NO: 536501 - DNA, 422 bp, Homo sapiens
tttttttctaagacaaggtatgcctctagcgcccaggatcgagtacactggcgcaatcttggctcacagcagcctacacctcccgggctcaggccatctttccacttcagcctcctgagtagctgggaccacagttgtgcaccaccatgtctggctactttttgtattttttgtagagagagagtttcactatgttgccccggcaggcccggaactcctgagttcaagcaatccacctgcctcgggcctcccaaagtgctgggattacagtcgtaagccaccacgcttgtccaataaatggattttaatggaggagttagaaaagttctttggtgtggtttcagattacacttcacaaccaaccttaaagaaactactactggatagtattaaagaagaatgtccacaattatctgtaaggg

SEQ ID NO: 536502 - DNA, 1063 bp, Homo sapiens
gactgctgcatccgggtgtctcggaggctggtgcgccgtttgtgtctgtctcttggctaaaagatcgggggagtgaggctgggccggggcaggccgcggacaccgggtgtccggaaccacatgcacggacgggggctggacatgacctgtagaaacaagatgtcgtaggattgtctcagagaggctatgagatagcatcaagaatgcaatattgacgtggtggtggaaaagcagcaaattaacgttgattgctttccgagtttgcttgcatgtgtgtacttaatttaattaacgagggcgtggtgatgagacttatcgataaggatgcaagcttggcttagttatatcgcgcgactcgatggaaagagattgtcaaccgacgtcctatacaccatgctcgtggtaggctgttgcataagcgaacgctatagccgtgtccgtaaatggatataattgccagtatcgtgaagtggacgaaggtccagtagagttggatgagttgaccaggttgagagggttggtcgtgggtcgaaaaacagtgatgcttctgcatttgtgtggcgttttcggtgtggattgtcagtgcttagggccttttgggaagtcttcgtgagtttgccactcgtaatggtggaattgcatgtaacgagggaggtctatggtggctaataagaagaatagacgatatgtaatagcgccctgggaaattatggctgttactattctacccacggacaattggccgtttcaattctatgtatttgtaggggagagcgtcctggggttctgggcacacggttgttgggcctgggactaggaaagaactataatggggacaggatggaacacaaacagtcgtggagttattgccccacaaggcaacataacaagggggccttgtcgagtgggggtatatggtagaagagttgaatgcttttaggtggggttcaaaggcacgcgaaatacggtattaaagggtaaagtggaccgaatgttttgcggtagaaaggttaaattgatcctgtaaggtggataggttactcaaggagtttaaaaggtttgg

SEQ ID NO: 536503 - DNA, 112 bp, Homo sapiens
acttgtttagcgaaggagcatggacctggctgacctgcacgtggcatgcacctgcacctcacctccatttcacctgcacactcaccggcagctcacaaccgcatcacccgtt

SEQ ID NO: 536504 - DNA, 225 bp, Homo sapiens
tccagtacccgagcatgcttgcatggcttgtcaaggtcgacgtgtattcagctacatgcgtgtgcatgtctccctggactaagttccgtcgagacgtgagcaccgttgctgacctccaaatatcgttaagctggagcctggtcgacgtgtattcaccactgcggtgcatgcctccctgtacaagttccgtcgacacgtgagcaccgtgctgacctccaaatatcg

SEQ ID NO: 536505 - DNA, 955 bp, Homo sapiens
ggcgaaagcgaagaaggaagctcgctgcccgcgtcctaagagctggtagagccaaagcgaaggcttgaaaggccaagaaggcagtgtggaataggtgtccactaggcacaaagaaagaagaagatccggacgtcacccacgcttcctggcggacgaagacactgcagactccggagacagcccaaatatcctcgtgaagagcgcgtcccaggagaaacacagcttgaccacgtatgctatcatcaagtttgtccggctgaccactgagtctggcatgcaagaagtatcagacagacgaagcaagcacactgggtgtctcatggtggatgttgaagagccaagcaagcaccagattaagacaggctgtggaagaagcttgtatgacattgatgtggccaaggtcgaacaccctgattcggcctgatggagagaagaacggcactatgttcgactggctcctgattactgatgccttgtggatgttggccaacgaaaatgtgggatcgatctaaactgagatccagctggctaattctgaatatatatatatatatctttcacaaccatatatgacagatatggaccctagaaataggaaaaagaaccgggagcgactatctcggggggagtacaacaggtgggcgaagagctggcagcttgggccaccaacgggcgaagccgggcccacactcgtggcgtggacccacaggggagaaaagctgggccgaccgttcccaataggacgagccgagacaggatgatggacaccgccggggataccccggctataaaagacagacggaaaacagagctggcccgatgggccaggcaatcaccactggccaagaacagctccggagtccgaggcccaggaccacaccctaccaccggggaaggacacatgtccgcatcccgaaaccaccctctcaccaacacgaacggtagcactggcatc

SEQ ID NO: 536506 - DNA, 270 bp, Homo sapiens
gcagcctgctgagctgcacttcaccgctgaccttgcctcacctttaactttttcacctgagccccagcttctacctctgacggcaacttctcttagatctctgaatcccctctgactccaacttctctttcaccctctatgaggtccattttacttttacacctgcaagtcctgttttatattggacccctccctccgagctgcaggtcacctttgaccttgccttacctttcaccccccaccccccacagcgtcagctcctacctctga

SEQ ID NO: 536507 - DNA, 491 bp, Homo sapiens
  misc_feature (318)..(318): n is a, c, g, or t
  misc_feature (488)..(488): n is a, c, g, or t
gcacgagcttcattctaaaaaaaaaaaaaaacaaacaaaaaaaaacaacctgttaatatatcttaatattaattttgaagaattatttcctttaggaatcattttaagaaattttattccaggtgttccaaaatttcaggaaaaggtttgagaaaattctcaattataaataataagatacagattatttcattgtacaagtgaatctagtaaggaggttaagaataagaaataacatcccagagcctacagggatatttagatatcttcctatgtgtactacataatatgaattttgcagtttggcattttacttgngaatgccatatgtgagacaaaaatcatcttccagagatttcagtatctctgatactgacaatatctctgatatgacaatatcatcttccagagatttctactctgcataccaacattgtttctttgtgtcttaccaaatgcaacttgttactagaatatggcttactaanatg

SEQ ID NO: 536508 - DNA, 179 bp, Homo sapiens
gggctgataaatagccgacgcacacacacagacgtatatcatccaacaaataaagcctaaatataaatgtactatcttacgtttatttctttctgcatcaacgtgaacatggcttttggcttaattccatcagttagaatggtaaataagagcaagtcattttcccacagtggagttga

SEQ ID NO: 536509 - DNA, 226 bp, Homo sapiens
ccccaagcagtgcagctcaaaccactgaaagagattcctttcctctacttgaggagaggagcggggagagtaaagaggactttgtcttgcaacttggaagccagctcagccacagtaggatatggcaccaggcagagtcctgaagtccccattccaggccctagctcccagatgacatttttcacactttttttagaagggtgacagaataagactccgtctcaca

SEQ ID NO: 536510 - DNA, 427 bp, Homo sapiens
  misc_feature (169)..(169): n is a, c, g, or t
  misc_feature (195)..(195): n is a, c, g, or t
  misc_feature (204)..(204): n is a, c, g, or t
  misc_feature (216)..(216): n is a, c, g, or t
tgaagacagcgtctcggaaggcatgaccctacggagacccggctgtgcaccatctgctcttggggagtcttacagcgtgggggcgggtagctgtccaaactgtgtgggggccgccccgtcccacactcccctgggcattcttggactcaaggccggggctctgcctggnttgctgggaggtgggctgcagcacanaggcctgtnactgcgttccancggccagtcactacgcagtatctctggggcctggaaccagccacgtgccgagctgtcagcaacgtgaggtgtcccttctcgttgagatattaaactttggttttgctctagttctttctttttgaacagagtgactggagcggtaaagaaggaaatgctggaaatgatcctggcgctcacgctgccatccgaagcagatgctgggggatcc

SEQ ID NO: 536511 - DNA, 193 bp, Homo sapiens
tacctacttggtctgactcttcctccggacattttatggtgtcatcatcggtctgctctggacgtgcaccagtagtattgcattgctgctattttcatctttttcttccatgctccttgtgggtcgtgctattagtctcagaactggttttaggtcattcttccaaatctctggagttctcttcctttgtggg

SEQ ID NO: 536512 - DNA, 447 bp, Homo sapiens
gacaaacaaatggaaaaatattccatgctcatggataggaagaatcaatatcgtgaaaatggccatactgctccaagtaatttatagattcaatgctattcccatcaagctaccatttactttcttcacagaattaggaaaaactactttaaatttcataaggaaccaaaaaagaacccatatagccaagacaatcataagcaaaaagaacaaagctagaggcatcacactacctgacttcaaactgtactacaaggctacagtaaccaaaacagcatgatactgtagccttgtagtatcatgctgttttggttactacaaggctacagtatcatgctgttttggttactgtaccaaaacaaatatatagactactgaaacagaacagaggccttagaaataacaccacacatctacaaccatctgatcttcgacaaacctggcaaa

SEQ ID NO: 536513 - DNA, 436 bp, Homo sapiens
  misc_feature (359)..(359): n is a, c, g, or t
  misc_feature (373)..(373): n is a, c, g, or t
  misc_feature (419)..(419): n is a, c, g, or t
  misc_feature (430)..(430): n is a, c, g, or t
cacgagcgcccaagtgggagaggaaggtggctgaggtgagaaaagtgctggtgggacggaagaacaatttacaatatattttggaggaaaattcaacagaagttggtgatatttcaatgtagggattggaagagagggaggagtcaaggacaacttacatttttctggcctgagtgactgatggatgctggtactgagcagcacaggagatgaggctgaagtttaggaactgctaagtttaaggtgcctgagggacctcaccaggaggactgaacaggcagccattgtagctagtagaggttttgatcatcaatacatttttgcccaaatgccatcttcagatagtcaagaagctgaangcaacgggctgtanactaggccagccttaaatatcctgggtgtttgtcttaagaggacanggacacagtgngagagt

SEQ ID NO: 536514 - DNA, 460 bp, Homo sapiens
  misc_feature (14)..(14): n is a, c, g, or t
  misc_feature (91)..(91): n is a, c, g, or t
  misc_feature (100)..(100): n is a, c, g, or t
  misc_feature (118)..(119): n is a, c, g, or t
  misc_feature (121)..(121): n is a, c, g, or t
  misc_feature (123)..(123): n is a, c, g, or t
  misc_feature (125)..(125): n is a, c, g, or t
  misc_feature (127)..(127): n is a, c, g, or t
  misc_feature (137)..(137): n is a, c, g, or t
  misc_feature (139)..(139): n is a, c, g, or t
  misc_feature (142)..(142): n is a, c, g, or t
  misc_feature (151)..(151): n is a, c, g, or t
  misc_feature (163)..(163): n is a, c, g, or t
  misc_feature (167)..(168): n is a, c, g, or t
  misc_feature (171)..(171): n is a, c, g, or t
  misc_feature (174)..(174): n is a, c, g, or t
  misc_feature (186)..(186): n is a, c, g, or t
  misc_feature (188)..(191): n is a, c, g, or t
  misc_feature (193)..(193): n is a, c, g, or t
  misc_feature (195)..(198): n is a, c, g, or t
  misc_feature (200)..(205): n is a, c, g, or t
  misc_feature (211)..(212): n is a, c, g, or t
  misc_feature (218)..(218): n is a, c, g, or t
  misc_feature (220)..(220): n is a, c, g, or t
  misc_feature (224)..(224): n is a, c, g, or t
  misc_feature (228)..(229): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (255)..(255): n is a, c, g, or t
  misc_feature (262)..(262): n is a, c, g, or t
  misc_feature (270)..(274): n is a, c, g, or t
  misc_feature (287)..(287): n is a, c, g, or t
  misc_feature (298)..(300): n is a, c, g, or t
  misc_feature (303)..(303): n is a, c, g, or t
  misc_feature (309)..(309): n is a, c, g, or t
  misc_feature (337)..(338): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (359)..(359): n is a, c, g, or t
  misc_feature (362)..(362): n is a, c, g, or t
  misc_feature (369)..(371): n is a, c, g, or t
  misc_feature (394)..(394): n is a, c, g, or t
  misc_feature (419)..(419): n is a, c, g, or t
  misc_feature (427)..(427): n is a, c, g, or t
  misc_feature (429)..(429): n is a, c, g, or t
  misc_feature (434)..(434): n is a, c, g, or t
  misc_feature (446)..(446): n is a, c, g, or t
  misc_feature (454)..(454): n is a, c, g, or t
gttttttaaggaanaaaattgtacaacattcatgtttttcatgacactgaatgatatatcaatttatctcttagaagaaaaagtagcatanttcacatcnctggttctttaatccccnncncncncnccccccctcncnccnccctctttncccaataacccngcannacntantatcccctcccncnnnncngnnnngnnnnnntttgtnncctttntnaaangttnnattttttntnggngttcaacataccnctcatcnctgttttnnnnncttttcccatttngctctggttcnnnagntaaatnatactctataatccagaaatgtatacanncttcttatcncanttnccctnatnctgtaannnaggaaaataggtttaatgtttancagaagcattagtgtgatattattnccgaaacncnctttngccattctcacngctcaaanagtacc

SEQ ID NO: 536515 - DNA, 138 bp, Homo sapiens
acctctagacggactcccccgtgtgccagtctaccagctgacctcgtttgtcctggcagtaggcgttgtatgttgccgcgctgtgtgcggccatctcgtcgccggccagcagcaggggcgtgccttgagcaaggacca

SEQ ID NO: 536516 - DNA, 138 bp, Homo sapiens
aaatggtgctttatttaacagaaaccctgtggaggaaataaagcccccttgatgtaaaaaaaattgttttatttttattgacatgactgattgattgctattctgggcccttaattaaactgattgtgatgactttta

SEQ ID NO: 536517 - DNA, 650 bp, Homo sapiens
  misc_feature (602)..(602): n is a, c, g, or t
  misc_feature (637)..(637): n is a, c, g, or t
acaaaacagtatatgggactttttttggagtgaggaaaaatgttctaaaaattgttatggcgccaggcgcgatggctcatgcctgtaatctcagcactttgggaggccgaggcaggcggatcacgaggtcaggagatcgagaccatcccggctaacacggtgaaaccctgtctctactaaaaaaaaaatacaaaaaattagctaggcatggtggtgggcgcctgtagtcccagctactcgggaggctgaggcagaagaatggcacgaacctgggaggtggagcttgcagtcagccgagatcgcgccactgcactccagcctgggcgacagagcaagactccgtctcaaaaaaaaaaattgttatggttggtcaggtgcagtggctcatgcctgtaatcccaacactttgggaggccgaggcagacagatcacctgaggtcaggagttcaagaccagcctggccaacatgatgaaaccccatctctactaaaaacacaaacattagccgggcgtggtgacacgcgcctgtaatcctggctactcgggaggctggggcaggagaattgcttcaacccgggaagcagaagttgcagtgagccaanatcacatcattgcattccagcctggacaacaagancaaaattccgtct

SEQ ID NO: 536518 - DNA, 247 bp, Homo sapiens
ggccggtacctgtgcagagatatgggggagtagcagcaggcagtaggctggctactgtgtacaaacaaaaaattgaataagattttttttttttccaaagttggtggtgtctatccaggtccctttgccttatcctacaaactttgggaatgggcttcctatttaaaaaaaactctgctggggtttggatatggttggattggaatctatagctcaattggggaaaatttgccttcttaccactttg

SEQ ID NO: 536519 - DNA, 875 bp, Homo sapiens
gcactgaagatggcggctgctgtaggactggttgctccgagcgtcggttgcccgagatgtgaggtgccattccttggggcgattcttgccactgaagtcctcaggctgctgcatgtgagtagagaacagagcttgacaaatttatatgtgtgtctcggttacctagtcgaagctaaattattcagcatccgagttcctcagtgccatgcacctgctgtcaccctagcgatgcaccctgattttagaggggtacaggcgtgtccaaatggacagtcaaaagacctaagccttggtgacttcagcggggagatattggtgcttatcttctatcctgggattatcagcttgtgtggtgtcctacagatgatgtggcttgttatgtgacaaagctaagcgaatttcaggatgtgaactgtgaagttgtacgcagtctcagtggattcccattttagccatcttgactgatattgtacatcaagaaagaatggtggttaggggcaatgaaatcgtagtcttgtcagacttaattaagcagattccggagactacggtgtgcttgtgagaaggtgctggtctgcctaagaggtctcgttcatacttgacccccatggagtcaacagcattgagggtcagacagatcgtcacagtgggccgagggtggaaagaacctcggctgggatgggtccggatggatcaaccatgggagacgcgcgaggaaggacaccgatcctacgaacagccaatcgtggccaaggccgcgaggaaccagagcgcgggtttgctcacggggagacagggacggcacaaaggggaggagcacccaaacaaacgggggggcaacaaagagagcagggacaaaacaatcccaaaacgcg

SEQ ID NO: 536520 - DNA, 305 bp, Homo sapiens
cacctgcgacgttcacacaaatccctcctaacttatgttgaggaggacatggggctgcgggacagcaccttcgcagggcaggtccaggacatgatggtcaacctgcacatgatcctgacggacacggtgaagatgaaggaacaccaggaggaccctgagatgctcatcgacttcatgaacagaactggccggggctaccaggcatctccggaccctcggatgacctggttgcagaacatgcccgggaatcaggcggagctgggcatccacgccgagaccgccacagtgcatggtgcacgcggccg

SEQ ID NO: 536521 - DNA, 144 bp, Homo sapiens
ttcattcgagtggcgggcaacttatgcacgcttactatcttaacaagcttgagtgcagagatgaagagttcaaatctgaccaagatgtagatgttggataagagaattctctgctcaccacatctaagttgcccgccaatcgaa

SEQ ID NO: 536522 - DNA, 158 bp, Homo sapiens
ccatgtggggcattcacttgccatcggggcatcactgtacagtaaaataacgtcatggtagaggaatgagttgggccgggtgcggtggctcacgccagtaattccagcctttggggaggctgaggtgggcagataacttgaggtcaggagttcgaaac

SEQ ID NO: 536523 - DNA, 822 bp, Homo sapiens
gcttctcgcataacgctgcacatggtgtccaggcgcttcgtggaggtgggccgggtgcctatgtctccttgggacctcatgccggaaaatggtcgcgatggtcagatgtatggatcagaacagggcttgggtcgatggacctttgcactcaagtgaggagacaggccatgcctttcaagtgcttgcagctcactgatttcatcctcaagttccgcacagtgcccaccagaagtatgtccgaaaagcctggagaaggcaggacatcaatacaaaatggcacgcacacgatggcccacagagattgaacgcagagacaggaacgcaagatgacagatttgatcgttcacagttatgagggcacagaaatggagggacagaatatcaaggatcgaggttaggaagtcaaagggagtctcttgaaagttctccaaaaaaagacctggtactaggggtactgtggctgttgtgtgatgtgtagttgtagctgttgtgttgttgttgtaatgtcagaaaaagatccgcgcggattaaaggtccagcaaggaggttctgcagaaggccaaggcaaaaaggaggtgtccaaccgtcagacgatcagaaggtcaggccagaaagacctgctcaaaggctctgaagacgttaggtgacataaacgaaagggtctgggcggcaaagacaaccacaacacgacagacacgcacaaccaaaaacaaaaagtggggccgcgaaataaatcggggccgaaagacgagtaagcgggggtgccaaaccggcgacctgttacagcgcccccgggggagagaaggaaagtggcgcacacac

SEQ ID NO: 536524 - DNA, 1090 bp, Homo sapiens
taggttggtattataacatttattaaaataatgctgtgggttaatagaaacagcaaaaaaccaaaagaatttaaaagtgcaacgctattgttaaaatctcccaactaaaacccaaaaggtgctctaagtgtattcattcattagctaactaaaagcccaaaaaagacaagacacccaattattaataagagtacgtgcgaaaacatattggcgcacattttccacgtttatccaaatattggtgggtattttggctatttggtgtatcctttttctccaaaaaaaaaaaaaaaaaaaaaaaaaaaaaaaaaaaaaaaaaaaaaaaaaaaaaaaaaaaaaaaaaaaaaaaaaaaacaaaatataataaaataaataaaataacataaaatcataataaaaaaaaaatatataaaaaaaaaaaacaacagaaaaaaaacaaaaaaaaatacataggaacgcggggcggagaggaatagaagagagagaggaagagagaaaggaagaggttttgttttgtgtttctttgttctggcgagaagaaggagggagagcagggagatggaaatcagaagacaggagagggaaaagagagagtagataagagagatggcgtacagaagacgatgtatctggaccgcgagagataaagagagaaatgaacgaacgaagagacgagagggtgcagagatgagagtatatgagagaggatgatggtgagagagtgcaggcgtgtgtggtggagagcgagatgatgtagagagtggcagagactgtggagataggaggacgggggggagtggagagagtggaggagaggtagagacggatgagagagagggaggagggaaagagaagaaagagagggagacaaacataaaacaggacactaaagcaaacaactaagaaaaaaccaaacacaatacaacataatataataactaaaaacaatacacaacaacacacaagatagcaaaaagcaagtagaagcaaacagaaactaagtacaaactgacagcaaagagacacagcaacaacagtatacataaggatagatagacagtaccaatatacaactatctatacttcataa

SEQ ID NO: 536525 - DNA, 159 bp, Homo sapiens
ggacgatgcctggttggtgatggaccggatgtgtactgagatgacgccatgatatattaaactacgacagatacatgaggaatactagtaaacaacagcagcagaaacatcagtatcagcatgcgtcgccagcagtgagaatatgcatgcgccatgagc

SEQ ID NO: 536526 - DNA, 251 bp, Homo sapiens
taataatcgtgcacccgtgcgtagctggcggtacgctccgcgtcgttaatcatcgacaacgccacgcgatctttaatggagccgccggggttttggttctccagcttcagaaacagcgagcagggaccggtatcaagcttgtgcagctggatcagcggtgtccggccaatcagttcggtgacggagtggtagatcgtcatgatgttttcctttctgggtgtcatgacgggatgatagggcggagaaatttt

SEQ ID NO: 536527 - DNA, 200 bp, Homo sapiens
tattttctccacgtgctcgccgaagtgcaccgcacgcatccggcgcttccgtggcggtttctcgccgccggatccggcgtgctcgaatcggagctgaaacgcatcaccggcgcgctcggcctcaccgaccgcgtgcactggctgggctaccgcgacgacgcctcgaaactcatgcccggcatcaatctgctcgcttttac

SEQ ID NO: 536528 - DNA, 167 bp, Homo sapiens
tactcatgaaacaagaaaagggtgctattaagaaggagcatggaccgggcacggtgcctcacgcctgtaatcccagcactttgggaggcccgaggtgggcagatcacaaggtaaagagatcaagaccatcctggccaacatggtgaaaccccgtctctaataaaaat

SEQ ID NO: 536529 - DNA, 764 bp, Homo sapiens
  misc_feature (14)..(14): n is a, c, g, or t
  misc_feature (89)..(89): n is a, c, g, or t
  misc_feature (191)..(191): n is a, c, g, or t
  misc_feature (220)..(220): n is a, c, g, or t
  misc_feature (236)..(236): n is a, c, g, or t
  misc_feature (281)..(281): n is a, c, g, or t
  misc_feature (297)..(297): n is a, c, g, or t
  misc_feature (341)..(341): n is a, c, g, or t
  misc_feature (348)..(348): n is a, c, g, or t
  misc_feature (452)..(452): n is a, c, g, or t
  misc_feature (515)..(515): n is a, c, g, or t
  misc_feature (551)..(551): n is a, c, g, or t
  misc_feature (602)..(602): n is a, c, g, or t
  misc_feature (610)..(610): n is a, c, g, or t
  misc_feature (616)..(616): n is a, c, g, or t
  misc_feature (618)..(618): n is a, c, g, or t
  misc_feature (669)..(669): n is a, c, g, or t
  misc_feature (684)..(684): n is a, c, g, or t
  misc_feature (698)..(698): n is a, c, g, or t
  misc_feature (754)..(754): n is a, c, g, or t
tcggagtgtgtttnctccaactttgccacagatcgtgtgggcaaactctgctcgggtgtgagcgtccttcagcttctgctccaacagtntgatcttctctgcatatttatcttctttggtggaatactcctcctctgaggccatcagggacttgagggcctggtccatggttcgaagtgcctcctccagcngtgtggctcggctctgggccacctcagcnctctgctccgagcgcnccagccctccttccaggatcaccagcttcctggccacctctccanatttgcggtctgaatnctcagcgatgtgcttggcctccttcagctgcatcttctgcagtnccatctnctcctcaaccttcaaggcccggttttcgatgaacttaattcctctgtggctctgatcagcggccttctcggcctcctccagcttctgcagggctgttgcgaggngctcctgggcccggtccagctcctcctcaaccagctgaatgcggcggttcagggaggccacanctgccttagcatcagttgccttcttctcggcctgcnccagtttctcctgggcctccttcacggattcagaatacttttccacctcancctctgtncccttnancttcttctggagggcctgctgctcctcctccagccgcttgcgcggttcctnagcttgctttttgtnggcttcggcctgcncggcgcggtcgatggcgttctcttgtacagcttcagcatctgcatttcttcttganggcgtcatgg

SEQ ID NO: 536530 - DNA, 103 bp, Homo sapiens
  misc_feature (15)..(16): n is a, c, g, or t
tctagaggatccctnnggagagggagaggatgtcggagacgggagggatgtcggagagggggaggatgtgagagggaggggatgtcggagagggagaggatgt

SEQ ID NO: 536531 - DNA, 917 bp, Homo sapiens
  misc_feature (228)..(228): n is a, c, g, or t
  misc_feature (518)..(518): n is a, c, g, or t
gccggcctgtgtgtgtgcacgccaccgttttgcgtggacaccctgtcttgcggggtgtagtatttcaagccgcggtcttgggtgttatatacctcgggctattttgtgggctagagcccgcagtgtgttccttccgggaataatgcggggtctcctttgctacgaaagtgttgctgtgtccccgccttccgggatacccgcggtggttggcccatccccgtgccgagnggacgcttcttttaatataggcgtcctatgagccccccgtgggccctgtaattttcgatgcggtctcccccctcccgaccttgaacctgtcgtttgtcgtagtagcccccgtcgttcccacgcgagggatcattcttccgacaaaaattcttgggacgaaaatctcgggtcccccctctgatcgaatacatgcccaccttcttaccaaagtcggtgctgcaaacaatagtcctccgtcgcgcccattctaaaactttcgttgacgcccccgaaggttttcatgacgtagnatagcatctttctaaacagatagttccgcggcgatgtgttggaccctccccgaacggtccccacaactcggtgctatactcgaaatcacgcccccgttaaactctagtggctcctgcatgcaaaccgcgttctgttcttgataccagacgctgctggatagaacacacttttctctacacaccgtgcgggctgtgacccgctgcttctacatattgccacgacttctccttctgttgagatcgtctgcaaccaccgagtcatgaacccttcggaattctcgtgcggaacaccacactacatatggggtcgttctatctgtagacacactcaggtttaacatagcccatgggagtttaaaacaaaaaaaaagtttatttcccttttttccccacaaaaca

SEQ ID NO: 536532 - DNA, 325 bp, Homo sapiens
ccccaatggaatctccccaaatggaatcctctaactagcatctcccttttactaggtctggaggaaagctgcctacaatagagcgtaccggcaaatcctgaaggcaagcttgtatgtagctctgattatgtttgtcagcttctacgggggcagcctggtaatgcagttattcggaatatctgttcccggcttagggatactgtttcaaggggcagcgctactgcttgcagctttttctgtcaaactcgtgggaaatttatctcacgcaaggcgtgttaattggattccatttgggggattccatttggggagattccatttgggg

SEQ ID NO: 536533 - DNA, 104 bp, Homo sapiens
tgaccgtcgctactaaatcggaccttcgtgacttttggtttagacctacacgtttcgtgacttaccaactaacacagcttctgttacgccacgggggactcctc

SEQ ID NO: 536534 - DNA, 415 bp, Homo sapiens
  misc_feature (53)..(53): n is a, c, g, or t
cctttctgaaaaaaattgagtacatttatacagtaagtcctcacttgacatcnataggtagagtctttgaaactgtgactttaagcaacgtgtacagcaggtccttgaataacattggttataatatcgatgagggacaaacatcggtttcattatacattgttttgcttaaagttacagtttccaagaacctatctatgacattaaatgaggacttcgtgtatattcaaatggattctctttctgagtctctagatatagactataatgtgaattctaatcatcacgttatttcctgagctcctgtatgctcagttatatgccttagttttgattttgggtatgctaatcctcatgttaagttccccaccatttggaaactgaaacatcggatgctctatcagcagcctaggga

SEQ ID NO: 536535 - DNA, 165 bp, Homo sapiens
ggtccatgtaagcagaggccaccagcgacaccctcaggccacaaaacgcactgaagaatcaacaggaaactcctgaacacaccacttccccatccttccgcctcgcaccgcccctcagaccagctcctggccgcaggcctcccccagcccccaacccttgtcctg

SEQ ID NO: 536536 - DNA, 256 bp, Homo sapiens
gctctagaggacctcaaaagtgcactcttctatatctacgacatttgtctcaaaagcaaaatcttagagtcaatcctacttattttctttggtcagaaatagcacaattcccacctttcagtgagtctagctgcttggtctaacattcagaatctatccaaaagttaggcactctcttagtctcttcccagaaacagatcccagtaaaaaacatttcaaatcaagaaagtaatttggggactggtagatattagaa

SEQ ID NO: 536537 - DNA, 237 bp, Homo sapiens
agcggccgcccgggcaggtacgcgggggaatggaatggaatggaatgcaatggaatggaatcatccggaatggaatggaatggaatggaatggaatggaatggaatggaatggaatcaactacagtgcaatggaatggagtggaatggaatggaatggaatggaacaacacgaatggaatggaatgtaatggagagtaagggagttgaatagaatcaacccgaatgtaatggaatgg

SEQ ID NO: 536538 - DNA, 491 bp, Homo sapiens
cggtcaatcacttctattctttcggatcagtgtacatccttttctttaataaaataattaaacactggcagaaattcacttattcaaaaagtcatactaactacttgtatatgactttttatagaaaaacaaactttatttttttattttttagagatggagtcttgctctgtcacctaggctggagtgcaatggcacgatctcagctcacagtagcctccacctcccaggttcaagcgattcccctgccttagcctcccgagtagctggaattacaggtgtgcgctaccatgcctggctaatttatgtatttttagtagagatggggtatcaccatgtcgggaaggctggtttcgaactcctgacctcaggtgatacacccgcactggactcccaaagtgctgggatcataggcgtgagacacctcacctgctgacaactaaacttaaaacatctcacatcgaaaacatacaaaaaatcggatacctgag

SEQ ID NO: 536539 - DNA, 202 bp, Homo sapiens
ggtggttcacggaatcgcatcttacgggtgactttccatccctgaagcaaggcatattagcactggctcagcatgtgtcaccattccaaccagaaagtggcacaaatgctacggagtcggggttgtagccaattctcttaatgtacagtgcagacttccttaacaatttcctcatatctcttctgactgctaggtggctctg

SEQ ID NO: 536540 - DNA, 796 bp, Homo sapiens
  misc_feature (59)..(59): n is a, c, g, or t
cgctggtccgtccggattccgggtttgtggccccaggttccggaagcccctttggttgngagttgggcgcccctgggccgcgaatggcgagatttcgttcgctccaattcatgggcgccccccgatctcttggccttcccgccgcagtgctggagcagtgcttgttgtcccgcctcttatgtgatcccccccctccccgatatgcttgctcgcacccccggctgtatctccccccccccatggcttatccaacttacctccgcaaccgaatggtgcccgtactcccacccttaagggcgaacctgatctcttatactagtgatccctgatcagttttattgccaccaactaacctcctcggacatcctgcctcactcatgttgacgacccacccccccactatctataaacctagccctggcccatccccttatgagcgggccccagatgattattaggctttcgctctaagattataaaatgccctagcccacttcttaccacaaggcacacctacaccccttatccccatactagttattatcggaaccatcagcctactcattcaacccatagccctggccgtacgcctaaccgctaacatttctgcaggccacctactcatgcacctaattggagagcgccaccctagccatatcaacccttaaccttccctttacacttatcattttcaccattctaattttactgactatcctagaaatccctgtcgccttaatccacagcctacgttttcacccttttagtaagcctttacctgcacgaccacacatta

SEQ ID NO: 536541 - DNA, 396 bp, Homo sapiens
tttaggggaggggggcctgtttatcccgcccaaaaaggttcccaatattttggccccggttttccccttttttaaaccccataattttcccccacggggggtgggggcccccccccctttttttttttttcccccccaatttttttttttgtaaaaaaaccccatttaaaattttccccctcctcccaaaattctcctggaaaaaaccccccaaagggcccctttccccaaggggtttggggggggggaaaaaacccggaaaaaatggtttccccctttttccagggttctcttaaatttaaacaaattccaaagacaggtcttttcccaaatgacttcatccaatccaatagctcggttctttaggtagtacagaatcattagcaatgaaaccag

SEQ ID NO: 536542 - DNA, 107 bp, Homo sapiens
tacaaatacgaaaactgagcatctgagactcaatccttcaagctgcaggtatcccaggaaaaagatatatagcatcctcatagcttcaacatgcagtgtgtcaggca

SEQ ID NO: 536543 - DNA, 100 bp, Homo sapiens
cggccagggggggttttgggtggctcctcccactggcctcaccagccccattttggtcctgtcaccctggccccaactattaaagtgccatttcctgtca

SEQ ID NO: 536544 - DNA, 239 bp, Homo sapiens
  misc_feature (98)..(98): n is a, c, g, or t
  misc_feature (102)..(103): n is a, c, g, or t
  misc_feature (106)..(106): n is a, c, g, or t
  misc_feature (111)..(112): n is a, c, g, or t
  misc_feature (117)..(118): n is a, c, g, or t
  misc_feature (143)..(143): n is a, c, g, or t
  misc_feature (154)..(154): n is a, c, g, or t
  misc_feature (169)..(169): n is a, c, g, or t
  misc_feature (179)..(179): n is a, c, g, or t
  misc_feature (185)..(185): n is a, c, g, or t
  misc_feature (198)..(198): n is a, c, g, or t
  misc_feature (200)..(200): n is a, c, g, or t
  misc_feature (214)..(214): n is a, c, g, or t
  misc_feature (225)..(225): n is a, c, g, or t
gtttttggttggtagttaagcaaactgacattacggaaagtgccttagacactacagtactaagacaatgttgaatatatcattcgcctctataacantttnntgnattcnnttttnnctgtgcttcatatcatgtacctctntagtcaaagtngtattacagacattnagtgacaatnaatcantgttaattctaantncttgatcctctgcnatgtgcttganaacacaaacctttt

SEQ ID NO: 536545 - DNA, 423 bp, Homo sapiens
ccaagagttatatgggacactgttgtgtgcacagactgcaaaggaaagatggcgagaccactctcttcccattcaccacctacaattgcccttcctctggccctcacatactgccttttacataatttcctcttttgaatctgccctggtttcctataaagaagtgaccacaagaccaccgaaaatgattgttctttaggcacagtttctcccaagagataaccctatatccaaagtatagtttggtaatacctgtcattcagagaaattcgtgtccaatagacaaactttgggaaatgttgatcttgtgcaacctcttgttatatattatttggtatgtgtaaaatttagagcaggtacaaagagtttaatctataattggattttaaaactcatctcaaaattgcagaattaaaccataga

SEQ ID NO: 536546 - DNA, 303 bp, Homo sapiens
tttcctgaatgcagcctgctgagatcgtgccattgcactcctgcctgggcaacatgagttaaactccgtctcaaaaaaaaaaaaaaaagggaatattttttcatagggtttttgttaaaataaaaaaaaatggagtgtttggggcggccctgctcccgggccagagaggcccattttttttcggggttctaacatggggaaagggccggggggggttctctgggtcctttttaaaagggcccctatttggggaggcccctgccctaataccctaaccacctccaagagccctcacttgttttc

SEQ ID NO: 536547 - DNA, 113 bp, Homo sapiens
cccctgaccacgatgacggcatcgcggtgaactacgacgacgcgacgtgatcctggtggcggtgtcgcgcgccggcaagacgccgacctgcatctacctggccctgcattacg

SEQ ID NO: 536548 - DNA, 161 bp, Homo sapiens
gggacaaggttggtttttctggaggtggaaagtcaaacttcaattacaatttggaggctgccactgtggctcatgccggtaatcccagcactatgggagggcgaagtgcgttgatcatttaaggccagaagttcgagaccaacctgggcaacattatggag

SEQ ID NO: 536549 - DNA, 271 bp, Homo sapiens
ttagtaagaaggtgctgttccgagaaggagaaggaaaagggcttgacacgtattcactcggccccggacgtgggaaagcaaggccgtcttggcttcgggcctcacatcggtccctgtgctcgggacggcggcgtttgcggacttatccccggcggtaaagaggcgcctctctctggcagaacttgtgtaagacgagacaatccttcccgccggccgagataataaagagtgtttggcccgacccttgagcatacaccgagagagtgaaggg

SEQ ID NO: 536550 - DNA, 133 bp, Homo sapiens
tagccgagtatgtgttcttctttccagctgatgtggcgcgggctggctctcggttacaaagcaggagactaacacgcgtcagagcgcgaagcgtattccagccctggatgagggtctttcttcaccgttacaa

SEQ ID NO: 536551 - DNA, 150 bp, Homo sapiens
tacgagttcatccgtaccatcgcctcctcaatcttcttcttcctcagctcaatgagatcaggggtctccattccagcatggcactgatgaaaagcctccaggagtgataaggccactgtctgcaggggtaataaagcctgtctcatctgg

SEQ ID NO: 536552 - DNA, 181 bp, Homo sapiens
gtagttagtctataaagtctttggcttggtgtctgcttcgttcatgctgtcatgttttaaagcggttaaaagtaactctgtgcgacctttaaaaaacacagtgattaatttaacttgtccaatcgtgatgaatatttcggctttacctttctttaaataaataccctgcataacgatcatg

SEQ ID NO: 536553 - DNA, 165 bp, Homo sapiens
ggccaagggtggcaacttccttcggtcgtcccccaatcccgggtgtcatccgacaccagaccgcctccaccatgccgccgaagttcgaccccaacgagatcaaagtcgtatacctgaggtgcaccgcagtaaggtcggtgccacttctgccctgccccaagatcg

SEQ ID NO: 536554 - DNA, 251 bp, Homo sapiens
agggggggctgtcgcgtgctcttcggtgtggatacaggaagtcgtcatatttgagcacttggagagggatccccagctgctccagcttcacgtgctcgcttcagcttcgctcaggtaattcacatagaagatcttctgcccgaacttgaagctgatgaggggcttgaagaggatgagcagagtttggatgaacatggttggatgcacgatgtacaaggccttgatgtacttcttgtacttgcggtcaaact

SEQ ID NO: 536555 - DNA, 210 bp, Homo sapiens
ttgcttggttaggaaagcttcagtgtgagaatgtacaagagatacctgtatagggaatggtgcctgctatatattcaaactgccatagtcgaggcaccaatatgtgggggtgtggattcccatgctaggatcagatgtcccagatcggtgggatggtaaagcgaaggcacaaagtgtgtggtgctgagaaagatctggtagaacacttcc

SEQ ID NO: 536556 - DNA, 105 bp, Homo sapiens
tggtcctgtcggttcacaggtttagtggctgatgggatcttcaggttccaggtctgggggcttcagttattgcaggctggaccatttccacatgctgggcctggt

SEQ ID NO: 536557 - DNA, 146 bp, Homo sapiens
tcactgccatgtttattgcaagcaaatatgacagaaatgtgccctccagaaatggtgactttgctttgtgactgacaacacttatactaagcaccaaatcagacagcatggaaatgaagattctaagagctttaaactttggtctg

SEQ ID NO: 536558 - DNA, 470 bp, Homo sapiens
gggttcaagcaattctcctgcctcggcctccccagtagctggaactacaagaccgtgccaccacgcccagctaattttttttcgtatttttagtagagacgggtggatcacctgaggtcaggagtttgagaccagcctggccggcatgatgaaactctgtttctactaagaatgcaaaaacttagctgggtgtggtgatgggtgcccataatcccagctactcgggaggctgaggcaggagaatcacttggacccgggaggcagaggttgcagtgagtcaagatttaagtcactgcactccagcctgggctacagagccagagtggctcaataaataaatcaatatttatgttcaactgatccaacgaactgtggatcaaaaatatctgggaagcttgcattgaatctgtagatcactacaaaagaaaaaagaaagttcaagaaaaaattaaaaaaccacataacaatag

SEQ ID NO: 536559 - DNA, 475 bp, Homo sapiens
gatgtagcgaatagataggactttgagtagagaaggaagggcgtacgaatgtccaggtagaaggaagctcagaggtctagcagaatatattacatgtaggggtcctggaagctcagtgtaagaggaggagtaagagggcaggagaggcatcagatgactctggatggggaaacagggactagtgtaatgaagagctataatgaaatataaattccacttttctttacaaaagcagatttattgaggtataaattcacatcatacagtttaccccgtttaaagtgtacatttcattgtttctttagcatattcacagttatacaatcatcagcacagttgattttaaaacatttttgtcacctcaaaaagaaaacctgtaccttttagctagcaaccctccaagtaccctagtcctaagtaactactaatctactttctgtgtcatacagtttacctatttggagatttcatataa

SEQ ID NO: 536560 - DNA, 226 bp, Homo sapiens
  misc_feature (120)..(120): n is a, c, g, or t
cctgggaggcgcagtgcacagaagtcaatatttcagaggatgtatgaaaacgcctggatattcaggcagaagtttgctgcaggggtggggctctcatggagaacctctgactaggtgctnagtgcagaaaatgaagatgtggagttcggacgcccacacacgagagtcccgtacgtggggcactgcgctcatggaccgtgtgagaatgagggccacacatccttca

SEQ ID NO: 536561 - DNA, 285 bp, Homo sapiens
gagaagcgacagaagggcctaaaagagtgatacagggtttcaccacattggccaggctggtctcgaattctggcctcaagtgatccacctgcctcgggccaacatggcaaaaccccgtctccacttaaaaatagcaaaaaaattagccaggcatagtgtcacatgcccgtagtcccagctactcaggaggctgaggcacaagaatcatttgaatctgggaggtggaggttgcagtgagcggagaccacgctgttgcactccagactgggtgagagataccgcctc

SEQ ID NO: 536562 - DNA, 338 bp, Homo sapiens
tttttttggcctaaaaaggggttgggcccccccccccccccaaggagggggaaaaacccccttcaaaaaaaaggggcccccccacccctggggtttcacccctttttttttttaaaaaggaggtcccttttttttttccccccaaccccctgacctaaaaaccctggggcttgggggcaattttaccccccctcccctttttgggggggcccccaaaaccatggcccttgggaaaaaaaaaatttttttttcttttgggcctggggggattttttttttaagttccccccccaaaccctgccctttttaaaaaaaaaaaatccccttttttgggccca

SEQ ID NO: 536563 - DNA, 697 bp, Homo sapiens
cataaccctcaacacccactccctcttagccaatattgtgcaaaaaaaaaaaaaaacaacaaaacacaaacaaacacacaatgcggcggcgcgcgcgcacggggcccttccgaaaacgtttccataacaacacacatcgcggtagggggcgcgcggggcgccccagacgggaaacgggcgaacatgggcgcctaaagaggtgttcatcaaaaaggagaggaactccggggaaacaggagaaaagcgggcgggggagcctccacccacacacatcaaacaaaaccgccggggggggcacaccagaaagcgagtaaaggagacaaaaaaccaccagaggggaagtacgctggaggacaccaaaaacgggggaacctcataactaaaaccaggggagagagccaaaagcgcgagagagaagacaaaaatacaccaacatccagagccccacgagagagcgggcaacaaacaaacaagaagaaaaaagacaacgaagaaacaaaaaaaaaggagaggaagaaagagggggagacggacacgcgagagggaaaacagcaggagagcgaaggcgagaagggaggaaaggacaaggacggagagaacgagaagaacaacgagaaagaagaaaaaaaaagagaagcagcagcaaaaagcgaaaagatggaaacagagaggaaaacaaaaaaaagggcaaaagaag

SEQ ID NO: 536564 - DNA, 150 bp, Homo sapiens
cgctgtataattcaagagcaagccccttatacaaggacacagacactacgggagcttggaagcaggctggctgcccttgccccagcttggctctgggcaaaccagccaggcaccaaaagcgacttccctgacatcgcaatgagagatttt

SEQ ID NO: 536565 - DNA, 388 bp, Homo sapiens
catgatgttgccatatatattacagttgtatctagggttaatgggctgtagtataggtgaggaaaagatttctggaataagacgttgctcttttacctggaggaaaggatctggggccgggcaccgtggctcagccatgtaatcccagcactttgggaggccaaggtgggcagatcatgaggtcaggagtttgagaccagcctggccaatgtggcgaaaccacatctctactaaaaatacaaaaattagctgggcgtggtggcacacacctgtagtcccagctactcaggaggctgaggcaggagaattgcttgaacccaagaggtggaggttgcagtgagccaagatggtgccactgcccatcacagcctgggcacacattatggag

SEQ ID NO: 536566 - DNA, 325 bp, Homo sapiens
gtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatatatctacccaagagttaccagtagggtttagttttgactatatttctagtgatataatccgatttggatcatgcgcaaagagttcatttggtactagaccagacacttataaatcctattctccagccgcaacgat

SEQ ID NO: 536567 - DNA, 1206 bp, Homo sapiens
ggcacgagggtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536568 - DNA, 789 bp, Homo sapiens
ggcacgagggtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccctctgtccccagggatcaaacagaagcagccgtgggcaaaatacaatttcatttaacaaattgaaaaaaaaaaa

SEQ ID NO: 536569 - DNA, 250 bp, Homo sapiens
  misc_feature (176)..(176): n is a, c, g, or t
  misc_feature (223)..(223): n is a, c, g, or t
atgcagtaaatcttcgcaatttatttcctctgcgtggtccagctggtcctccatttggggtcctgacttcccgcaacatgcgacatgcccagctaatttttttaatttttagtagagacagggtttcaccatgtttggccagtgttggtctcgatctcgttgacgcttgtgatccnactcacctcatgcctgccaatagttgctgggatcacacggcgtgagnacaccacgccaaagatttactcaatcg

SEQ ID NO: 536570 - DNA, 218 bp, Homo sapiens
acctggacgaacaacacaagcatgtaagatgaacaatgataagtcagaagcaggagcagagcagcagctccgtgaacgaacgatgagcactaatgtgacagatggagctctgagcgggggtgcacgcatgactcctgctgagcgagcggcgcgaccctacctggcactcgcactgcactgcactacactgaacgacaccggggcgcgactgaacccag

SEQ ID NO: 536571 - DNA, 1471 bp, Homo sapiens
  misc_feature (421)..(421): n is a, c, g, or t
  misc_feature (426)..(426): n is a, c, g, or t
  misc_feature (438)..(438): n is a, c, g, or t
  misc_feature (455)..(455): n is a, c, g, or t
  misc_feature (457)..(457): n is a, c, g, or t
  misc_feature (475)..(475): n is a, c, g, or t
  misc_feature (492)..(492): n is a, c, g, or t
  misc_feature (505)..(505): n is a, c, g, or t
  misc_feature (537)..(537): n is a, c, g, or t
  misc_feature (561)..(561): n is a, c, g, or t
  misc_feature (599)..(599): n is a, c, g, or t
  misc_feature (601)..(601): n is a, c, g, or t
  misc_feature (634)..(634): n is a, c, g, or t
ggcacgagggtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctggnaaagncacggcttggangctcacgggggcctggntnaggcaagatggggtgganatagcggccctagtggngatcccgtgcccngctgcatgcaccttcgactgtaccgaccggcntctcaggctggagcccactgctgncctgggagacccccgtatcccctccagcccacctggcngntcactcctcagcttggcccgccctgaaatgcgnacccgcgcctctcccggcctggttgccatgacgacgccgctcagccagcgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536572 - DNA, 848 bp, Homo sapiens
cgatggcgctcggtgatacgaacaggaccccacagtcttcgcctgaatcaggcgaagactgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536573 - DNA, 115 bp, Homo sapiens
gtgcaggcggcgaggatcccccgtctaactgacttcgtcttatcccggactacatctgcgtggtggggggctggactggggccggggtaccgacgctcgacacttcgtaactcac

SEQ ID NO: 536574 - DNA, 1335 bp, Homo sapiens
ggcacgagggtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaaggtacctctcgatggctctagggttgccccccatcctcttatctcctggtcctggcacccacaactcccgtactagaagcaaagggaggcttggggtactcagcgcaaccccctttccctctcctcttagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536575 - DNA, 1019 bp, Homo sapiens
aaaaaaaaataagcaaaatacaaaatctgatcaaacaaagctgaataatagaataaagaaatccaaaaaatgataataaacataacagatgaaggaaaaatataagacaaattgatatacagccatgcagtatgtggctgatagaacatgagaaacatgccacggtatcttcaaatcatgactttgaagaaaatggctcaatggacaatgtcatgcacatctttatcgaacttggctaatgacccaaccattgagcgaattatcacatcctcgactggcatctaaccacagctgaatttcatggccgtaccactgtgcagaaacatgtcttgccttattctaaccagacatgagttcttatgctgaagcacgttcgacgaggtttcatgccagccacgggcaagaggtacctggctcgaccgacgcttttccaggttacctgtatacagatttagccacgatatatgaacgcgctgggcgagtggcagggagaaacggctcgattactcaaatccctattctaaccatgcctaatgatgatatcactcaccccatcccaggacttgactggctacattacagaggggcagatctatgtggacagacagctgcacaacagacagcattatccacctatcaatgtgctgccctcaactatcaccgtttatcgaatctgctattggaccacggatgaccaagaacgatcatgcccatgtatctacccagctatactcctgctatgcattggcaacgatgtcaagccatacagctcgccccgcgccacacacccccttaccacccgcactcccccctatccacactttgcaaagttacactgccccaacatcgcaacacacaacctacagcgggcatccgccggccccagcaatatacacgcaacgagctactcgaacttggacacatctagctcaacacactcccaaatcattgccccaacgcgtctccgacaaaacctgccacaaccaccccaggcaccttacaccccgaccctgtccaat

SEQ ID NO: 536576 - DNA, 1039 bp, Homo sapiens
ggcacgagggtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536577 - DNA, 1334 bp, Homo sapiens
gatgcagtctgggaacatgccgccttctctccagcctctgtgcctttgttccaggtaggtctcaccctcctgtaccctggctgatgctaggtggtacctagatccaggctcctgcagcgcccccctcactttgacactggactagagatagcagcctcccttctgtgtccccttgagggtaccctgggtcccctcatcatggggctgaggcttgatatgagtcgggggcttggatggccgtggggtcttctgggtcccgacgcctagttgcaggcccctggggtcgtggtttgacagtttgatactatgccgtgatgagcaaacaagagagatccttgcctatttaagtggtagacagtgccctccagcagtggcttccgagacttgacggtggacgtctgcgttgtcctgacatagaaagacgaaagccaaacagcttagtggaggtcaaagcccagacactgtaaagtaggaaccccggcgtcacaacatcgccgcgcgtccgtcctagtcatccgtaccctggatctgctggtgcatcacgagggccctacggggcccttttgctgctgctgctccgccgcggactggcgagtgaggtggtgccgattgtgaggagcgtgtggtttctgggtgctgaggagtccgatgatggcgacgtgagatggagaaaccgtgggcgtggaaagctgcgccaagcgaggtcagagccatggggagtcgcggggaggcaaagccaacaaagcaaagagtgaagtaaagagcgacccaaagaagtaaccacatctcaagaacagaaagcaaagaatcaaccaatcgacccaaccaacgaacacaaaaccgctatcgaatatccagcacacgaccaccaaaacaaacaaatagaggcgagtctcccgccgaactccaaacaaaatagcagcccagtgtgctgtagatcgatcttcctgtcgctgttgtgtggttgcaggtgatgactgcatcccgacgccccctactctcctgctggctgctgggtgtctcccctgcctggctggttcctggacggatcgcgccctcgctgcttacggccttctgcttgtcgactattggctccttcgtggtgttttgtacagctttacgcgcagcccctcctaacgttgcactcttggctgtggtcggactcccaagacaatgcccacctggcagccgacatgagcccacgcgcacatgaaccccacgcgcccacaccacttgcccgtcacacgctgcgcattccgtgaagcacacgcacctgcgccgaacgagcgactgctaaaccaagcatacagcccactgcagcgcacctcccactg

SEQ ID NO: 536578 - DNA, 114 bp, Homo sapiens
  misc_feature (4)..(4): n is a, c, g, or t
tacnacgtacgggtcgtggtgctggacgtttaccgttgacgtacgtaccgaactgcgagtactacgttacggactacctactaccctacgttacaacttaacgacactggttac

SEQ ID NO: 536579 - DNA, 871 bp, Homo sapiens
ggcacgagggtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactcttcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536580 - DNA, 342 bp, Homo sapiens
ttttctctgctgcggtgactctagacggactccccctaggtggacacgcgaccgtggcggtgctccactagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaa

SEQ ID NO: 536581 - DNA, 216 bp, Homo sapiens
ttcctgaagacacagtagaagaaagggaaaagagaaaaggggaggaaagaaagaaaagataaaaggacacaggtcatggtgccaggaatttggaaactggccacctcggcaattttgagatgccggtgggctggggagagggtgtcctgggggactggcccggctgaaccaccaggccagcttctctgcctggtggagctaacccgaccaccgcct

SEQ ID NO: 536582 - DNA, 124 bp, Homo sapiens
gctgttaccctggtgttgtctctcctcatctgtctcctccttgcgcaacgccgtgtggtacggggctgttggagactctgcctacagcatggggtgtgtgtccatggctgaacccgctgagtgt

SEQ ID NO: 536583 - DNA, 427 bp, Homo sapiens
gtagatgctgcatgatcatcttctgcctcgacagacagtataacgttgtcttgttttcttaagattccttaccactcagttactttgggccaagtatccacgtccccttgcgtatagcatgtgggataagagtgttggatgcaaagtggttattatggtgcaagtagctcgatggttaaaaggacaaacacctatctatcttagagcttaagcctgtatatgcttagttcccatagataatccacttagcagtcatcatctgtacttaactcttcataattaatctggtcattctccattcgatgtcagcctcccttatcatctcatccatctcctcatcggtcagtttctcccccaggttcgtccttacgtgacgcaattcttcggcgctgatgtatcctttcccatccttgtcaaagacaaggaa

SEQ ID NO: 536584 - DNA, 139 bp, Homo sapiens
  misc_feature (49)..(49): n is a, c, g, or t
  misc_feature (55)..(55): n is a, c, g, or t
  misc_feature (134)..(134): n is a, c, g, or t
cgatgttagaaatggttccagaaaaacgagcctcagctggcgagatctntgctgntcgctgtggttgaattcttagcaaattctaccaatattgcattctgagctagcaaatgttcccagtacattggacctanacggt

SEQ ID NO: 536585 - DNA, 1056 bp, Homo sapiens
ggacgcgtggggtggggcaaatattgggtccccaggctgtggaaagatggacagaggtccaagtgggtgaaggctttagaaggagcacacaatgaagcccctggacccccacgatagctggagagccatgtatatggcttcaaaagccacactacgggaatgggacactagctcgtggagctatgtgtggcctgtcagtttcagggtgagtacatttaccagatgttacttgtttagtcgtggggtagccagagtaacattgagttatctggaacacataagttgaaatgaactaacttaagaggtgatatgtcgagggctatctacctttttaattccaaaagggagtctatatttatgtctaggcttgttctctggatatccatattctattggtttataacgaaataaacggcaatcttgtataaatcaggttaacggaagatttcttggacttatgaaaggatgaacaagctccacgtgtgctattggcattggcatgtcaggtgagtcaaattatcacccagtgatcttctgcgcgtcccatctgcgttgggtatctgcctataatccgcaggtccaaccaccattccgagagactgaaacatggactggcgtggactgcagacttcctacggaactaccctccctcacctgacagaggcacgtcactcttctctgtgtacccaccgactgtctggtcttcagaatgctccccaggtaaaattagaacaactctttcttcggttgggggtctaggaggccgaccttgacactaattactatacccatcgggcgggccgtagccaaaaaaaccccatccggggacactcaaacagcgaagcctagttttcgccacgaggcccccaatggaaggacacataaacggagaacacgggcggctacttgaacggcggacggcgaggaagggtccttgtggcgacttggggcaggccccccggcggggcccacagccaacccacagagaatccccgggcaaaacactggcgaaaggaacacgaaagcggggcaatgccgaggaaacgcagagacaag

SEQ ID NO: 536586 - DNA, 740 bp, Homo sapiens
  misc_feature (225)..(225): n is a, c, g, or t
gcgggagactcacgttgccggcgaagtgggagagagaaaagtggtaacctgtggtgctggggtgcctggcgctggcgtgagctcgtgagtagatagagctggagtgaagacacaggggtgagtgatagcagactgtgcattccgtttgtgtgcctgtgtggtgactttggctgtgtgatgtctgttgcttgtgtgttgctcttcagcctagtgtttgatgtgtcnccatgttgatgtgtgtgaatgtgatgaacgctggacagatgtgtgtcatctatgtctgtgtgtgccttagtgtgcacaatgtgtgaactacaacaaatgtgattgcatgattgactattaagaaattgatgtgactgactgatggatgattgcttgttggatgtgagcatgtagatggtgaagacagatgattgcaaaagaaacttgttgtcagtgaaggaacttgtattagaggggtcattagaaggtgaagtgttgtgctggacgatgaaaactacaactacactgtgaccattaacgacgtgttgtggtgtgacgccatttgtcagcaatgggactgtcgggactgcgaaaatggtgtcagtggtagattgtggcaatattgttgttgaaaggcagcaaagggtaagatggggggttggaagaagggagaagattcaatggacggatgaaaatgaaattggcgaccttagaaagtcgaggctctgcaagaagttggttgaaggtgggtgata

SEQ ID NO: 536587 - DNA, 241 bp, Homo sapiens
cccccacgaataggaggcatcaggagtgactgagctggcctctccatggctacagaatatagagaggccatgagcagtctctcccatgagtacaaggacggagcatgtacgcttggcaggttggctagttccttgatagcatcttattctcaccttctttgtgtctggtgatgaaaggaacagtctgtgcatgggttttacttacacttcactgttcaacctatagagcaatctaccgtgg

SEQ ID NO: 536588 - DNA, 109 bp, Homo sapiens
tgactagtgcattgactccagcctgggcacaagagcgagacctgtctcaaaaaaaaaaacataaaaccccacaaaaactaggagcctggaaggcctggacttgggtctc

SEQ ID NO: 536589 - DNA, 197 bp, Homo sapiens
ggggaggatctaggcaggtgggcaatagagcaagactccgtctcaaaaagaaaagaaaagaaaaatactatgagaatacagagaaggaatagctaacttagtctggaaggtatggtagaaagatgagtaatgaatatgacttgtggccagtgtgtggtacgttcacgctctgtatatcccaggtgcttcagacgtcc

SEQ ID NO: 536590 - DNA, 829 bp, Homo sapiens
ccttcccgcggggtgcacctgggccccaatttcctcagagagggtctctggtgttagccatttctctcgatgggcctaaccgtcttcgtcgagcttctgcaatttgcccgtgttccccgtttggagcgcccacctcctccgtgccgctcgccgcccctgggctcgtgcctgggtgtccccccggcttgtgccagcagtgtcgcagcgcgacacaacgggctacccttgtcccaggggcggcgccccccggtgggctcccaatccgtgttgatcctcccgctcggggacaccccacgagtctgggccccccaacttgttttcgcagcccgtgcggtaccccgtgtcttcgctgcccccggtgggagcataaaagggctcctgcccccccgtcttgggggcacaggagtcccggcacaccatagaactggtgctgctcgtcgcggtaatatttagtgctgactgttttcccccgcgcagtcgatgaaatgtctcagcggcggccctctctccccacccgcgctgtgtggcgtcctctctccgggcgatgttgactccgacaggcggcattcttggggcgttccccgggggtgcgtcactagtattgggtgagccacgcgggtcccgcccccttttcgctcgaggcttgggcgcccactcccgaggtgtcttgggggcactaccttgggcaccccgatgtcatcttctgttgcccccgactcccctcggggcggaagttcttgctccccctcccgcccccgtcaggcgaggtgtccgttttctgccccggtctctttaaaaaaaattttgggcaaacccctcaacaaaaaca

SEQ ID NO: 536591 - DNA, 577 bp, Homo sapiens
  misc_feature (213)..(213): n is a, c, g, or t
  misc_feature (284)..(284): n is a, c, g, or t
  misc_feature (300)..(300): n is a, c, g, or t
ccgagatggcgccactgcactccagccggggcgacagacactccgtttcaaaaaaaaaaaggtgagtacaaggaggttcattaaagccttatatagaaaaggttagacatagcttaaatgccactagatgtgacattcttttcaaattgtcagcggatgtccctcaaatatcttcccatctcacagaataaaacccagagttttcatgtcttncaagccctatgagacctggttccccacagcctctggaacctaagttcttacagctctctccctcaggcacngtgctgtggccttgancaagcccagcccacaaatgcttcactcctttcacctgcctttccctcagctccagtgctgaatgacctgttcccttctttcatttaggtctctactcagttgtcacctcagaaagtctgtctctgactttgccacctaaaaaccacccctgatgatcctgtagcccctttcccttctttttttttttttgagacagagtctcactctgtcacccaggctggaatgcggtggcgtgatcttggctcattgcagccttgacctcctgggcgcaggtaat

SEQ ID NO: 536592 - DNA, 224 bp, Homo sapiens
  misc_feature (110)..(110): n is a, c, g, or t
  misc_feature (150)..(150): n is a, c, g, or t
gcaaccagtgtcctcgtctgaagagagaaagggaggcgtgcctgagagggtagcctgtgcatctggtgagtgtgtcacgagctttgttactgccaaactcactccttttnagaaaaaccaaaaaaaagggccagaaagtcattccttccntcttccttgcagaaccacgagacaagccagttccctgtcagtgcaggcttcttgtaatttatggtatgtgcctt

SEQ ID NO: 536593 - DNA, 264 bp, Homo sapiens
cgtcctctacagtactagggagcaatgggaacaggagcccagacgcctctctcagcagcccaataacgctagaacactcgtcaaggaagagaaatatcccataactgtccatcctttgggttcaaaaagtcaactccccttcataaggtgagagacgcatctgttcagagcagcagtattcacaatagcaaagacgtggaatcaacccatgtgtccatcagcggtagaatggattaagaagatgtggtacatgcacaccatgga

SEQ ID NO: 536594 - DNA, 259 bp, Homo sapiens
tgtttgctgcatgctgagggctcacaggcagagggacgtttagagtgagcaagcagctgactacagagctgctcagtaatccaggaatagctgagggcctggcgtcagaagggctcacagtgagacccactgtctctaaacttcccagggttcccagcactgaggctcatttaatgggaactctaggtacatgagggaggtctccagcgacaccaagcatctctggacttaggacctggtgaacacaaacagaggaccc

SEQ ID NO: 536595 - DNA, 429 bp, Homo sapiens
aaaatagcaaatgatattgtcttattttacctcttggacatccttgaatgaaactgctactaaagggatactcggatcaaaattcagatctaatgttttgaacagtatagtttgtgaatgtccagtgatcatgagcccttgatggggaaatgacctttcgagtttcacttttgcattttttgctcttttcgttgacttgtcttgaaagcttaaattcaactattttatttttacagaaaccaggaatataacttttaaaatatatgtctgtcctgtctcacggtgttgtgtactcttcagatcttgtatgaacatagacttatatgggaacaattaggttttttgtttgtttgtttgtgtttttgaggcagagtcttgctctgtcaccaaggctggagtgcagtggctcagtcttggttcattaccacc

SEQ ID NO: 536596 - DNA, 144 bp, Homo sapiens
gacagctgaccatggaagctaatgggttgggaccttacggttttccggagctgaataatgacacattcgtgctagcagcctggggagaggaaacagactactctcccgtctggtgcatgcgccaggcaagccgttacttaccag

SEQ ID NO: 536597 - DNA, 1232 bp, Homo sapiens
  misc_feature (800)..(800): n is a, c, g, or t
gaaacaaatgatatagagactcccatttaaatgaatcttatctttataagaaacagccaaactgttttccagactggctataccatcttacattcccaccaggaatgtatgagtgatccagtttctctgcatgctcgccagcattggtgttgtcactatttcttatttcaaccattctgtttatccttttcagtgaaatatctgttcatatcttttgcccatttgccaattgaggcaggaggatcacttgagcccaggagttcgaggctgcagtgagatatgatcactaaatgtttgcttaatgagccatatctttaaatatcttttttaaagtttttaaaagtcagtccagtggtttatgtgattatgtgggattttttaaatctttccaggcaaaatgtgtatagcattttgaacatatttacactgtactgagcccaagagttctcatattctttctttgctcattatagagtatggtactaatactgtataatagtaaattttcaaagatacctttatttagaatgttagagtatacagatatatactttgtacatagttatcataatgtttctaacctttttatttaaagcaggctgatttgtgtaaaggtttcagaatgattttgttaactaagttattagaaactttcctatttgtacaagatggtaaatgtagattccaatttgtatgcctcagtaaattcataatcttatttctctgatgtgagccactgtgcctggccttctgtgatgctcttaatgaattttgcagttttattaaattgtcattgagancctcataaatcattgttaagatctatacaaaaaatcaaggatccacagtaatagaatatttttcatctgcatatgaatttttcccttccctttttgtctacttttagatttaaaaaaaattaccaggacattcttattaaatactattacctgttttggtttctgcacattaagaaagtcacagagaagccagacacagtggcatgctcttctattcccagctactcaggaggctgaggctggagaatcacttgagcccaggagtttgaggatatcctgggcaacatggtgaaacttggcaaaaacaaaaacaaggccgggcatggtggctcacacgtgtagtcccagcactttgggaggccacggctggcggatcacgaggtcaggagatcgagaccatcctggctaacatggtgaaaccctgtctctact

SEQ ID NO: 536598 - DNA, 1158 bp, Homo sapiens
ggattggcctgaataaaaatgccttgagttggtgagtagcatggtatggtttcgtagagtaggaggacgcagggaaaactgcgtcgccatgtgaagatccataggtcaagcgagctggtgaggaacgacctcataatgctggcaccctttactctatcggaatgagctccgggccacggggtctggcaaggtgctacagaactgattccccacacagtacaccagttaccattctttggactccacgtggtaccatatgtctttgttaggaacgacgagtggctatcgggtcaatgggtcatgcggctatgggacgaatatcgttcgctggataatgcgtgtccatgcagccagaagatcgtgcgctgtgcgtgcctgggcatctcagctggtctacatcatgcgtagagagcacgcgcacgaggccataatcatagtgacccataggctaccctgagtgtatacggtgaaactgcaagcaagtgacatgggtaactgaagcacgtggagtcgtgagcgacagtcactccaccgataacgagaaagcgattcattgctgactagtgaatctgatggatattgccgaggactgggaacgggcgccgtggatccacacgctagtgaattaactcgtgggaattcagcgccaagtgctacccgtaggactggaggggccgcatgtgagggggggcgcgcggtccagctaacaggagggtcgttggcactagccgagagtcctccttacaaggaccatcaagaacagttgtgaccggcctcctagtttggaggtgactgcggatgcaccacatgacacacatcagcgccctaaagaagggcagcatgctggagccatgagcagggttgaagagacaggagcccttcttcatgggtccagggcgaggcggctggggatgcttactgaaaaggcggaacgtcgtggtgcttaaacagaacacaggcaagatcggtcactggacagttgatgcgtcagacctggcgactcccttcacttgagtagcaggcaacaccgacaatcacaaaagtgatgagagaacacaaataaagttcgctgcgtagccattcacagggaattctagacaacgagcaccgaagttgaaacgagacgagcaataagatacgatatacactacaatcatg

SEQ ID NO: 536599 - DNA, 148 bp, Homo sapiens
atcctgattgcccctattctcaggctacacccgtagaccagaccgtacgccaaaatccatttcactatcatattctcggcgtaatctactttcttcccacaacgctttctcggcctatccggaatgccccgacgttactcagactacc

SEQ ID NO: 536600 - DNA, 276 bp, Homo sapiens
agccctggaaccactgtctattctgtttctgtgagttgtgacagttttagatccacatatgagtgacatgcagtatctgtctttctgtgcctgggtcgtttcacttaacataatgactttgggttcatccacgttgtcacacatgacaggatttccttcgttttcatagctgaataatattcagttgtgtacacacaaccacattgtcattaaacaccaaaaatttttaggttgtttccatatctcgggtattgtgaataacgctgcaatgaacat

SEQ ID NO: 536601 - DNA, 176 bp, Homo sapiens
  misc_feature (18)..(18): n is a, c, g, or t
  misc_feature (25)..(25): n is a, c, g, or t
atttttttttttgggggntaaaaantttaaaaaaccccccacaataaaatcccttttcaaaaaaaaaaaggtatttttttttaaaaaattaaaactttttttaaaattttttaaaaaaaatttggggttttttttttttttttttttttttttttagattttttttaaaaccctta

SEQ ID NO: 536602 - DNA, 559 bp, Homo sapiens
gtagggactggaaaattggcaaaggaaatagaaattggaaaacaaaacaaaatggcaaaagccttagtggctttttccacctaagaagtggatcaagggagaaaaggtccacgggagttggaataatgaacttggagttggggtgcaagcaaatgactcagagaagggtccagctctcaagctgaatgacaaacatgcggtggtaaatttagtctcaggtgtaaatacccaagccctcgggtacccagggagcgggctgggtctgggggggcatgtgtgtcccggtgagggcaatcatggtagtggctggccttcagaagaatggaggatcggagggagttttgtaatgtatttattttcggttcacctggtgacccggtgtcaaaatttataaagatacaaaaggcattactggaaagggtactttctggtaattggatactattgggctaaatcatcttcactggactatttgtaatactgttgtaatgttaactctgttaagtacccaagtggtgtgtcttccaccaaagagtgtttattaacaagaatctgtgaa

SEQ ID NO: 536603 - DNA, 513 bp, Homo sapiens
  misc_feature (435)..(435): n is a, c, g, or t
  misc_feature (452)..(452): n is a, c, g, or t
aagaaaagtatatggagtatctggatgcagtaacttatagtggtgatcctgcaccgggaccagatccattttcacttatgggagagagcacgattaattggtgggtgacaattcagggtggagtcgtgctgctccagagggtaaaggggtcaaatgtcgatttccagtagtcgaaaagggaaaacagatatcaggattgggaaaaaaattttactacaaagcaacagttatgttggaatgcgataggggttttacctcgatggcagcgacacaatggtctgtgacagtaacagtactggggatcccccagttccaaagtgtcttaagggtcctaggcctacttacaagcctccagtctcaaataatccaggatatcctaaacctgaggaaggaatactggacagttgggatgtcggggtcatggctgtgatggtnatggccatagtggtggnagtggcagtaatttgtgttgtcccgtacagatatcttcaaaggaggaagaagaaagggaaa

SEQ ID NO: 536604 - DNA, 172 bp, Homo sapiens
agacaacctagcaaccattaccaataagtatagcgatagaattgaacctggcgcatagatatagtaccgcaggaaagatgaaaattataccagcatattatagcaggcctacccctatactctgcatatgattaactagattacttgcaggggagcaagctagacccgaaca

SEQ ID NO: 536605 - DNA, 223 bp, Homo sapiens
tatccacgcccactgtgggtcctgcattgagcagggctgggagtgagggtttctggggcctcatgattctgggaaagcaacagctatcagatagacgagaagggccagaccccctagcctcttagattcctggagtcactcctctgtgactggcagcaccatcttccctggggggaccaacaggaagaggccggggtccagttagagaagtgcgcctaggtgc

SEQ ID NO: 536606 - DNA, 819 bp, Homo sapiens
  misc_feature (683)..(683): n is a, c, g, or t
  misc_feature (708)..(708): n is a, c, g, or t
  misc_feature (787)..(787): n is a, c, g, or t
  misc_feature (789)..(789): n is a, c, g, or t
  misc_feature (814)..(814): n is a, c, g, or t
ttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgctctgggctccttanatcaggtatccagagatttttactnctccagtgccaggcagggcctacgtccataaactcagcagggaagtagttccggaaaacagatcttcacccctttttgnancccccttaagattaaggggggagtntctaa

SEQ ID NO: 536607 - DNA, 132 bp, Homo sapiens
tatctaatcttcaacgcagataagtcgcttctacggcataatactataaggaataaaaggacccataccacccactggctttatctagagtgagagatagtagtaggggaactgtttatcatgtaatttgtc

SEQ ID NO: 536608 - DNA, 737 bp, Homo sapiens
  misc_feature (724)..(724): n is a, c, g, or t
attgggacgggggggtttatgtgtaaccggagggggcccccacccccccaaagacccgtttgtggaaggaggaccggccggctttcccttgcttctgggccggtttggctttgcaaaggcgggacaaaaagaagtggaggatgacctgccaggggggataagggcaccaattacgagacgggggccccaacactggggggggggggacataccccttaaacaggaagcgggaaatacaaccgcttttcaaaggggcagctatgaagcctggcggggccacgaccactgtaactggatgcactacaaggaagagcaggccccaaatgggcgtgggggaatatgaggcgtttccctgcaaaccaaatctgggaaaacagggacccaggagagaaactcaaaagaaaaccttccctcaccttctaaggaaaagtcccgaccacggggggtggggtttggcccctaaaattacaacgaattttgtgaaaagggggatggcgcatggtgagggaaagaagaccaaaaaatttccacctcttcctaaaggaaaaacaccgggctccccacccctcgggggctcctggggtacaaatctgaccgcgcttttattggggaaacacagaaagggggcaaaccactccgcttggggaatatttagaagaactccctcgtgggggccccgaggggataacaccaaggcgccggggacccaacggggccactgggnaagatttaacatg

SEQ ID NO: 536609 - DNA, 304 bp, Homo sapiens
  misc_feature (16)..(16): n is a, c, g, or t
  misc_feature (99)..(99): n is a, c, g, or t
  misc_feature (111)..(111): n is a, c, g, or t
  misc_feature (121)..(121): n is a, c, g, or t
  misc_feature (138)..(138): n is a, c, g, or t
  misc_feature (167)..(167): n is a, c, g, or t
  misc_feature (217)..(217): n is a, c, g, or t
  misc_feature (241)..(241): n is a, c, g, or t
  misc_feature (258)..(258): n is a, c, g, or t
agaataataatattanatgatagattaacttatttctattgcttttaccagtgaaaaaaggaatgggcatgcttacaaagggaaacaatatagaaatanacaaagcagacnattaaaggcnctccaatcccattaccntatacccacctgcagacagaatgggaagntttagtcataaatacaaagacaatacatggaaaaaaaatagacaattatnaactcgtaggaaaaaacgtaatcntagcatattccttggcncagaaatgaaaaggaattacttgggtatcaaaaaagagaaatatgg

SEQ ID NO: 536610 - DNA, 195 bp, Homo sapiens
cggctcatgtaccccggtttccggcgctgccgggtctcgtgttcgggttcgttgccccggtgccgtggaccgtggccgtgtctctccgcgcctgccccatgccgggtcgcagcagccggaggtgtctaggaccctctggacccatccctagcgggccccgtccggcggtcggcctccggtccgggctcccagtct

SEQ ID NO: 536611 - DNA, 394 bp, Homo sapiens
taagagtatccccccagttcctgcttcttgaaatgtctgttttgacatcatagtctcagctaaattttgacagtggcatatctactgttactaaaagcttctgtgtattgaatagtttcatccttcttgcgtaaaagtgagtggcttcttctgtttcaagaagcaggaactggccagttcctgcttcttgaaaccgttcctgcttctccttttgtttatctttgtggtccactctctctgactattgttcgctgtgacccgcgttgctccgtttgatgtatggaggtgcatcacgccactgcatgtttccctctgggcacacgagtaactacgggcactctgtcctctctgggcgttcacggctctaccctctgcgatcggctggcttctattc

SEQ ID NO: 536612 - DNA, 287 bp, Homo sapiens
atcccagcccataccgacggacatttcatcggagtcaccgggcccgctcgttttacaactccaggcaagcacccttaggatagccagagaccctgtctcccttcggcggataaatcgtaggtgatggagcacctcacgctattcctcatcagaagacccacaaacatgaccctcagcctgaggaccccaactccaggccctccagccccaaacctgcccagccagccctgaaaatgcaagtcttgtacgagtttgaagctaggaacccacggggacgtggcgtctgt

SEQ ID NO: 536613 - DNA, 256 bp, Homo sapiens
aatgtaactacaatctgaggaactccacgaggggctggtggaattccaatcaaagtaaactgtccaaggagtttgttgtctccagaccatctcatcattcaccctgaacacacttatacatttccagcttgcgtattgaccatacagacggcagtgagagaatacctggtctcttcttggcttggaagtagtggtattccctattaatatagtttggtaacagacaccgtcctcagagtttcaactacccgagaga

SEQ ID NO: 536614 - DNA, 253 bp, Homo sapiens
gataaggtaagcctaggtgttgacagcaggaagggatgggggagggcagtgttgtgggattcatgatgggactaagagggctcacgaggggcatccgcaatgtggggttcactgagagctgcctccgggtctcttcaccactgtagttctctcatttccaaaccatcagctgattttaaaataagatctctttgttgccatcctgtgaaatttgtaagcaatctaattaaatgggatcagcacttgaaccaga

SEQ ID NO: 536615 - DNA, 179 bp, Homo sapiens
cttaacgatccgttcacgtcagtctgtagtttaccaccacacatacacacacaagaaaccaatcgaacatcacacacatacgtacccaaccaaaaccaccagacaagagtacatacaacaaccataacaacacataatgttaccccacccccaaccacaatagggcgtgtgtctcggta

SEQ ID NO: 536616 - DNA, 1392 bp, Homo sapiens
ccatcccttgacgaatccaagaatttctccgtgccagccgtatcacacccctagtcctaaagtaacggtcatgctaaataatgctatcgtggcccaattacacccgcacaacactgttgagctatcataccctctataaaacaacacaaaaaataacaacaaaacaacacacacacaacaacgagtgtcgcgcgccagcccccacaaccacgccaccccaaaccaaaaccatctctccacacccaccacccaccacgagacagcacacgcatcatcccaccagactcattcacaagaagtccacaaacgtggcagtcacacgcggatttgcctcctcactaccactctctctgggccctacacctaacacaacagtcctgattgtgttgtttactacccacctatacacacaatatactgacggaggtgctcacccaccacgaaaggagctagacgcctgcacaacaccagccgaaagaaagagaacaatcaaaacgagagacacttactccactacaggggcggctactcttctacacaacaacaacaggatactttccctatagactacaacgtaccacacagacaactatcaaccacaacactcaccgcaccgccggccatcacccagacgcgcgtccccactatcatattatactaaccacacaatagtataatagtaatacaacaactacacaatacacctcacctaaccataaatcttctctcttgtcttctcacctccactacccacattcctattcattccgcatctctccttcactaccccctctccccacacacaacagactacacacactataattaactacaaaaatcccatacacaatcaagaccactatccacaaccccacaccacatccttcgatccaaagcaaccagagtgacataaccatcacctccccgacatcacatcacaaactcaatcatcaccaataaccgaacagacatttaaattaaaactcccacctcttatccagtaaaaactcccaaaacacactccacaacaaacacaaatcacacatcactccctcacacacacaattaacatatcaacattacaatacatacataacaaacacacaccataccaacatcagcctcacaattaaacactacacccacacaccacaacacgcccaccacctcaactaccccactcataaagcccccattaccacctatatcacaatccaactacattaccatcaataagaccaacccacaaaaaccacaatcacactcacaaacaacacaaacaatacaaccacaatcacacacaacataaattctccgaaatatctattcaacactacacccaaaataacacacaaaacccacaaagcaaacattcatcaatacatacaccat

SEQ ID NO: 536617 - DNA, 797 bp, Homo sapiens
ggcacacggagcacaggtctctgcggctgatgaaggctgtgaccagacgcacccaacccttggtaggccatctgtccctgcagactatagcccacattcctcatgacctccctctgtcttgtcgtgggagaccagtgtctgtacagttctctagggccccagcgccctggttatggtgaattgcgcattgccattgatttcatggtgtgctccagtggcaatccccatgcctagctccctaattccctaggtttggaacgaatgttagctcgacacgatgctccatcaaggcaaacacggttcatgtgcgtctccggtgtcactgacttacgcgatccgtacccaaccgcccctgttcacttgcgtggagtcattacaggctatggttggccttgagcttggaccgggcattcccactcttcatatcagtcgcgtaggcaccttcctggggtcattcgcgtatgcggcgcggtcgtggacgactgctagcaacgtacagcgttgtggtggatggcgtccgtaccattggtcgttaaactccttggcccgggcccaagctgagcacttggacgtcattctagcacacattcctcggcatagctcggcgtctcggtctgcttctcgtacttgactgcaacttagcatcccatcattggcccacgtatcacgcgcgacacatctcatgtgcgcgagaacggacggggtgccgcgcatctttcacatgcatgaaacattgtacgggcaagaccgtgctatctttcctgaatgctcgatcaagcgatggacccgatagcgcc

SEQ ID NO: 536618 - DNA, 567 bp, Homo sapiens
ggctcactgcagcctccacatcctgggttcaagcattctcccgcctcggctcccgagtagctgggactacaggtgcaagccaccatgcccagctaattttttgtattttagtggagacggggtttcactgtgttgcccaggctggtctcgaactcctgaaactcctgagctcaggcggtctgcctgcttcgtcctcccaaagtgctgggattacaggcttgagctactgtgcctggcccagtaaagctatttttcaaacacaaaggaaggataaagacatttccagacacacaaaagttgagggaatacatcaatgccagacctgttttacaagaactgtgtattagtctgttctcatgctgctaataaagacatacccgacactggataatttataaaggaaggagatttaattggactcacagttccacatggctcaggaggccttacaatcatggcagaaggtgcacctgcaggcagcaaagtcatattttacatagcggcaggcaagacagcttgtgcagtggaaccttccatttataaaactatcagagacttattcatacc

SEQ ID NO: 536619 - DNA, 397 bp, Homo sapiens
  misc_feature (143)..(143): n is a, c, g, or t
cgagcgatccgacacatagaatgacaacatagaatgcaggagtaatgaataacacgtgaagcaatttagaaaagcatgttaccgtaacagactagcaagccacacttcctcaggcctcgtattcatgagcccacttaacaggnagccacatttacacatacacaaaacatatgcagtcagtatgcacaatacaaccactagatagggtacccacaaatagaaagaacaatttccacatcgcctgggaacaggtctggtttatgccttttgatctgttgtaattaatagcatcccctttctctctcaatagtcccaatttgggcaacgaattatatggtgattcttctacctcaaacaaacatggtttatgataaagacatgatagtaaatgccaaca

SEQ ID NO: 536620 - DNA, 912 bp, Homo sapiens
tcattttgattaacaggactagcttatcatgagagccctcaggggaaagggtttaagaaaaacaactcctctttcccatagtcagagttgaatttttcaggcgtgcctgacaaattcaactctgactatgggaaagaggagttgaatttgtcaggcacgcctgaaatgtgctcatagccaaaacattttactctctcctcctagaatgctgcccttgacatttcccattgctgtatgttatttcttgctctgtgatcttttgccctcttagaatgtccctctcttgggacttgcttagatgatgggatatgaatattattagacagtaattttgctttccatccagtactgctagttcttattcgagaactatggtcagagcgtacttcgcgatatcagtatcctttgcttatctttgtagtactgccaaattccgccgaagtacactggctgtgcagaatgctaatagaagcttctcttattcttcgtcttcttacgatcagtactctcctaccagtattctctctacaatgatccctcttgttcgtaacagttccacaagaaatatctgactcactattcacacacaagcacttgcctgaatcatctgcctaactcaaatctcaacgggggtccttcccacgttaacgtaaccaaccataccctcgctaagctaaggacagaaagccattggttcccttaaacatatagacatattcccttctaatcaccccacgcagaaaccaccatgcaactattctagcctctcactcaattgctccaacacacgagctcacatgtctacaacgccgcagtcatcaattctctctacatctgacgctgtgccagaacacttgcaaagagtccccacaatcaccgatcgagacgacataggtcacatttcagtcccta

SEQ ID NO: 536621 - DNA, 295 bp, Homo sapiens
ggacctctacactggtcgagtcttgagtgtctgtacagtgatctgctgtgaatttagttcagctgaagacagtcttctcagatttcactgactgtgaagtgtgaaacacgggacgcatacttgatacttaggtgctgctgaactactttcgcaaaggcaaatgtgttaaaattcaaggccatctggaacgggggactatttccaaacttccttaggcagcacttttcagtgacttccccgcacgctgctttccctgccacgaagcgcttggtctgcttactaaagccacgtatcc

SEQ ID NO: 536622 - DNA, 283 bp, Homo sapiens
  misc_feature (49)..(49): n is a, c, g, or t
  misc_feature (91)..(91): n is a, c, g, or t
  misc_feature (204)..(204): n is a, c, g, or t
  misc_feature (208)..(208): n is a, c, g, or t
tccgagacatgtaccggtggccgccattcaccaaggccaagttgaccanctatccttatgtcaaggtgtacatgtaccagctcttccgcanttggcctacatccctcccagggcgtgtgtcaccgcgacatcaagccccagacctgctggtggactgacactgctgtcctcaagtctggattttggcagtgaaagagttggtcngggngccaatgtctcctacattgttctcgctactaccgggcccagagctcattttggagccatgattacactcatcacg

SEQ ID NO: 536623 - DNA, 206 bp, Homo sapiens
ctcccaggtatgatggattacaggtactcaccaccaggtcagctacttttgtatttttagtagagacagggtttcagcatgttggccaggctggtctctaactcctgacctcagatggtctgcccgcctccgcctcccaaagtgctgggattgcaggcgtgagccactgcgcccggccactttcacactttttacagtgagcggtg

SEQ ID NO: 536624 - DNA, 1040 bp, Homo sapiens
tacgagcccgtgctgatcgagatctggtggaggtgagatccttccttcgtgtgcttgaaagttggagcctgcccctcgtgcccataagcccttgtggggaactgaagaagtgtatattggagtgcccaagactagctggtgcgcataacacagcagagagcagcccagtgtcaatgctgtcgagcattgcacaaactgccatgtgtggtaagactaggaacggaggaatatgtccatctggcgtaggaagaaccagaagtattcgcgctctactttgtctactctgtgtgtcctggggagaatgaaccgcaacagtatctagtattgacttatgtataatagaaaatagggctcctcgcacaccgtccccccatcttctgtagtcctttgtattgtagcattgcctgtctgtcacatgcggagccccgtagccccttggcgagacgatagctgcttctagtggccccttttctctctgctacatggatgtttgatgcgcttggaggtcttttccgacctgcccttgcctggtgcctgctgtgtggatggtcggagagcgtctgctgtgcgatgcagcctacagtatcttgactggagaggcccatcgtttctcttggttcgaggccttgttcttgagcgcctgtacatgtgcttgggcactgtgtgggcctgtgcttctgaggtgtctcctggcctgatcgagggaccctccccgctatctggggggctctcagcgtgtacatacgcagcaaccaggaaaggcagttttatatttgaaagattaggaaagcctgggaataaatccaagttttaaatgatgttattccccctgtaatagccataggattttggaacgcagctgccggtggctgggacatcagggggcccggtcctgacccgggtcaactggattgggcttcccggtctctgggcccccgttgggggctgaggtttgggggaaagggcccgcaaaaacgtacccaaggccgggccgtttaaggtaggggcgtccccgaaaccgggggggacccccctattat

SEQ ID NO: 536625 - DNA, 123 bp, Homo sapiens
tccctttgcctcattgttctgtagttgcgtggccttctcttggctgttatgaagcaagtgggtgagtaaaactattttgacgtgggagcgttttcagataggagtttagtcttgttgggagct

SEQ ID NO: 536626 - DNA, 256 bp, Homo sapiens
aggccagctcacggagaccactgaggcagcctgcagatcggagccttcgcgctgcccttcaccgtggcccatgtggatcgccaaacccacatgtaatctggctctgaccggatggagctgctggcgcacctgctgggcagagaagtgcgctgggtgcgcacccaggcgcacttctgtacccttgcgtttccggcacaccaagctggcagctgtgatgagctggatggcgtagcgcagtgacgtctccagcccgatg

SEQ ID NO: 536627 - DNA, 949 bp, Homo sapiens
cccgcgctccaggtggtaagtgtgcgcaagcgttttgtgtccggttaaattaaaacgggggtatcaaaggaacccggggagctttgaattccggacttaaacatcctggggctccaactcactgaccagtcgtcagttttctttgagttaagattcacagcctttcttgtcttaaatcgggctgcaactagtaacgactgtgggcttcacctgtcacgcccatggacttgctgaggctgctcccagaccagcggtagaactgtaagttccaataaacctctttcgtaacagtcccagcgaaaatcactatttaagatactaggatggacttgtgactgttgaggagtacttacagtatcctacatttgactacattatttccaaagccaagtacttgccatccaaaggaacatatctgctatcatagagaccaaggagggaactgctttaaggttgccaaggtgaagcgacgctgagaggcttggtcctcgtgccagtaactctgaaatctctctctaattcctgctgtccaggcagcagaactgccatggtttccccaagtaggtagctgctttagcagttaaagcccaaagtgtcatgttcatgttgatcagaggtcgtctgaatttctgaagtggtgttttacgtattctggtgaactgattgcttaatccattgtacaatcccatccttgataacagtgtgctaataacgagaagaatccaccttatcaaagctgcagaagccagagccgtgccactaaattgagccaacgtccaagctcgatgtgccatgcaggaagtctctggccagctgtccctgtgaagaccccctcactcccccccagctgctgccttgcacactgaagcatctcagaactgtgcaaagccgtgtagtcatcaagaccagtaaatcccagggcttggttaagtgtatctgtgataacttg

SEQ ID NO: 536628 - DNA, 256 bp, Homo sapiens
cactgtcagtatacgagaagatgttagtctaccgaggccctagtggactaattaactgctagtggggggtaacagctcaacctgttcctgctccggcctccactattgcagatgcgagcatgagtaagagagaaggaggtaagagtcagaagcttgtgttgtttatgcggggaaacgccatatcgggggcaccgattattaggggaaacagtcagtagtcaaagccttcgattttgatggtttttactatgactaa

SEQ ID NO: 536629 - DNA, 968 bp, Homo sapiens
gttttttatttggttttttaaaccttcccttataagcatgcctgtgtaggggttgacagtgagggtaataatgactggtgggtggatggtaaattatggggctgtaaatttgtcagatctcaggtggtttaaatctctgtgacgcaggcttataatgcgtgaggagaaagtgttatcacaggtgttatgactataatagcatagccatttagtttctttcataataggggtgaatagaatgggtctccaaggtgggtgtgatagaggagtttcagttatagtattgtttgggggaatttatcataggatagtagtgggtgtgttgaagagcactatgtgaaagcagcaattatcttataaattcgaggcgtgggactgtgcttatattgaagcgccccataaccatatgtggtgtgtgttacaacaattatttcataaacactcatcaatctataacaagagggttatatatacttcactataagtgtgtctcccaaaagagaggcgtgggtacacactctatgtgggggcactctaaaaaccagtgtatacacaaagtatttaacgaaagggggggagaatgtatattcaaggaacgggagtttctctcgtgtgttgggacgccaacaaaatgtcattatacaagagcggattttggacaagcttataagagagaatatgatctataatctctatggtgggcacccaatcacgacgaggctattatactccaagcacagaagggacactccgtcagaagagaggatttagattgaatacgacgccccaatcaataggcccgattatattagaaattgtcgtgttatcccccacacactcataaagtattgtgtggcgcacattaacaatgataatagagccgggtgtgtgtatggatggccctccctttaaacataggccgtgtatgtcaccattcagaagggaataaacccactcagacaacgtgg

SEQ ID NO: 536630 - DNA, 1622 bp, Homo sapiens
  misc_feature (1412)..(1412): n is a, c, g, or t
  misc_feature (1622)..(1622): n is a, c, g, or t
ggagagagagagagaactagtctcgagtttttattttttttattttggaaataaataacaaaggatattttatttttattttatataaaacatgtgcagtttacaacaaatttttaaaaaaagtggaacaaaacttggggacaaggcaagtgtgggagtggaagacagagtgctctcctcagcccactcagcgaggaattaaagtgaagccggcgagcacaagcttgtgtgctccagggatcatccaaagggccctttgtgggacaatgtggatattgggcaaccacggtggtttgtgcttgtggcgccacacaacacctctctatactgtgtgcggtggcccctctcacagggatattccctgtagaagcatgtgtggtgtgagatctatggtgcgctaaaatgtctcttgagaatactaactgagtgggtaatcactctctctggtcacatctggtccacagaggatctatacaaaatactctctaaaagccacgtctaaagagaatcttcacacaggttatatggggtcgcccccagggaagtctattctctctggctcgggggatatattaaagtcacaccccagggatatatttaagagatatacacccaattatatcttttccacatttctggggggtccacatttctaaaagatctctcctatgtgtttctgggtgaccccatctgtgtgtttgtgggcgaaaagatatgcgacacagacaggggatatgcgaacatcttggggcgtcccctaaagaacacccttttggcaaccaaaattatcctgcgctggtgggtctcccaggtgtcaatttactaaattaggccacccattctggggtgggaccctctaaaaaaccctctggagccacgtgttcccagtcactctggggacactgggcgcccacgcgcgtacattacgacccaaaatctataagagggaaaaggctcattctaccccccaggtcctcagggggggggtctaaactaaagcacacaccacgtctacaaacagcgcggcgcaacgacagggggcctccgggagaggcatcccttagtgggggcaacacggcgcgtcaaccacccaagaaagtcacgcccaagcgactcctgcgacagggagacacaacacaccgcgcgtgacactcaccgtaggagggacactctgaagggtagtgggaggccccaacagcaggggcacaccgaggggccaccacttccacagaggcgcaacatgacatatcagcggcccgctgtccacacagcataaaggagcaccccccgtagatgaaccactcgttatgtgcgggctcaaagaagcattcacaacggtcacacgaggccaccaaattaagcgtaatagcaccaaataacaaccggtctcacgactaccagcatacaggggncagcgggaggcgccactccaccacgtgggtacgaggggtacctccgaagagaatgaatcaggcgccagaagagcacagccagcgaacgcaggcggagcaacacaatccctagaggagccatgaaaacagaaaatagttcacgactgtccttacgcccatcggtagctgcccagctctggacgtcacacaaatacctgcatggaagacaan

SEQ ID NO: 536631 - DNA, 884 bp, Homo sapiens
  misc_feature (523)..(523): n is a, c, g, or t
tcgcacgggatggggagacccgtgggtcgccccgagaattgcgccccgcagaggacaagcgaaaagtggggggcccgcccagaggacacccagatcgggggtagaatccccccccccgggtggggtcccacatagtaacaaaccgcgaatgtatgttcttcaaacagcggcccaagaaactgaattacgggcgttctccccgccgcagcgataatagagtgctcgtgggcgcgacccgtgacgacaatgtcgacgaagttcgccgtaggccccttcgctgaaaaaaagataaatgggacagagagcctaaagacggtggtggaatggacagcgattgttgacctccggtctaccagacgttggttgtcgcaccagaaggagcgctccgagtccaaatagtggggtaaagggaaagaatcgtggagaaattctttacaagaggggctgatcaagggaaccacagaagtgttgttttcccttccgggaactctgaccccaaaagccgtgctgtgtgggagttganaagagcattatgcctgttctctggtgaagataatatgcgtccacatgtggctgtgtacgagcgcaaaagatgggttgccacgccgattagttgtcatgccagaaatcttttagttgtgtcttcgtgcgaaaaattgcgcacgctgcaatacattttggagtcctaaaaatgatcaagcggtgcctccttgaagcgctatgttagggacgaacacattgtggtttgtccgtccgacgcgtgtgtagtcgcactatcacaccccataagaagtagcggggcgcgaacatgtgcaatctcgccacaatgtcactccttcccaaaaaaccctgcggaacaaaaaatttctgaacaaacaaaaaca

SEQ ID NO: 536632 - DNA, 297 bp, Homo sapiens
ttcttcatccaaaaaagtttatttctcccacgtaattaaatattaggtgtgggtataaaaaagcgttataaattttttctttcgcgaaggcaggttcacagttttgtttaaataatattgctttctggatgtgaggtatagcaccagagctaggtgtttaatggttaatatgatgcacatcagtttaatgaatgtgttgagcagtttttcatgtgaatcctgtcttaaagggctcagttttccactgtgttatccattgatgtaacgctgtatttagttatgtttttatgaaataaa

SEQ ID NO: 536633 - DNA, 304 bp, Homo sapiens
gccacaggttgagtcataggggaacagtaggaaacaggatcagcacagaatccaacctagagctcaaagtttaaaacagaacggaggtggggaagagctggagcttccagggcgggccccctgagaagcaagcactcctctttaaacattcttgtggtcatgggtctacttctagcgatacaccagaaaaactatatgagtcacacccgccaagaaaaatgcacgtgatgctcacattaattctgcttttcacttctggggattcacaggtccctgaaagccaagccacagactggagattatg

SEQ ID NO: 536634 - DNA, 359 bp, Homo sapiens
gagagagagagatacaaaagaacagaaaggctaaaaccaacataaatttaaaaaacaattcaggatatgaatgaaaattttctaaattgatattttaaagaaaaaccaaccagaacttctggaagcgaaagacatatttagggaactacaacatgcagtggcaagctttaacaatagactagaccaagtaggaaaaagaatttcagaactcaaagacaagacttttgaatcagcccagtcagacaaaaattatgacagaagaattaaaagaaatgaacaaagtcatccggaaatagggaattatacaaaatggcccttaacaattataggtgttcctaagaggagaggagatttagact

SEQ ID NO: 536635 - DNA, 651 bp, Homo sapiens
cctttcatagagcgtatcaccttcatgtcacccctcataatcatggtcctatctgcttcctagtcctgtatgccctttcctgacactccgaccaacttactgatactacatctcagacgctcaggaatagaaaccctctgactatcctgccccccatcatcctagtcctcatcgccctcccatccctacgcatcctttacataacagacgaggtccacgatccctcccttacccatccaatccattggccccccatggtgactgaacctacgagtacaccgactacggcggactaatctttccactcctacatacttccccccttattcctagacccggcgacctgcgactccttgacgttgaccatcgagtagtactcccgattggagcccccccattcgtataataattacatcaccagacgtcttgcactcatgagctgtccccaccttaggcttaaaaacccgatgccattccccggacgtttaaacccaaccactttcaccctacacaccgggggtatactacggtcaatctctgaatcttggaccaaccacagtttcatcccatctcctagaattaattcccctaaaatctttgaaatagggccctatttaccctatagcaccccctctaccccctttagagcca

SEQ ID NO: 536636 - DNA, 296 bp, Homo sapiens
cagtgtgtctgggcccaccgacagcgcatacggaaaagtgattcctgactaagttattgtactggactgagtctccggggaatcgtaggggactttaccataacattgaatttaacagcagaaaatatgtatgagtttcaggcggtggtttggaatcttaactttatccccttctaacctattctcttttggtgatcttagcagctcagtcagaggggcagaccctgttgaaatataactccaggcatctaaccagaacgggggacaggttcccagcccaaactggtaacacatcc

SEQ ID NO: 536637 - DNA, 114 bp, Homo sapiens
atcccccgggctgtaggacttcggcacgagggagttttaaccctacgaattcagttacaaggttgaagttagtgagcagtctcctgttctgccctcttgcgcactcttgaactt

SEQ ID NO: 536638 - DNA, 326 bp, Homo sapiens
ttgtatcccctgataacggcacgacgggtgaacgcaagtaacaccccactaacggcagtgacttcgccagcggatgctcataatcactacgattaacatcgccccaggtcgtatggcctgctgccatcgcctgccaggcaatatccagcgaatggcgcgtaaagtcttcccaactgctattcccttctggcacccattttcccgcattcatcagtgagaataaggtttcatcccagcgagggttggcacgccggtaaattgcctgcggccattggcttgccagctggctgtccagctcactgaaaagcgttgagtagagatcatca

SEQ ID NO: 536639 - DNA, 321 bp, Homo sapiens
  misc_feature (282)..(282): n is a, c, g, or t
aataaggaagattaagataaatgaactagacatataactctagaatgtagaaaaagaacagtaaatgaatcttaaggaaatagaaggaaggaagaaataaagataagaaaaaaagaaagcaagaagaaaaaaatcacaatacaattgattagatacaagattatttagagaaaatttttttaggcaattctagatcaaacgaaaaaagacagagacaataacacaacattgaggaattatatattaaacgatataaacaggcaataggacaaaatataaganaaatacacagtcagcaattttataactactcaacattga

SEQ ID NO: 536640 - DNA, 240 bp, Homo sapiens
gatgtggacaaggcatcaacctcgcaagaaggcttgtcacaatgccttagtgctatgctcacacccccatggtaaacagcagtgattaacctttagcaataaacgaaagtttaactatgctatactaaccccagggttggtcaatttcgtgcctgccagcgcgctcacgcgattaacccaagtcaatagaagccggcgtaaagagtgttttagatcaccccctcccccggtacatgcaag

SEQ ID NO: 536641 - DNA, 130 bp, Homo sapiens
tgataagaggggctcaaacaggtagaagacgtccaggtgctggttgaatgagctggccacgaaggaggagccactgcgcgtggtgcgcaggatagaggatgtgggtcttgcgaggagaggttgtagggcg

SEQ ID NO: 536642 - DNA, 244 bp, Homo sapiens
ggatgcctcgagtcgacttctgctctccagcagctcacaaggacttctccgcgctggagtccagctgcaggacactcaggagctgctgagggaggagaaaccgggagaagctgaacctgaggaacaaagctcaaggcaggtgggaggacgagaaagaaatcccttccggggagcaagctggagggagggaggagtgagtgcccattgcgctttcagacattcttgggggccactgtacattcca

SEQ ID NO: 536643 - DNA, 675 bp, Homo sapiens
ggagatgcgggctgatcatcgcagcagtcctggaccctgtacttcggacttggagaagaaacgccgaggaggaacgggagttagtggggttagcagtcttgcgcgcgctggtgagccggccaaccctggtctccaggacttcacttcccaggatggcctctgcgcagctgactggaagtgctgcgacgcctataagaaggctaagcaggacccgtcggctctgctctggggcggcattggcagcacggcttgtaggcattcagggcatgtgtcttctgcatctactaggaacctcgggagcggtagctccggcgcctggtagcgagaggcgaggttcctggagatcccgggctcactttcgtcccactgtggttaggggtgagtcctgcaaatgtcaagtgatttggctcaagggtgcccatattcgcaggaattggagcccaggccagttctctgagcctatcattagcggctaaacggagtgcgtgatcagaatggtgtctggacggttctacctgtcctgcctgctgctggggtccctgggcatctatgtgcatcctcttcactatctactggatgccagtactggcgtggtggcctttgcctggaatggcagcatctacatgtccaacctggcacccagtgcttatggttgctggcataggtggtatccta

SEQ ID NO: 536644 - DNA, 250 bp, Homo sapiens
  misc_feature (6)..(6): n is a, c, g, or t
  misc_feature (64)..(65): n is a, c, g, or t
  misc_feature (190)..(191): n is a, c, g, or t
gacgangagaaggggagagagaaggctaacgggagtcgtttctagggtgacacttccaattagnngggggagtttgtggcctgcagtaatgtccccggttaggcgtacggccagagatattgattggatgagtaggctgatggtttcgataataactagtatggggataaggggtgtaggtgtgcctagnnggaagaagtgggctagggcatttttaatcttagagcgaaagcctataatcactgcgccc

SEQ ID NO: 536645 - DNA, 176 bp, Homo sapiens
tgcatatgcagtggatggtcgtgcggaactgctccagtttctgcatcagaggataagcagactaagcatgagccaatattgaaggccgaattcctaccgtacaatggattgattcaccgcatgactgtgtgcgtgaagctggaagctgaaggcaaaggtgtcgtggtggtcattaa

SEQ ID NO: 536646 - DNA, 723 bp, Homo sapiens
tgcggcgcacatttacaggaaaacatagctcctttgcatgctccttgagttcctctgctgcttctccccccagtgttcgtgttgttattgagagagtgacaaggactgccaaaaatggggattgccacagaatctggcctgctgccattaacggcattaaagcactcttactgtccaagagataggctgtgggtaaatagtgtagtgcctataaaacattttcccccaaatcttttaacttaaaaagttagtactggggacaaaattgacacagatagctcagaggttccccagtggcactcaagcatgtgttggtgtggcattgcctgcaaaacaccttcacattcctatggagttctttgtgggcctctctctttgaaagatgtctgtagagatgagcttggccagtgctcagtaactgtactagccagtttggggatgtgctagttcaagctagtccctttcccactagattaagctgcatagaattatgatagagtggtttggccagcactgggatacgtcacattgtaaataagtgaaaatattcataatattgtgttctgttttatgtgctaaagtgtgaactgccatcctctccttcaaaagcaatgtgagaaatgggaagctgtattgcattgtcatggaataagtttcacagagattgcgttttgcatgtggaattataacctagatacagaataaacctgagtctctggtcca

SEQ ID NO: 536647 - DNA, 1321 bp, Homo sapiens
  misc_feature (785)..(785): n is a, c, g, or t
ggaacgaatggtacatacagcatcatcgtagagacattggcagagcactagtcgtggagcactggcgcataccttatgcagtgattattcagagagccaaatatagggcatgagactcaatcacaagatgaagtaggacatgaacgactagagatagcaagagcttgctagacatagtcatatacccagatggaaagacgtagagtagacgcgccgactggcttgtatattgcagctgttgaacatggtcatgaagagggtgaacgttaacctgtacaagactcatagtctatgtgatctgttgtagccacgacatctgtctccacgctaggtactgtttggacgacatatgtgatgctacacgaagagcgactcttagcatttaaagggttcgtactggttggccagcgcgttgattagttccatttctcactagaacctggactttttccaatggaatggtgaataaggcccgttagaagatcagcgcgttcgacaggtgttgggttccaaaagggcgctggttgggatggcgcaccattccaaggcaatggagtgcgtacgcgccctatggagactaggtgtatcgcactcgcggaatggacaatcctctttcaaggtcaagaagctacataaagaacctaggcggtctaaagggggctagacctctatcgagaatagaagaaacgccctttgtttccctcgttagacaccaacgagccatagggatcgaatttgattccaataggatataggactcttggcggtcgggattgaggtacaanacgtaaaccacaagcttcggatgtatcggtatcccaccaagggcaaaaagccggaaagcgtgggcaggggggccactccgaaaagcgatattcgaggaaggcgaatatcgaagtgtgtaagtatggcccttggacagcgagaacccgaggtgcctccgagaagaggttctgcgcaaacgaaacgagggtcctctagagtaggcgatataaaggcatgttttcggtgcatgtaggcggatctcccccacaggggtaccctagttgcgttccaagtccaagttggacgaaacgcagttggagacccaccttttaagctttaagaccccataaaggagaacccaaagagattcacttggtttgcgcgacaacaagcaagacattggcacaaggcggaataagaggcaccactggaagaaggaaagtgtcaacataacattcgtgactcttctcccaaatgggctctttgggagaacaccaaaggcggagcgaaaaaatagtgcagtggtacgtggaaaacatcctttctccgtacccaa

SEQ ID NO: 536648 - DNA, 325 bp, Homo sapiens
cggtaccccaagggtcattaagccgatatagttattaacccattttttatcacatctgaagtgccagcaccgtttactgagatcacagatctttacatagtacttaactttttactcttttattttgagatggagtcttgctcgtgtggctcaggctggagcgcagtggtgcaatctcagctcactgcaaactctgcctcccgagtagttgaaattacaggtgcgtgccaccacatctggctaatttttgtatttttagtagagactgggtttcaccatgttggccaggctggtctcgaactcctgggcttaagggacccttggg

SEQ ID NO: 536649 - DNA, 298 bp, Homo sapiens
gacgcacgcaaactatggcacacactacctacccagccactctctgttcttcattcactagttaacagacatacatttatcacaaaaaaacagttttttttaagacaagtcagggtttttatctttgtgggcctctgtgtagagttcacctctttacaccatggggttatatcaaatgacagactgaaggactcttagaaaggctgataggctaaaaagaaaccagacagaaggacttggatatgtatcttcctacctcaccaattgagaaacgggtatgggttttatttacatatcg

SEQ ID NO: 536650 - DNA, 472 bp, Homo sapiens
tttttttatttattcccaggtttgtcttgttttttttttcccaggcctctctccctctttttttgctttctttttttctttttttcggataaacatcccccaggtgaccattaaatactggaattttttaaggcttattcccaagcttcctttttttatgccactttcccccatgggtgactcatccatgcaaaaattgtaatccctccctatttcaagaggatttttccgttggtaaagggagcccaggtctcacaagaaaaatccagagccatgggcccattttccttcttgtgggctacactgggatataattgctatctgggtcgctgcctgggttagaggcatcctcattaatataataccaaaccaaacctcaggggttactcgggacatctttcactttctcacttagaaataggacccgccaggtttattccctaaatcaaataatccacctaaatcaaataat

SEQ ID NO: 536651 - DNA, 101 bp, Homo sapiens
tcctagtatcataccacaataccaatatagagatgtcaccagtcccggtcttccatgctcatgcaaaccaccctccatcccattcttctaacaatgcccta

SEQ ID NO: 536652 - DNA, 3137 bp, Homo sapiens
tgatgcctcccgtcagtacaaccggacgctgaacagaaacagatgaattgttatcttgatgccagaaatgcccataactgttgtatggtttgtggttccctcgacaacaaccctgatacggtgaacttaatgttttcagaatacccggatggatctgtatgtgctgactacacggccgatcacagacatcaggggtatacgggtcttttacatggcggaatgacgagtaccttgctggatgccgcaatgactcactgcttgtttatgcagggagtgcaggccctgacggctgaactgactgtcagattcatttcacccgtttgtaccggtgacaagctgatggtctgtgccagactgcttgggcaacgcaggggggtttaccagctcgaagcatggctggcaaagggacagcagaaagtggctcgtgccacggcgaaattcattgtcccgtcgcaggatattgctctggcgcatggctagtgtggcagacgccaggtgtaactggttattataaaaatatgaagcgtgttttgctcagaccggaaagaataatggcatatcgtatatcccacttaaacagtgtaagaggtagttatgagtaaacaaataattgatattggtattcctgaatcatcccgggtggagattgcagacggtctgtcccggcttcttgctgacacctataccctgtatataaaaacacattactatcactggaatgtaactggccccatgtttaacagcttacatttaatgtttgaaaatcaatacaatgagctggccactgctgttgatgatatcgctgaacgtatacgctcgctcggatgcttcgcgcccggcacatatcatgaattttcacgtttaacagcggttaatgaagacaaggatattccggcagcaaaaaacatgattgagaatcttgtccagggccaggagactgtggttaaaactgcgcgctccctgttccctgttgttaataatgcgaatgatgaagccacagcagatctgcttacacaacgtatccagttacatgagaaaactgcctggatgttgcgcagcctgcttgaataatgtaaaccggtggcagcagaaaaaacggtttgtcagccacaggccattgctgtcagtgcagtaccatccgtgctgccgtggctgttttttctgaccgtaatagtataaaaaccgataaatcaataagttaaacagtgaacgcgtgagcgataaatacagtccggacaggcattaccgatgggtatatccggaccactgtcgctttcccgttataatatcgcagataccggccaggctcttcacaacctgacagggttaatgctgcaatgataaaacggtttgcgtggaaagcaggatcacattattcgttgttatggcttcctttacctgtgcctgcctgcgggcagtagagatcatacaaggtatttaacaacgtcatgatacggttatcctcaatacggtaatataccattttacctgcccgtcgggtctcgacaagcttcaggcggcgcattacacccagttgctgagacagggtcggctgagtgataccgactgcagcttccagctcggccacattcgcttccccatggcttaactggcacatcaacagcaaccggtcgctgttagccagtccccgtaagacatctgctgcccccagggctgcatttttcatatcggtctgacgttttgtgtcttcattcatgggcattgctggtttctcacattctgtatttttatataatgttatttagtatactgatggtgccataattttgccaccgtgttcgccaggtctgcagcgtccagctggcctgggtaactaattatatctggcagacattttgccccgagtgaacagagaggatgtaatgaaaatagtgattgttggtggtgttgccggcggtgcgtccgctgcagccagagctcgccggttgtcagaagatgtcagtattgttgtgtttgaacggggaagcgatgtctctttcgccaactgtggattgccttatcatataggcggaaaaattccgttacggcagtcacttattcttaagactccggaggattttaaatcccgctttaacatagacgtccgtacctgccatgaagtgacgtcagtggatccggttaataaaacagtgacagttaaaaatttgacctcaggtgagatccataccgaagtatgggatcgtctactcctcagtaccggagccgcgccggttgtccctcctttgcccgggctacagcaagagggcgtctttacgctccgaaatcttactgacatggatgctatcctggcgtggattgagcaacataacgtcgctcacaccacgcttgtcggggggggattcatcggacttgaagtgatggaggctctgagcgaacgggggatccgtgttaccctgctggagatggaggaacaggttatggctccggttgatcctgaaatggcatcagccctgcatcaggaaatccggaatcatggcgtggatctgcgtctcagaacggcactcaccgaggtgctgcggacagaaacgggattccgcgttgcactgtctgacggtggctttgtgcagaccgacatggttattctcgccatcggggtaaaacctgagaacagccttgccacagtagccgggctcgaagtgggtaaacggggaggtataagcgtcaatgcctgtatgcagaccagtattcctgacatctacgccgtgggggatgcagttgaaacacctgaccttgtctttcaggaacccgctaatattcctctggctgggcccgccaaccgccagggacgcattgctgctgataacatgcttgatcaccacagcctttaccatggcagtcaggggacatccatttgtaaggtattttcgctgagtattggcagcgtcggtgcgaatgaaaagcaactgaaagcccatggtacccgatacgagaaggtttacgtccatgctgctgatcatgccggttactaccctggggctacgatgatcagtctgaaactgctgttcagccccgataccggtaaaattctgggggcccaggcgtcagggaaaaaaggggttgataaacgcatcgatgttctgtctgtcgcgcagcgcgcgggacttaccgtcaacgat

SEQ ID NO: 536653 - DNA, 664 bp, Homo sapiens
  misc_feature (10)..(10): n is a, c, g, or t
  misc_feature (79)..(79): n is a, c, g, or t
  misc_feature (87)..(87): n is a, c, g, or t
  misc_feature (121)..(121): n is a, c, g, or t
  misc_feature (124)..(124): n is a, c, g, or t
  misc_feature (133)..(133): n is a, c, g, or t
  misc_feature (142)..(142): n is a, c, g, or t
  misc_feature (152)..(152): n is a, c, g, or t
  misc_feature (159)..(159): n is a, c, g, or t
  misc_feature (168)..(169): n is a, c, g, or t
  misc_feature (178)..(178): n is a, c, g, or t
  misc_feature (201)..(201): n is a, c, g, or t
  misc_feature (222)..(222): n is a, c, g, or t
  misc_feature (224)..(224): n is a, c, g, or t
  misc_feature (238)..(238): n is a, c, g, or t
  misc_feature (242)..(242): n is a, c, g, or t
  misc_feature (244)..(244): n is a, c, g, or t
  misc_feature (246)..(246): n is a, c, g, or t
  misc_feature (249)..(249): n is a, c, g, or t
  misc_feature (253)..(253): n is a, c, g, or t
  misc_feature (260)..(260): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (284)..(284): n is a, c, g, or t
  misc_feature (308)..(308): n is a, c, g, or t
  misc_feature (316)..(318): n is a, c, g, or t
  misc_feature (328)..(328): n is a, c, g, or t
  misc_feature (345)..(345): n is a, c, g, or t
  misc_feature (348)..(349): n is a, c, g, or t
  misc_feature (357)..(357): n is a, c, g, or t
  misc_feature (359)..(359): n is a, c, g, or t
  misc_feature (366)..(366): n is a, c, g, or t
  misc_feature (373)..(374): n is a, c, g, or t
  misc_feature (382)..(383): n is a, c, g, or t
  misc_feature (388)..(388): n is a, c, g, or t
  misc_feature (393)..(393): n is a, c, g, or t
  misc_feature (471)..(471): n is a, c, g, or t
  misc_feature (476)..(476): n is a, c, g, or t
  misc_feature (478)..(478): n is a, c, g, or t
  misc_feature (513)..(513): n is a, c, g, or t
  misc_feature (521)..(522): n is a, c, g, or t
  misc_feature (543)..(543): n is a, c, g, or t
  misc_feature (569)..(569): n is a, c, g, or t
  misc_feature (574)..(574): n is a, c, g, or t
  misc_feature (578)..(578): n is a, c, g, or t
  misc_feature (637)..(637): n is a, c, g, or t
cacattaggnaaagcaaaaaacccagataagtgtacataatgataaaatctaaagtgatgagaaaacataaaatatttncatttggncctgtcacctaacaaaactatcgataaatatganaanatagtaatnactaaagcnggttaaaggnacatganaacataatnnctttatacncatccagttattttatacaaggnactgctatcccttaaatgggngngtgaacgacttgtntaananantanccgngcactangtacctacaanganaccncttccnccaaagactcaaacagattaacantgcaaaannntacttctgtngcactgacttctgacanccnncctaattnangcatatnccagtcnnatataatnnattcnggttncaacaacagtaatacaaagtcgacaattttccgccaggaagaccattcacttcatagctgcaaaaacacactgtagcntttcngnaagggtctgccaggcttgcagcgtgagccgggtgnttaaccanncacttcaaatttacatcgatncacgccaggcacggtggcgtgggccngttgncccnactacttcgaaggctgaggcagggggatcactctgatcccaggagtgcaaagacagccngggcaacaaagaagaacctgtctctta

SEQ ID NO: 536654 - DNA, 111 bp, Homo sapiens
tcaacataggcatagccccctttcacttctgagtcccagaggttacccaaggtacccctctgacatccggcctgcttctactcacatgacaaaaactagcccctagaggtg

SEQ ID NO: 536655 - DNA, 898 bp, Homo sapiens
gcaccacaccacaaaatcacacaaaacacccttcagtaactgaagtatggaatacatagcccacgctcttgatcggatgtttctgcggacttttcttttcgtttcaattgtgggatctcttgggctttttgttcctgttatttataaatgggcacatatattaataccagatcatattggaaatgcaaataactgaagcctcccaagggactgatagatacatttaattaacacacatatatctgatggcacctataaaattatgaaaatgtaagtcaatgtgttaaatttacctgcaagctttatcaagactaacctgctaacctctacccatgctaacaaattatccatttcgaacagtttggatgtattaactcgactcaacaacctgatcaagatacatttgatcttcgtccataataacacaaccgtccctccgacctgacactacacaaaattctgatctctccgttctcacgtttatacgactcacttatgagtccacaactactttcatcccttttacctaccaaaaacaacacaaacacaaatatacacacaaacccataaactcatccacataactaatcatacataacaaaacatcaacgcctcccatcgcctcacgctatatcttagctctctctcctcgccaaacaccactaaatccacaccctctacatacttctacaccctatcacaccccaattctcccccacatctcattacttataaaatccatcataactaaccttcaatcccccaatcactaaaacccctccaacctattcattattcactacaattaatcaactactaatattttacacggcctccaccaccaacctaatatacacctccttctcgccttcatcgctcttacacctccaaatcttat

SEQ ID NO: 536656 - DNA, 436 bp, Homo sapiens
gtcgattaaaacatccattctgtgagctcagcggtgaccttgggttatggttagcggtcattcacagctctgagtgccaggcgttaaactgtctcctcacctcccatggtctggttccactgacttggtatgaatagtagatataatctgtagagacccaaagtgcttggcagtgacccctgtcatagctcttccctgtcttgaaaaacggagctgatcattccagggcccattctagctcactcaaggaagcgtcacttttccagaacattccttatttcctacaagagtacatgaagctcatttcacacagtctagacacactcaggtggagctcagcgacaggctggcatttgtctttaaaataaaaggaggtacccagatgactgaaagagaagtataaggcagaagctcaccaagaatgaaaggaggtggg

SEQ ID NO: 536657 - DNA, 108 bp, Homo sapiens
aacgcaaaaaagaaaaccaaagggtcacaaaacattctcctttccttctgaaggttttacgcatgccatgttcattattcaacccagtcttttcactactcaaactta

SEQ ID NO: 536658 - DNA, 300 bp, Homo sapiens
aaaaaaaaaaaaaccaacaaaacacagactcacgccaccccgttggagcaggcactaggcgaggggctccatcggactcactagccgcactcacgaagcggcaccacctgcaggatcactttctggaaatagacaagaagaaccgctgagtgccccgagacgacttcattgccaaggcgtcgccgccggagccggggccggagcgcacctccgggctcctgggcaacggccttgccccgcggatctaccgcgcccacctcaagccctggaaatccagccggatcgtcccggccaacctgg

SEQ ID NO: 536659 - DNA, 128 bp, Homo sapiens
aagactcacacaggccagtgcagtggctcatgcctgtaaactcagcaactttgggaggccaaggcaggtggatcacctgaaggatgacaaggaggctagaaccttaaaaagcctgagtcaggctggtg

SEQ ID NO: 536660 - DNA, 376 bp, Homo sapiens
atgcagcagcttgacgattacaggtagttgtgatggacggccactctgcagggggatcaggccatttaatccggcagcattcgggtgtgcgtcccgctccagcagaagctctgccacccgcaccttcccgtacttggccgccacgtgcagagtgataaatcctttcttggtcatgcaggcctgggatgcttccttttccagaagggccaggactgtctccacatagccctcacgggctgcaatgtgcaggggggtgtgcccggcgttcgtggccaggttggggttggcgttcttttccagcaggagcttcaccatgtttgtgtggccgatgcgagctgcacagtgaagtggggtctggtcatccttggcctttgct

SEQ ID NO: 536661 - DNA, 197 bp, Homo sapiens
ctgaggatccctttcttgccacgactcgaagtactggcttcctggccgtggacctctgtgcgctatgagcggcttgccctgctgctctgctggaccggacgcggggagtgctggagaacatcttcggcgtgggctgagcagccttgtggccttcctgggctacctgctgctgctcaagggcttcttcacaggttcca

SEQ ID NO: 536662 - DNA, 588 bp, Homo sapiens
agtctcaagtgcgccatgattggaaaggaactgccgcagagagaagaaggtggtcatagaacagccacaggagatgacgaaaaacttcaggttctccttattagaagtcaggggtaaacaatatctctggtatctgaatgaggtgaatatgtttacaaaccaaggaacagtgatccactgtgacaaccctaaagttcaggctatctctggcatgcgaacactttcaccattacaggccatgctgagacacagcagctgagagaaatgctacccagtcatgttaaatcagcttggtgcggatagtctgactagttataagggagactgtgcctgtagcttttgcacaaaaaagatctgtgggatgggaaagcaccagttgctactggagaggatgatgatgatgcagttccagatcttgtggagaattttgatgaggcttccaagaatgaggcaaactgaattgagtcaattctgaagataaaacctgaagaagttaatgggagctgctattttatattatgactgctttttaagaaatttttgtttatggatctgataaaatctagatctctatatttttaagccagc

SEQ ID NO: 536663 - DNA, 81 bp, Homo sapiens
tttgttaaaatgaaaagtttattgctgagtcaccaaataggatgcaagcactgtcatgacaatatacagaatatgcagatc

SEQ ID NO: 536664 - DNA, 839 bp, Homo sapiens
cagtcatacttacctttgaggtttgatttaaagtttggataccactagctatattttgcatttagtcgccctcacattgaatcttttaattccatctcttgaatgtaagaaactttcagattctcataaaactacatgtcacatgtttttaatcctagaacatgttgctgtcagaaggcaaaggaaatgttaccagtgttttcggtatcgttgtacttttaacatattccattatagaaattatgccattctgtttaccattaataataggtgaaatacaggaaaactacattatgtgattcctcagtttgtaatgaccttttcagacatcaattgttaatcagattatttcaggttttcgtaaataattttgttgcctctttcaaaaggttaacaattaagcatacgttgcatgcagttggttgattggattttgatctgaggtacagcattaatactagtgcaaaagaatgtcataaactgagactaaaatgatgaactattttatgtagacattgaggagtggatcggaatacttctgctttctgggtaaaatttaaaagttgactatttcttatctggtaaatagattttaagccaattctagtcaagcaaattacataaaactaccttatttgtatttcacttacaggtggaggagcttaactaaaggaccatatctaattcattcatttgtaagtatcataaggggaaagtaagaaaaaggtgagggtatagtctaaatgggtgcatattagggagatattggcagtgatataacaaacatggcagccctttgggaatttcgtgtcgtaatggattagtttggctaacgatgg

SEQ ID NO: 536665 - DNA, 1047 bp, Homo sapiens
agattgtggataaatctggtgtggtgagggttcgaggtggacaggtgataatgacaagaagaaccccaggtaggagggaatggttcccttcattctagtggcacccgagagaacatcagcaatgcccaggcttgtgctggtacgtatcactctcctacctgtcaggagcgtacagcagcttcgcttggagaaggctacaaattgatgagcatcgttctgtgcagattgtggctcgcgtgctttcaccctcctcgggaataggactggggcaagcgggtggtcaagcggacgaaggctgggatatacgcacatgatgatgaggctcgctcctccgtccctccatgcgactcgaacttctatggggggcagctatggggggccggtgcgtccgtaggcctgtagggacatggcggtccttgcctatggatccccagctcaatatagtgtctacaggcttcagaagactgagtcagataggatatgatgagcccagaacagaatcgtgagtcgtggcatacagggaatctcctcaaacacaggaaggggaagaatagcccggagtgcaggccgattggcgtggcctggggtagggggaccgcaaactgaccccccgtggtccatcttcgagatacaattcttcgatctagttagctcagtgctcggagggttcagtaagtatcattccttacatgctattggacacgtactgaacagagcctccgggtgatctcagaacctggtgaagcctcgcctagacatgtgccaggtgccggtcgatccgcagcgcggctgattgaagacggaccgatgtctggagggctgaataatggccacgtgaaagatggcggaaatgatctactgagtgagattcgagcgcgcgcgaacgggatcggatgtgccattaggacacgcaccgatggggggaatacaaagaagtaaaccaaggccggagcaaccaaacttatggaaagaaacacagggcaaaaaggaaaggcttaaagcaagataaagggcacaaaagtgtgagcggaacaaatttgcgaaaac

SEQ ID NO: 536666 - DNA, 305 bp, Homo sapiens
ggcaagacggaaacgacaaaggacctggggtaaggccttagccatacagacagttgtgttcaactgttctgacctgctcgacttcatggccatgggaaagttcttcaagggtctggccagcgcgggggcctgggcctgctttgatgagtttaatcggatcgacattgaggtgctatcggtggtggcacagcagatcactaccatccagaaggcacagcaacagagggtggaacgcttcatgtttgagggtgttgaaatcccccttgtaccatcctacgctgtatttattactatgaatcctggga

SEQ ID NO: 536667 - DNA, 642 bp, Homo sapiens
tactccccggaacttttcatgggggggccccgctgggacaccaaggcgggaaccttttttgaagcccgttctcagggagctgccatcccctatcccggtcatctttgcaaaagccacccccgtggacagacaagaaaccaaacagacctacgagtgccctgtgtatagaaccaaactgagaggccccagctacatctggaccttcaggctgaagagcgaagagaagactgcaacctctcgtcccggcttcaagaaatcctcctgcctccgcctcccgagtagcttggattacaggtgcccgccaccacgcccggctaatttttgtattttgaggagagatggggtttcaccgtgtcggtcaggctggtcttgaactcctgacctcaggtccacccgcctcggcctcccaaagtgctgggattacaggtatgagccaccgtgcctggccaagagagataaattctttgagaaggacaataaaggacgcctgggacacatccccaaaaaccccctaaggcacgaggagaagatgaatggattttctctaagagaataatggactggtggaccagggattagccttccaggagcaatttttttaggttatggtaattgcttgtaagataaatatgtaagaaaaat

SEQ ID NO: 536668 - DNA, 413 bp, Homo sapiens
ctagaggacccgcgtggttcttgcagactgccacctcagccttaggaaaggctaagggccaagcctcaaggcctgggaaatctacttctctgggattgacttctctttgtctaattctctccacattaaggcttaacggggccatttctctccatttaaaccaccaaagtatactcctcagctgtcccattgctcttgggatcagaaccaagattcttaacttctttttgtaacctgtaagggcatcattcagctctcacctttcagagattgccctgcttcccatctggttccgtgtgtgtgtgtgtgtgtgtgtgtgtgtgtgcgtgtgtgtgtgtgtgtgtgtgtgtctatagattaacaccctctgaggccatgagctgcacattcaagttctctgcaaggaacccacg

SEQ ID NO: 536669 - DNA, 345 bp, Homo sapiens
tttcttcagttgatcatgcggccagaagcagtctcatttcacctgaatatgatacacctactatatacatatctgtcagggctctcgcgtgcctgtcgttcccgatagaggttgtatgtgctgactatgtagttgacaatgcctatagtctgcgactgcttgatcccatcattctctcccactggcataatttatggatctctattccaattattgtactgctacagacagaagcctccaggtgcgttccattctactccgtgagttgtagtaatcgatcgtaggcatctttagcatgatagcagtatcatgatggtttctgatagctatgttagacgatgtcac

SEQ ID NO: 536670 - DNA, 792 bp, Homo sapiens
gttttacagaaaaatccccaaaatgggccaggcatggtggctcaagcccataatcccaacacattgggtggctgaggtaagaggattgcttgagcccaggaggtcgagaccagcctggacaacacgtgagactccatttctacaaaaaatttaaaaactagccaggcgtggtggcatgcctgtggttctagctactcaggaggctgaggcaggaggatcgcttgagcccaggaggtggaggctgcagtgagctctgatagttccactttactccagcctggaagagcaagaccttgtcacccaaaaaaataaataaataaaaataaacaagtatgcacagaacccaagagaaaacacaaagacacacaaccaacaacgaagacaacaatgggaggcggcgcgcgccgcgggccctaggagaagagggggaacacaccaagtggaagagggcccgccggggccacaagagagagagcgcagcaaacgggggcaaacagggcggggcaccaacgaaagaggagacgacggggagacacaacgacaacagacgggccgcacacgagactcacccaaccagcagaaagagcaagaaaagaagccaccacccgggcaggtgaacacagcccagaaagcgtgccatgcaacgacgacaccaagcaccgagcgaagaggagcactacagaaaagggccaagaacaacaacaacaggacacagacaaaaaaacagacggagaggaggtgaccagacgcgcagaaagacagaacacagaccagagcaaagaaaagcacccg

SEQ ID NO: 536671 - DNA, 146 bp, Homo sapiens
ctattttttacttttttaaacgttcttctgtagttgctctctctttttttaaaaataaatagaaatgaggtgtcactacattgcctcaggcggtcttgaactcataggctcaagtgatcctcctgccttggccttgccatatgcaa

SEQ ID NO: 536672 - DNA, 150 bp, Homo sapiens
gccgaatggcagcctccagaaagccaccgcgagtaagggtgaatcaccaggattttcaactgagaaatttaaggataattgaaccctaacgaagggtgacaaaattaagagacacaaggtgttggaacagacggcagaattcctccaagg

SEQ ID NO: 536673 - DNA, 645 bp, Homo sapiens
agcggataacagagactaaagaagaaagacgcttactgaataaggtgggatccaacaagagtgtagtatggaatgcaatagctttatggaaattacttttttctgagggagctcaacagaagacactaagaaagggaaagtcttgacactggtacgttgtgatttggtcatactgaaaataataagttgaaatcactactctagaaggaagaaaggatgactctatcagctatctcagcgtgtaggcagaatcgaagagaagatgacagaaacaaggtaggcaaatcccaaaacgatgtatagagaaaagaaacacatggcataccaaaatcatctagccccaaagctacccatcgtatggtaatacttcggaagcaaaggcagtactctgcaaagcctatgagtctattagagtatttctgagcttcagcaaagtggacaaagagaaagaggacaggaaatgatagtagttctccagaagaacatgtagaagagaaaaagagtcagtagtgaggaaagcgggtactgaagaaaagtcagctgatgtagagaagtggtatgaatgccgagagtgttcaggatgtgaaatccacaaaatacttcagtcaataagaaggacagatctcagggagaccagcgtacagg

SEQ ID NO: 536674 - DNA, 436 bp, Homo sapiens
tagacctggctgaagtaagtaatatcaacacagacacacacacacacatacaacacacacacatactacacacacatacacacacaaaacgatagatctatagggctgagtgcagtggccagggaggccgaggccgacagattgcttgaggccacgagtcagataccaacctgcgacatatgtcaacccccatctctccacaaaaattacaaaaattagctacatggtggtgcatgcctgtagtagcagctactcagaaggctgagctcgagaggataacttgcccccagtgaaggcggaggttgcagtgagctgatatcgcaccactgcactctaccctggtgtgacagatcaagaccctgtctcaaaaaaacacaagaacccatagatagatagatagctagatcgatagatcgccagtgcttctaccatggac

SEQ ID NO: 536675 - DNA, 306 bp, Homo sapiens
  misc_feature (77)..(77): n is a, c, g, or t
  misc_feature (88)..(88): n is a, c, g, or t
  misc_feature (97)..(97): n is a, c, g, or t
  misc_feature (110)..(110): n is a, c, g, or t
gggaacccccccccccggtttttttccccccaaaaaaaacccgggggccgtccccccccccggttttttccttgggnggggggggggntactttttnccccggggacccnttttcccccttggccctttttgggggcccctttaaaccagttttttccaaaaaaaggggggggggcggggcgggttttcccgggtttttttccccccccgggcccggggggggggttttttttggggggccccccccccccttggggggcccggggggtttggccaaaaaaaaaaaatcttttttttcccctttta

SEQ ID NO: 536676 - DNA, 288 bp, Homo sapiens
  misc_feature (28)..(28): n is a, c, g, or t
  misc_feature (51)..(51): n is a, c, g, or t
  misc_feature (281)..(281): n is a, c, g, or t
ccctgttataaaggggcaaactccctcnggtccctatagcatcctttaccnactgatttttttttgtttaatttgaaaatgcaaagaattgttaaatgttccctaaatgttctcacctacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatnttaaaaa

SEQ ID NO: 536677 - DNA, 158 bp, Homo sapiens
  misc_feature (99)..(99): n is a, c, g, or t
  misc_feature (150)..(150): n is a, c, g, or t
agggtggccagaggaaaatggaaaagaagcagggaggacagggagggagacacaagaggtttaaagagtcaagagccaaaaaaaaacccagcagaaggnaattcagcaatgaaaaaggcgttaaagacagaaggttgaaaataaagaaangaaaggga

SEQ ID NO: 536678 - DNA, 3180 bp, Homo sapiens
ggtggtggcggcggcgcaagggtgagggcggccccagaaccccaggtaggtagagcaagaagatggtgtttctgcccctcaaatggtcccttgcaatcatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccctcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggcccaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacatcctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgcccggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctttttcatgaatgggctatcgctaccatgtgttttgttcatcacaggtgttgccctgcaacgtaaacccaagtgttgggttccctgccacagaagaataaagtaccttattcttctcaaaa

SEQ ID NO: 536679 - DNA, 144 bp, Homo sapiens
tcaagcttctaacgatgtacggggacatgctggcccttgatgcttttttttattattatcatttttaagacggagtcttgctctgttgcccaggctggagtgcagtagcatgagttgtaaatataaaagttgtgtaccacgata

SEQ ID NO: 536680 - DNA, 633 bp, Homo sapiens
ccaaaattctttaccacctccaaggggcagggaacccccagttgggaataccccccgggccctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgcccggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctttttcatgaatgggctatcgctaccatgtgttttgttcatcacaggtgttgccctgcaacgtaaacccaagtgttgggttccctgccacagaagaataaagtaccttattcttctcaaaa

SEQ ID NO: 536681 - DNA, 197 bp, Homo sapiens
gatgaacatttaactatttaaagcttattgttcagtagtgttaggtatattcacattgggaccaggtgcagtggtcatacttgtaaccccagcactttggcgagactgagcgtgggagcgcgtattacgttgagcctacggagttcgatgaccacgcctggagcagtcgctactacagatcactgtcgtctataaga

SEQ ID NO: 536682 - DNA, 336 bp, Homo sapiens
gcagctcgaaatactcctcttcttatcctttaaatataggtgtgtcttggcaggtgtggtggctcacgcctgtaataccagcactttgtgaggctgaggcgggcagatcacctgaggtcatgagttctgggtcatgctggccaacatagtgaaaccccacttctactaaaaatacaaaaattagccaggcatggtggcaggcgcctgtagtcccagctagttgggaggctgaggcaggagagtcggttggaacctgggaggcggagtttgcagtgagctgattatcccgccattgcattcccacctgggggaccagaagcaagacttggccttttt

SEQ ID NO: 536683 - DNA, 194 bp, Homo sapiens
ggactgtcgtggtctgtggatgtggaggttgtgctgaggcaggagaaattgcttgacctgggaggctgaggttgcagtgagctgagatcgtaccactgcacttcagcctgggtgacagagtgagactccatctaaaaaataaattaaaaaaaaaagatagatggaacctgggtccttatcaccacgacacagtg

SEQ ID NO: 536684 - DNA, 404 bp, Homo sapiens
  misc_feature (105)..(105): n is a, c, g, or t
  misc_feature (115)..(115): n is a, c, g, or t
  misc_feature (123)..(123): n is a, c, g, or t
  misc_feature (133)..(133): n is a, c, g, or t
  misc_feature (161)..(161): n is a, c, g, or t
  misc_feature (164)..(164): n is a, c, g, or t
  misc_feature (286)..(286): n is a, c, g, or t
aagtcctattcttaaacacattggtattatttgtattaggaggatcaatcattgaggtttcttatagtttaatagaacctaactgaaatcaaataatttaagtantggttattanaattttantgggttttanttttaccctcttacaagcctaagagtanttngagtctcccttcaccatttccgagggcatttaggggtcaacattttttgtagccacaggtttccacgggatttaaggtcattattgggtcaactttcctcactatttgcttcatccgccaantaatatttcactttacatccaaacaccactttggctttgaagcccccccctgatactggcattttgtaaatgtggtttgactatttctgtatgtccccatctattgatgagggtttta

SEQ ID NO: 536685 - DNA, 1171 bp, Homo sapiens
gttctaactgggcgtgtgcttctgggtcttggccgttctagtgtgcgtttcaccggcgtgttgggcctctaagcctattcctgtgcgtccagacgtgttccctgtatccaacttgtgtcttcggcctaattgccgggatgctcgcttaaggtatgtacggcgttgcaatgtttgcttggacccttggagtatccgtttggaaggttcatcctcgtctgtgcttcttaagtatgctttggggcaaactggagaaacctcctcaatgggaggacttgtgccttacccatggacctatgggcactcatgtggtcctggacaatcagacttcttgttttggggagacgttccgccaaggatcgaatcatcaatgttagttgttggcacgcttaacatccttatgtgattctagtaatcgctgataatgtgcttcttgttcttccgctcaactagcgctccatagaaccgtgtgaagatatgttctcttgctagtctgacatcttctcttgtagtgagtacttacgtgcgctgcactactttattctacttggtatgctgacgaacggacgactctagtaaccggaagattctaggaaacgcctagatcttacctatcatcactacttttcgtgatctactcaagtgtttgtcgctataactgctgcataactctggtgactatcgcactgatcgtgcggtatgtgtgatggcgtgctcaagtgagaacgtgactatatccagcgacttcttgcaacaagtgactacatgtagcgacacgtgatgtaatattcttggaataagagtatcgctagagagaatcgtcactgcatgaatgtctcgatagcactgatttgtcatgtataattgtcaaagtgttaattaccctgcttgtcaaggtgagatcatatccgtagatcatctattgcttttctactttaagcgagcaatgatagttgcacgctaaacatgtccgacgccttaaagctaataactagcacgaaagaaaagtgtgcacgttcttgaaagtgaaacatgtcttataatatgtagtggcaaaaggcatactgtaagaaacaaattcttagcatccttaagacaaatattctttaatttctgtgtaaactgaatatacaattgttccctaaggcaaccaacttttgcttataactacaat

SEQ ID NO: 536686 - DNA, 149 bp, Homo sapiens
gtgctgggctattacaggatcttacgtaatattaacgcattgctgatctagcagcgtgtggagatggcctcaggatccaagaacaagctggaagggctggagtgataccctgacagaaggcaatgcagtgactggccctggctgctgaa

SEQ ID NO: 536687 - DNA, 1388 bp, Homo sapiens
tggtttcgcctctgttgtcttcgttgcttgtcttgttttcgtcctgttttctcttgttctccgtggttctttggtgtcgttcttgcctgtgtcttctctttttgtttgtctgtgtgtggtcgctgttggttcttttcttgtttctctgtctctgcttcgctcgtctctgttgtgttcttcttctcctgctctttttcgtgtgcgtgctgggccttcctgttggtcctcttctggcgtgttactcgtctcgtgtcgttcgttccttgcttccccctcttcttttgtgttatttgttttttttatttttttttttagagagagacaagcagagaataaaacaaggggagagagagaggaggagggtgatggagcagttatggtcgctcttacttctgcttttgtgactcggctctgatgagcgtctcgggcctggtgggctcgtccgatttgcccgttgttgcgcgtgtttcgcgagtcttggtgccctaaaaggggttttctggcctttttgacgtctttcgccactgtttttgtgtgggggccccccctccctttctgcctgcgctcgtctctggtccctctttggaggggtcttgacctgtgtggtgtttcctgtgtaccccgagtcttttgggcgtccccccccgccgagtggctggcgcctgtggggagcgcaatgggtgaccctggtgcttctttcgaccgccaattttttcgggttgttttctccgcgctggtccgccgccctgttatgtttcgcggtgagtcatttcttgggcgcgagtcttttgggacagtccccccccgctgggtctgttcccaataactgtgggcggcgcgattgaagatgtctcgccacccccggggtcatgtttttcggcccccacgaggcccccccgccagtggggcttcttgtcccacccacgggcgcctccccctggccgtttgttattatctcccatccgacctttatagaggcggccccgccgctcatcattttggcccgcgccaccgcgttgcggttactccccacaagcggcgaacatttttctcttgtgttctatattaaccacaccccgccctcgcccacaagcggcgtgctgtatactatgtccttgtgagccacttcctcctttatttggataagtgccgcgccgcttgcgtacaatatagttgaaatgctggataactgggtgtttgataaccagagcttctgcgcactcactcattctactaccgcacagttattaatcttttgcccttcaccacagagaagtcatcttgttattatctttttcaacccccgtgagaaaatcttagctccacaaataatatataaaaatctgtttctgttcttgtttttaaaaaaatcaatagatccaaacaaa

SEQ ID NO: 536688 - DNA, 158 bp, Homo sapiens
gtaatctgctgattgtgtactctgcccgtgtaggtagcgctcactctgcctggggcgggcgggccgccaggagtgacaccgggttcccatgtctctgcagacagtgcttcggatctgggactgtttgtttaacgaaggctcgaagattatcttccggg

SEQ ID NO: 536689 - DNA, 148 bp, Homo sapiens
gcgagaggaccccggtgacaggagctcagtcagagcgaatcggacatataatttcacccaggatagagtcagtgaccacaggatagcatatgaagtacgtgatataaagggaattgtaatggtggtggggaaggggccgggaatcagc

SEQ ID NO: 536690 - DNA, 159 bp, Homo sapiens
atggctgttctgaggatcccactgttgtcatacctgcactgttgtcatacctgcactgttgttcatacctgcactgttgttcatacctgcactgttgttcatacatgcactgttgttcatacccccccccgtatacagcgaccaggtgtaccgagctcg

SEQ ID NO: 536691 - DNA, 415 bp, Homo sapiens
gacgctgctccagcaacagaggggccatgcagtcccgggcactccttgctgttgccctcctgtcgctcctggcctgtgcccgagcttcatacgcccaggatgcctgccttctaagcttcatgcaaggctacatgaagcacgccaccaggaccggcgaggatgcactgagcagagtgcatgagtcccaggtcgtccaacaagcctggggctgtatgaccggtggcttcagatccctgaaagactactggagcaccggtaacgacaagttctctgagacactggaacttggaccctgagggcagaccaactttacacagggctgactgagacctcaatacctgaagtccacctgcctatgcatgctgacagctgcttgtgtcctgcgatccatggctgcacctggatgcttacccgg

SEQ ID NO: 536692 - DNA, 138 bp, Homo sapiens
cctcacaagaccctggcagaagcaggaagcaaggagaagaacgagaaaggagcgttgaagaggagagcaggcgacttgctggaggactctcctaaacgtcccaaggaggcagaaaaccctgaaggcagaagcaggaag

SEQ ID NO: 536693 - DNA, 137 bp, Homo sapiens
  misc_feature (35)..(35): n is a, c, g, or t
tcgcattccaggctgagtgcagtggcataccccanagatacagtcccagttagcaggctcaggtaaagtctgcaggatctggcacactaagaattagtggagcttgtctatagtagttctgcagagctaccacatgt

SEQ ID NO: 536694 - DNA, 973 bp, Homo sapiens
cctgtcagctctttctcccaatatgattgctgcccccccctcctctaccctcccccgtgggttttaccaccacaaagtcataaacttgtcacccaaacaaactggcttgcgcccatagtaaccttccttcccgtgtatcagatatctccgtctaatatccccaggccctttaaccatggaccaaggatccccaccaaaaaacaacgttgcatgtcccccctaaacgtccgaatggcacaactactggctaaagcaaacctttacaaataccttttcgaaaccctgaggtaatattacgcccaggcctgtcgtggtaaaaccgccttatgggcggacacccgaggcatgtctcccctccggttttacgcggtgtctccaagcgtcctttgatcacattccccgatccggtgcccccccgccccccctgttggtcaacacgccgcgtctttatccccaactctgtgggccgaccctcggccgtccgcgaccaggtcctcttgtgtggatacccacgcgcttggcgataccctgccgatgtgccccaaggtaggtcaacaacacgcgtgggcgtgggtctaccccacacagactcgtgttccttactcccgccgcgccgctgtggtggagtacaaccctccaggacccccgccacccttagggggcaagtgaaatacccggcaccgccacctccgccacatagtcggtctaactatcccccccgccccacacacctgatggtgaactcccctttcttatcaactataacatgccccaaacacattccaccccgtccttctatgagaaaacctccctaattatgccacatactcctggcagagacctatgcccagccaatcactcgcttctaaacacaccgatgcaccagacccctcactcctcggctcatcaccctactacctcgtaacccccccccgggcccaacaagcgaattccccaccaaaaccacaaaaca

SEQ ID NO: 536695 - DNA, 478 bp, Homo sapiens
cacgaggatggcgggctgaaaaagacagcgcgcagccgtcagggaagctgaatgctgcgcgctgcacaacggtgcctgcaaggcaccaacgaggtcgatcagaaggtacgtttcacgtagagcagccacttgctgtcgccggtgtccttgcagcggatgccgttgtcgcagatcgtgtataagttcctgtccgcattggtgtcgacatacgccaccgccgcctgccagcccccttcgaagttcttcgtcacgcccaccttccagtccgtgaagtcgtaatcgtcgtagttcttcaccttctggtgaccgacgtgaacgttggcgatccacgacggcatgaactcgtagttcgcgttctgttgatttccacgcagaagtgacccactaacccccaggatttccatccaaacctgacccacgtactaaccctaacctgctgctttgttgagtagcaagagaccaggagtgatagacgtgg

SEQ ID NO: 536696 - DNA, 135 bp, Homo sapiens
atgtgcgatccgggatccaatgattgtgcgatgataacatttgctcaattgatatgagatacttggtacgctcagttttccatgcgagatgcgagctcgagtaggtctctgtttggcatggtgcatctgccctgt

SEQ ID NO: 536697 - DNA, 745 bp, Homo sapiens
  misc_feature (321)..(321): n is a, c, g, or t
  misc_feature (423)..(423): n is a, c, g, or t
  misc_feature (498)..(498): n is a, c, g, or t
gtgggcaaactgtaactttaaaatgattcaggatcataacttcagttatttttctgtgctgttacgtagcagctttccagttttcttcctaactctcaagctaccagctctagttttattgttagggtgtttaatatttgaattcttcaacatagaataccatgtgtttaggaaaaataaaagtgtgactgtatttggtatgttgtatttttagttacctggtaggagatgaattgtttgtggtcatggaataccttgctggggggtcactcactgatgtggtaacagaaacgtgcatggatgaagcacagattgctgctntatgcagagaggtaggtttgcctccttcttgatatgttatggtgatatgtggttagcaagaagtgaacaaaaggaaatttttctgcacaggtaattgttatngtgggaggtgctttctctgtatacattctctgcaaattactccatctccatgccatttcatcctacacaggagtntcagccctttccttcaggtataagataattggggaatgaatggtggacctttgaagatccagattcacaaggaaattctggtagagtgatgatgatcatttaccatccaaacaggacacttttgagagtaaagggtatatatcattagaaatacaccactcaagctggcgcggtggctcacgcctgtaatcccagcactttggggaggccgagcggggtggatcacaaggtccggagatcgagacca

SEQ ID NO: 536698 - DNA, 301 bp, Homo sapiens
ttcggagggaccctccagctgtgatgaaggcccagagccccatggaaacagtgacggcatagatgggcagcaggctggcctcataccagggtgttcagtgattgtcagtcccgattgtcatgtaggtgactcccataccaccagtgcccaaatgcccagttaccggtctccttctcacagtgcttcaaaggaacacaatctcccgcaaagggtatggacgcaggataatgggctgcgtgtcagagaaggctgacagtcagtgaagtagtacgggtgaagtctccatgtggatcccaaacca

SEQ ID NO: 536699 - DNA, 157 bp, Homo sapiens
tcaaagaaaagcccaagacggcacttttctgtttctattaaacatttaaagaattaataccaatcctcacattcttcccaaaaatgaagagcaaggaatactgtcctcgtaagatgagtttggaagtattccttgctcttcatttttgggaagaatg

SEQ ID NO: 536700 - DNA, 135 bp, Homo sapiens
ttcatttttctaaagtaacaaattgggtttttttttaacccattaaaatctatgggggggcgggggtatgtatgtgaccagttggtcttcccagaatcattgttgaactccctgaaacaagtctttagaatccta

SEQ ID NO: 536701 - DNA, 409 bp, Homo sapiens
  misc_feature (50)..(50): n is a, c, g, or t
  misc_feature (56)..(56): n is a, c, g, or t
  misc_feature (90)..(91): n is a, c, g, or t
  misc_feature (243)..(243): n is a, c, g, or t
taggtttttaattgttagacacttggatgataaatgcagtcattttattntcaagngcttaaaattaatgtaattaaaagcttagctgannacagaataggtgagggttttttaaaaatgagatttaagggctgggcacggtggctcatgcctgtaatcccagcactttgggaggccgaggcgggcggatcacttgaggttgggagttcatgaccagcttgaccaacatgaagaaaccctgtnttattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctc

SEQ ID NO: 536702 - DNA, 428 bp, Homo sapiens
gtcgacgccatgaaggctttgggcctggtctctcaaagacacctcagatggagctggtaggggaacccccataggtcccatgaacagaacatgccaaagtcttttgcagtacaaggagaggtcagggttttaatacgagccttggtccagggctttgaagtcagggagggtttaggcttgaggaaggccagtgtctcaatctctagcagctttttctttcttctgctccgctttgcgcacaaccagcatgcccagggtccaagcagccctgctctgtgaccgtggcctgtcacttctgaagattgtcttctcacccatgaactggcttcactattcttggctgtgtacccaaagctctctctgtttttacatagagacacatgctcacctgtgcttactgctcctctattcacaataaatggtcgacg

SEQ ID NO: 536703 - DNA, 2938 bp, Homo sapiens
  misc_feature (2922)..(2922): n is a, c, g, or t
  misc_feature (2924)..(2924): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536704 - DNA, 208 bp, Homo sapiens
cagtatttcaatttgagaattttttaacacattataactccctactttgaccaggcaccttaaaagagatttttttaaagcatattaccctgtcatataatttatgaggagttgcctatccctattacaagattaagggcaagctcccgaaaggaacgccagaggagggcttatcatcggcccccattgttgactcacagattagctt

SEQ ID NO: 536705 - DNA, 527 bp, Homo sapiens
gttgagcgcggagccctgcatgtaccctgccgtcctgggctcagaggacgtgactccccgaccctgcgcccggcagtccccggggtgcctgtgctgccctgtgcccatggtgctcgtgagtgtccagcccagcttggctggctcagtgctgctgctgcctgtgctcccagcctcagtttccccatttggtaaagcatttgactggtgtgtttgctggactggcttctgctggacagagccttgtggctccgactgtctgcgctgtgtgtacctggcatgcacccccgacccctgaatgtggatgtggcgtgtgaccttggatcatcaggcggatccctgaagtgcgcccccaagtgatcatgaggcaaggacaagaaacatggtaaaacagaggagttgtgaaaagataagagaaaaaacgaaaagagagcacatagttcaaaaaaaaagaaaggatcacgaatgcaaaaagaagagaagaaaaagaaagaggataaacaacaaacactgagagcagaaagtaaagg

SEQ ID NO: 536706 - DNA, 356 bp, Homo sapiens
catatttacttgagctcggtaccccaggcatgcgagctggtagctcgcatgacgatgtggcttgagccctctgttgcaatggcccctgctctgtacacctggttaggctgttgctggttcacgcctcattggtgtacgtgtagttgggggtggcggaatactgagtctgaggctgattcatggcgccctgggctgccgccctatggctggcgattctgggctcgcctgctgcacatttggattcttccatgcccgttgtgtaattttttctcgcaaattgctgaaactccccccacttccccggtaaaatttatgaaccatgctgagggcgatgaaggaaaagacggccatcactg

SEQ ID NO: 536707 - DNA, 2532 bp, Homo sapiens
  misc_feature (2516)..(2516): n is a, c, g, or t
  misc_feature (2518)..(2518): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536708 - DNA, 1115 bp, Homo sapiens
gttgtcactgtctgctctgggctgcgtctgtttttgtgctcgcagtgtcgttcagggtgtcatcttcggggcgaggtatcgtatcggttagggtcgtcctgtgctcttgtccggtacgtttgttcgggtgtcgttgacccttgtgcttttgtttgatcatttgacttgtgaacgttgtcctccgcctgggagtggcgtgctcaatcgtcctccacagggcttgtttctctcctcactgtgtggctatccctcggttattcctcgtaccgtttctcccctttttggttaatcccctcgtgtcttctttgttgtgtgtcccttctgttggtgggcctctatgccatttgcccccacgctggtgtgtgactgagtgtgggctgctctcttgtcctttcctcttcttgctgtcctcattatgtgatagcttactctgccataaccttttcgttcctcactagtggattacaatgatttgtcgatgtgactcctgtggtgtctgtagtcaccaacgcctcatctcctagtcactgctgctttggtacgccctgacccaactcttatcctctttcatcttcttctgtctttggcctgtccttttgttgcaattgccactgtctgacgatttgatcctgatatgcatctaccatctcgtcaaccgcctgacacctgggaccttggcccctctcctgctttatagcatcatcgctcatcttgctcccatttgctctgccatgccaagctttaggtgggacatgtagagtccaggactgctcagatcctcctctccctctcgctcttgagtccacaaaagtagagcgagcgagatgatctggaaagcacaccctgacagcaggatgcactatctcttagtgctccagaggcgttgaatagggcgctttgcatcagctccaggcccagcgggaaggaaggagctgcatgggatggtgagagggagaaggggtagcagaagcaaattatggaggcgttgaacctagtaaatagcaactgtctgacagcaataatcttcaatgcatgctaagccatccccggccatattttgtatgagcgcttggcgctcatcctccgtcctatcccaactcaccccccaaccctaa

SEQ ID NO: 536709 - DNA, 1970 bp, Homo sapiens
  misc_feature (1954)..(1954): n is a, c, g, or t
  misc_feature (1956)..(1956): n is a, c, g, or t
agcttacggctaggtacgaggctgggtgttggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536710 - DNA, 104 bp, Homo sapiens
ctgctacgtgacgcgccgcaggacccagcggaggaagtcaccatcactgctctgctcttcggggaggatgacctggaggcactcaatggccaatgaacatcaat

SEQ ID NO: 536711 - DNA, 555 bp, Homo sapiens
agagacagggtctcactctgtcacccacagtggagtgagtgatgcaatcatggctcactgcagccttgaactcctgggctcaagcgatcttcccatctgtctcctgaatagttagaactacaggtgtgtcccaccacgcctagctaatgtaaaaaatatacatttgtagagatggggtctcactgtgttgcccagactggctcaaactcctggcctcaagtgagtcttctgccttggcccctcaaagtgttggtattataggcgtgagccagtgcacctggcctcacatgacttttattgcattatactggtataactgttctcttttattattagttgataatctcttaccgtgcctattttataaattaaattttatcatatgtatatatgcataggaaaaaacatagcatatataagggtcagtagtatacagtttcaggcatccactgggggttttggaaggacccaacacagggaaggggggattactgtaaatacatttttaaacggtaaagtaagatatttttgacagtccacattattcttaaagat

SEQ ID NO: 536712 - DNA, 462 bp, Homo sapiens
  misc_feature (38)..(38): n is a, c, g, or t
tagtgcttccttatgtcccatccctcttggctcctctntgagcacccacccctctacccgtggtctagtcactaaaggaggaacacctgggggtctctggaaccctattcctataatatggtacctggtatcattggtgaggccatgccatattggtgttaaatatttcaattatcattcccttattctttctactctacataccctcaaattatgcaaagattgtgcatttcaaatgtgaattgaatgcttgtcaattagagacataaaaatcaccaggtcttatgtggtaatgtggtcagaacactacaagatctttctgtggccttgctttccacggtttgttaactttgttcctcactttcagaattcactgtgctataacagaaagggtcggttatacaaagtgtgaaatttcttttctttatacccaataataaaacatcatcctttttgcaaaca

SEQ ID NO: 536713 - DNA, 2775 bp, Homo sapiens
  misc_feature (2759)..(2759): n is a, c, g, or t
  misc_feature (2761)..(2761): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536714 - DNA, 1690 bp, Homo sapiens
  misc_feature (1)..(2): n is a, c, g, or t
  misc_feature (1161)..(1161): n is a, c, g, or t
nntctataggaaaggtcagcaatatgagttgtcctctcttttgtttttgttgtgtatctgtatcttatttcttgttgctctttatctctcgtcgtccggttcgtgacctgtaccttgttggtttgactttactctcgtgtttgtgtgctatcttcgttgctctacttgacatggcccttcgtttctctttgtcctcctatagtttgcgggttagcttctcctagctgtctgatctggttcatgtttccagttcttgctttgtttgttacgttatattctcctgtgagtcaccgcctgtgtggttgtgttgtatgacacactacctccttctgttgtgtttgtgtatggatcactgtctagctgtacgtctcgcgtgtcctttttctgtgactggatagttcttctttattcaactggggagcttatttccatgtggtccacgtattgcgccctgttttgcgctgttctgaactatagtttttgtggatactgtctggtgatcgccgtgttttggttctttcgtcgcttgttgtgttctccttgttgcgctactttccctcctttgctttatctatgagagtagtgtacatcgagttagtctgcctgtggtgtgtgtcggactgattgacatacgtcggttccgtcgatgtggtcttcttttatttgtcccgcggctgtctcgtcgtgcgaccgaggttggcgtgcctgattctttttatgggtctaagtactggctgtgtgttgcgaataaggcgtgttgccactggagaccggctgttttgatctctgggcggtggtgtctcctccagccactttggtttaggcaccgcgtgttggttgggtatcactctgttgttggtggttttatacccgtgggctatcaccgttatttggtgtccctctgtgtatggggggacctgtccaagatttgtctctcgtggtgcacccgcgctgcgccttgccggagtttctgcctgtttctttcggcgttttttgttgggtttcttcacacgggctgtgtcgtgtgtgagagttggcgcccccattgtctattggttgctacgcacttaatgtctcttttggccaaacaacctctgcaaatcttatatactctttttttatctctctctcaatgtcacctttcggtgtctcctcacatangagtattcgacacacgcgtggtctcactactctcctcacacatatctgtgactttgctattctatcgcattacataccttatagttattcgcttctctctcacatacttgctcgtgttgctacactcactcaccctcttctttggtacacaagtttctcgcattcccaccttaaagtttacaggagtttcttccggaccacattcacaacacttttttcacactcgctgttttttctccacaatttttctcgttttggatttttatgtgcacccttcgtttctgggctttccacctgtctgactctttctgtcaccttgagctttatcctcgcttctttcttagggtttctttgtttctggggtcgttcggctacgaagatattagtctacaggtaactgtgcgccaccgattacccgggcgatggggggggggtttggtggaaatttatttgttatgatgtctgtgtggaaagcggctgggcagacctctccatggtctattattactgtaaaaaaaaccaaaaaaaa

SEQ ID NO: 536715 - DNA, 2852 bp, Homo sapiens
  misc_feature (2836)..(2836): n is a, c, g, or t
  misc_feature (2838)..(2838): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctggtaggtccccgccccaggggcctgggctttgagctcagggccgcgccacccagtcccgggctccctgtctcctgcagattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536716 - DNA, 2609 bp, Homo sapiens
  misc_feature (2593)..(2593): n is a, c, g, or t
  misc_feature (2595)..(2595): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctggtaggtccccgccccaggggcctgggctttgagctcagggccgcgccacccagtcccgggctccctgtctcctgcagattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536717 - DNA, 209 bp, Homo sapiens
acgagacagatagaaccagaaaaacattaaacaccagctgggaatatcactttagatgagattgtcagcattgctcgactgatgcggctaccgactccttcaaccagcagaactctctgcgcaccattaaacgcagcactcctgggcgactgcccagctcagctgggctgtaactgcttgactgggccgccactccctcatgactatca

SEQ ID NO: 536718 - DNA, 2580 bp, Homo sapiens
  misc_feature (2564)..(2564): n is a, c, g, or t
  misc_feature (2566)..(2566): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536719 - DNA, 3209 bp, Homo sapiens
  misc_feature (3193)..(3193): n is a, c, g, or t
  misc_feature (3195)..(3195): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgcgtccactggggggtctggggctttgtgagctcctgggcgttgatgtgggaccgtcttgactggcatggggtgggcttggtgtggagagaagctgtcgttccgtcagactcttgaaggctcaggggccagtctggagatagctgcgtttgattccagggttgggaggacagctcgcgctgggaaaactggacaggccttcacactgctcctgaaagtgcaggtgaggctgcgagggtcttgggagtttctgctgttggtgggtgttaaggggctggcccaagaacccccttccaccatgagcttctctgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536720 - DNA, 292 bp, Homo sapiens
  misc_feature (10)..(10): n is a, c, g, or t
  misc_feature (35)..(35): n is a, c, g, or t
  misc_feature (269)..(270): n is a, c, g, or t
gattccttcngaatgcctgtctggggaggtggaancaagtgtggggcctgtggtaggaccgtgtaccacaaaaaaaaggctccttggggtggttggagcttccaccgctgctgctttctctgctgtatgtcgctctccatgctccacctttgacggaatttgtttgtcccgagcttcactatgtctatttatggaaaaattgtggttttgcccccttagatcattttgaatgcccgactggtttttacctgccttcttagatgttgccnntgccatgcctagccgtgccgac

SEQ ID NO: 536721 - DNA, 2831 bp, Homo sapiens
  misc_feature (2815)..(2815): n is a, c, g, or t
  misc_feature (2817)..(2817): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536722 - DNA, 3191 bp, Homo sapiens
  misc_feature (3175)..(3175): n is a, c, g, or t
  misc_feature (3177)..(3177): n is a, c, g, or t
ggtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaaagcgacggaaggcggacggcgaggacgctgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccggcaggtatgtggaccctagacctggagcgtggcaccgcccgcctcagcttccctgctgagtgcacagcgatcagcccctgggggacccagattagatctggggtcctttttgctgcagtaggtggacaccagctacctccaggccagtgacagacttctcctagcaggtgagcaaagttttcaacatctacacagatgccacacctctgagagtctccctggttacgggacagaagtctctggccaaggagcaggagagcctcgtccagaaaacgtaggttgtgtcagggtgcgggtttttcagggggtccctgctcagccctgcaggtggcctgaggcaccgtgggagcagaggaggggccaccatctttaaccacctgttcccgtgaagaggaggagctcccaccggcccccttcccatgtggggtggagtcggggctgtggggtgaggcagcgtcttgctatccggaagcccttgagaaagcttccttctctcgagctgctctctggtctgtagagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagtatccagcagcacgcccaggtgctggcctcccctgagcagagtcctctgcacacagctctccttccttaatgcccagagataagggtggcttgagctctggtgcacagaaccgcatcgtactgtcacgtgagctggacccaccttgctcctggtctgcggcagtctctacagtgcgtagatggaggaatcctgttccctggaggttcggggcagccactggtagggtgccagcaacacccccttctcttccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagncnggccagtctgtgag

SEQ ID NO: 536723 - DNA, 206 bp, Homo sapiens
gaccgtttgcttttctggggggtcctggcggtttttttttaggctgttcctagttgaaacccaaaggtagaagggttgttcttgttgccaaccaaggtaagtgtgcccgggtttcttcccgggtcttacgttcttccggggttcttctgggggcttagttgggagagcctacgccttattgttcctctgcgccacaggagagggta

SEQ ID NO: 536724 - DNA, 223 bp, Homo sapiens
caagacaagaggattgcttgaggccgggagttcaagaccagcgacacagcaggaccctgtctctacaagaaataaaaaaaattagccaagcatggtggcacatgcctaaaagtcctagctagtggggaggctgaggtgggaggatcacttgagtgatcattgatgatgccactgcactccagattgggtgacagagcaagaccctatctctttaaaaaaaaaa

SEQ ID NO: 536725 - DNA, 408 bp, Homo sapiens
tcaacggaacttttctaggtcttgtttatcaatgtggctactccaatattgggtacatatatatttaggacaattaaatcccctcgttgaattgaatcctctatcattatgtaatgcctttctttgttcttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctatta

SEQ ID NO: 536726 - DNA, 309 bp, Homo sapiens
  misc_feature (89)..(89): n is a, c, g, or t
  misc_feature (168)..(168): n is a, c, g, or t
  misc_feature (184)..(184): n is a, c, g, or t
  misc_feature (289)..(289): n is a, c, g, or t
  misc_feature (303)..(303): n is a, c, g, or t
atcctgatctgcatgatctcagctactttattgacaggcagtgaacataacctcacttaattctggtgtagggtgtatgtgctaatcgntctaattcttgatacctagtttatagataactgctggtcttaaatgcagagtcagagaactgaaccagttctgaaatgnagtagcagctttctgnttctcactctgcctatattccatggggttacttctctcatactctttcagggatttcttccagtgaatctgggcacatatttagcatctcctgtgatgagcaatngatttgggggcctntcactg

SEQ ID NO: 536727 - DNA, 141 bp, Homo sapiens
ataggagggagcagtgtaggtagagatcaaaagtgtaaatacttagggctgtgatactggacagcagcgtaggaaggtggtgaacaagactgaagtagtggggcgattacacagagagctgagttgttgggacttaatgtg

SEQ ID NO: 536728 - DNA, 505 bp, Homo sapiens
  misc_feature (128)..(128): n is a, c, g, or t
  misc_feature (130)..(130): n is a, c, g, or t
cgcttcctttctgaccctttccgggtgttcaagatgtcgaagcgaggacgcggtgggtcctccggggcgaaattccggatttccctgggtcttccggtcggagctgtgatcaactgtgcagacaacanangagctaaaaacttgtatatcatctctgtgaagggaatcaagggacggttgaacagacttcctgctgctggtgttggggacatggtgatggccacagttaagaaaggcaaaccagaactaaggaaaaaggtacatccagcagtggtaattagacaacgaaagtcatatcgaagaaaagatggggtgtttctttactttgaagataacgcaggggtcatagtaaacaataaaggagagatgaaaggctctgctatcacaggtccagtggcaaaggagtgtgcagacttgtggcccagaattgcatccaacgcaggcagcattgcatgattctccagtgtatttgtaaaatatattcattaaagtctcaaaaaaaaaa

SEQ ID NO: 536729 - DNA, 176 bp, Homo sapiens
ccttttttttgggggggggcccccccccctaaggccttttaaaaagggggggcttttttttggggcccggggggaaggttggtttttaatttttgggcttcccccttttttaaccccttttaaagggggtttggggacttttggttttttcccaaaaaaggttttcctttccccca

SEQ ID NO: 536730 - DNA, 211 bp, Homo sapiens
aagataggtacttgtttacttttttaaagaaactttcaaaatattttccaaagtaacatctaacattcacatcagctgtggatgagagttgtagtttacatacctcctgaccaacacttgatatagtcagtcttttatatttcacatattctaaccagtgtgtgtagtaatttcttatcaatataaaggggagtttatatattatatatat

SEQ ID NO: 536731 - DNA, 482 bp, Homo sapiens
  misc_feature (93)..(93): n is a, c, g, or t
  misc_feature (103)..(103): n is a, c, g, or t
  misc_feature (114)..(114): n is a, c, g, or t
  misc_feature (133)..(133): n is a, c, g, or t
acagcgagtcaggtgccagcggctcctcttttgaggagctggacttggagggcgaggggccttaggggagtcacggctggaccctggaaaaantcctttgggnaaggggccccncccccccctttgggggacntaccaagtggctctgggagcccactgcccctgagaagggcaaggagtaacccatggcctgcaccctcctgcagtgcagttgctgaggaactgagcagactctccagcagactctccaaccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttc

SEQ ID NO: 536732 - DNA, 914 bp, Homo sapiens
tccctgtgcggtgtcgacgtagatatgaagtacagctatgcgagccgccagtggcttctttataatattctcgcaaatgggttcctggcgaaatggggatataaaaatcttgcgaccgtctgattgcctcaaccgggggtcttgccacccggaattccgtggttttctgaccttctgggagacacatgttgttcccaacccacgggtggtctcccgcaatttgagtgggccccccctttgttgttggtagtttttgacgacgcaccagagtgtgccccggccaaatcaggactgtgtcttcccaaacttttccctggtccttccgttggagaaagttgtgctgccccgtttgaggcccaaagtcgcctttcggatgcttcttttagaaggtcattgggtcccgtgtcgtaaagttttgtgaaatagaaaggggatgtaccacacatgcaaggggctcttcaatagacccccgcgggaatgaacgaaccctttaaaccccctgggtttatctaaacgacgaactctcggataagatgtgtcgcaactttccctgagccctcgagtagtaggagaaaggatgttccttttcccgctctctcaggtcggagaaacatttcaccttgttgccgcagttgtcactccctgatcagaggatatccggttagccacatgatctgttatcttcatgaacaccctgataaggagagacgttcccccgcggagctcttctgatggcatataaatttatgtatagcacaatatgctgtgtaaaatatcaaaccccgccacaatcactgtctgtctatgccgaatccccggaaataaattatttcttatcatataaaaacttataccctttttttttttcccctttttttgccaaccccaaaaaataaaacgggtgttgaaaaaaa

SEQ ID NO: 536733 - DNA, 208 bp, Homo sapiens
  misc_feature (16)..(16): n is a, c, g, or t
  misc_feature (90)..(90): n is a, c, g, or t
  misc_feature (95)..(95): n is a, c, g, or t
  misc_feature (106)..(106): n is a, c, g, or t
  misc_feature (112)..(112): n is a, c, g, or t
  misc_feature (117)..(117): n is a, c, g, or t
  misc_feature (120)..(120): n is a, c, g, or t
  misc_feature (133)..(133): n is a, c, g, or t
  misc_feature (138)..(138): n is a, c, g, or t
  misc_feature (153)..(153): n is a, c, g, or t
  misc_feature (160)..(160): n is a, c, g, or t
  misc_feature (195)..(195): n is a, c, g, or t
  misc_feature (206)..(206): n is a, c, g, or t
gtcttagctcttccgnagttgccaaccgcagcaagaagtcccgggctttgttcctgtcagctgctgttttctgcatcttcatcatttgcntcggncccacaaacgncctccngattncgnattactcatttcnttctnacactttcaccacanagggtgnctactttgtgctacctcctctgtgttctgtgtcancagacataagntg

SEQ ID NO: 536734 - DNA, 440 bp, Homo sapiens
gaacacttgctgcttgggcttcatagtattcgcatacttcttgaagtctagtgacaggaagatggttggctatgtgaccgggctccaggcctatgtctccacctgctaagtgcctgatcatctgggccctgattttgggcatcttcatgatcattctgctcatcatcatcccagtgttggtcgtcctggcccagctatagatcagtaggctatcattgaggtcatgactctgcccttgacctgtatcctcacgtattttatcttccattcctcgccctgcccccagaggccaggtgctctgctcttgacctgtattccacttactccaccttccattcctcgccctgtccccatagccgagtctttcatcagccctttatctttacattcttttctacaatggcattcaattatgtgtatatgtttctggtaaaaaaaaa

SEQ ID NO: 536735 - DNA, 489 bp, Homo sapiens
atattgctagctgcagttgtcgtgagtatctgctcaaagccggggagagccagatgacgcaaggtcctgactatccttcagagacctcatcaagtatcttcacactgcccagcacaacattataatccaaagatggcttggaagtgctgcccagaagccatgttccctcttcatacgagccagctaggcggcctcacgtacatgacactccactcatggcccatggaggacgacgctacagacagctgacccagctcctgggactccctcctgagggacactgcagcttgagagcagagaggaacacctgagccggaagacctcagtgatgtggctatagcaatccaccagcaccaaggcaacaagcagtttgggacggcgaaagtgggctttctatacaagaaaagtgacggaattcgaagagtctggcagaaaaggaagtgtaggagtcaagtatggatgcctgaccatctcacgacaaactgcagc

SEQ ID NO: 536736 - DNA, 1324 bp, Homo sapiens
gggagtgagggcggggagtgaggaggacgactgaggagcatggatcctgcagacgatcgacagcctcattgagctgtccaccaaactccacctgccagctggactgacgtgtgtcatgcatcatctgagtgaggtggatgtgagaatgcttgtgaatgctgtgaatgaatgaactgcccgctcactgatgacctgatgctgacgactttgatgaaagaagaaaagaaaaaaaaaagagaaaaagaataatagaaacatagcacgaagaacagaagagaaagaatgaaagaaagataaaagaaaagaagaagaataaaacaaagagtacactaaagaaaaacacataacaaaaaaagaaaaaaaaaacaaaaaagaaaagaaacaaaacaagaatagaaaggagagaagaacgagaggaaggaaagcgaaagagacggaaagaagcggaaggaaggacagagaccaagaagggaagagaagaaagaagaaagaggagagaagcaaaaaacagcaaagaaagaaaaaaaaaggaaaggagaaaagagagggaagaagggaggaagagaagagaaggaagaggaagagagagagaggacgagagacggcggaagagaagacaagacgaaagggaggaaagaggcagagagagaagagaagaaaagagaggaaagagaagacaaaagagaggacggaagaacgagaggagaaaacagagagaggcggagaggaagacggaacaaaacaaagaaaaaggagagagagaggagagcacagcgaggaaaaaggagaagagaagaggagacagagcgcaggaagacgaagccaaagagaaggagacggaagagaaaagagaaagagaaagagagaggaaagagaaaaagagcgaagaggaacacgtacgaacgacaacgagaatagagaagaagagcacgagacggaggagagagaggacggagcagacaaggacaagagaggagaaaagagacagagaacgagaaagcaaagcgaagggagaacgagagagacgaaaatgaaaaaccgagagaggagcgaagcaatgcaggaagcagacaacaaaacaacaacaaagagataaagacgacaagaacaaagtaaaaacaagaacataaagaaagtccgtagtcactggttaattaataccgatcagtaaccaacagcaataaagccaagacagcaggagccggagaaacaatagacgagacaaaaccaacaaaacaagaaagaggaccagacggatagcaatacaagaacgaagatacagaatataggcagaagaggagagcaaagagggacaaacaaagag

SEQ ID NO: 536737 - DNA, 333 bp, Homo sapiens
tgagacgacgtttcactcttgttgcccacgctggagtgcaatggcacgatctcagctcactgccacctcctcctcccaggttcaagcgattatcctgcctcagcctctcgagtagctgggatcacaggcacccaacaccaaacccagctaacttattgtatttttagtagagacgggattcactatgctgaccaggctggtcttgaactcttgaccttgtgatccgcccactttggcctcccaaagtgctgggattacaggcgtaagccaccgcgcctggctgaccatcctgttttaagagtgacactgggaatccagatttttatatgacat

SEQ ID NO: 536738 - DNA, 790 bp, Homo sapiens
  misc_feature (601)..(601): n is a, c, g, or t
caaccactgagagccaggctcttgcacgacgggtttgcatggggccatctgaattggcagtctcagcgggtgagggagctgagagatgccaatcggggaggatggccacagagaggctggtgtggggaggttcatcccaggatgtgcactgttggtatatggggtggggaagcaggtgatgatgaaccatggacacccactgacatcgttccttggacggaagtggcttgtcgcgtgaccagtcgcttctcgcttccgtatcgctctggtaggcatgtggactgtgggattcctgaatccatcgagaatggtaaagttgaagacccagagagcactttgttcggtgctgtcgtccgcctacacattgtgaggagcccgtattactagcactggtaaaagtggcaggagcgtggcggacgtagtcacatgtgctggtaacgggtagctgggtgaatgaggtgctgggcactctggagctggtcgaaatgtgttcacacgtctggtggagtcgcgcctagagaaccctttgacatggaagaaacgatggaggatgacttgcgaggatccgaatgccgactattcgggcaccttagccgctggncaagctctcctttcgtacaagcgccatggagactgggtggagccgcctcatgaactgagttactgggctgcatgaacggctgcctcaggaagctggaggggaacaccagggagccgaacgagtgatatgatggagtccacctcagttgccgcactctcaacggcgggaccagagatccgaagatgccca

SEQ ID NO: 536739 - DNA, 887 bp, Homo sapiens
acatttcctcagaagaaggctccttggtgctttgaagaacatcctgaagattatatcggagacaatatatcaagaatctatttattgaatcatctagaacaaaagccaggagctccctaatggatgcacattagtgtttattttgatgaagaaatatatagattttttaaaacaaccacaaagtagatagctcagtaaaaaatcaatttgggaagatgtcactgaacaagctcttccaatgtatttctggattcagtgcccagtaataccaaatcgcttcaagttagggtcataaatgagaaccattgtcaggtaccgggctgatggaacaaattcccagggttcatgagcatggtaatcagggttccggccccctcatcaactggcgggaatcttctccttgcaacactctcctccgacctggcctccctgtgttcagcgacacccaaagggtaccaggctctgtgcaggacaaatctacaaagccctgacagtttaatggcaaaggggatatggggaaaaaacaatgaacccctgagaggatatattctcacattttcttatagccatgggcctttattcttatgcggaactgaacaccaatgctccccaatacatcacccaaactggagcatggcctacatatgcacattatgagttatctcctgcgtccaatgcctcttatgccagatctccaggatggagaccgcgaatgaatatacaacaagagaggtaaacaaggagcagaaagggcaggcaaacgttgccaaaacgggggagggcagcacaagcaagcatcggcaaacaccaagagatgagagcaaaaaagcgacacgacgagaaaggaacacagagagagctaagacacagatggggcaacggacaga

SEQ ID NO: 536740 - DNA, 656 bp, Homo sapiens
agcggacagcctcccaaggccctcatgggggccttgggcgggggcatcagccatgaccggaggtttagagttctggttccgccgatcgtcattatggggcgtcaggataaaaatcctaggcttccggacccaaccccacacgtgcatcagagtcatcaggaaactctggttgtagctaggctgccacgaagtgagctggttggaccgactgacttagattcaacatcggccatttcgcgtgtagcaaaagtgaatcccgagaagacacagaacttacctgaagtcaccaggcagttaggcaggcagggccgaggtcagaacccgggttatcttcagatgcctcgttccaccagcgtatcttgattcagtcaggaataccgcagtaatgggctgcccagagagctgcaggacaagcagcgcaggatgcacctccgggtagactactacgcctggagccacccaatagtggagggcagtatggtagtgggctagcccctggtggatggtaatgggggtcctgcccctggagggaccatatggaccaccagactggttggaggggcctgatggacacacccaaatcgctgggatgtaccacacatctggaactcaaggaggacactatggacggcgcagtacacgagaggcccactatg

SEQ ID NO: 536741 - DNA, 369 bp, Homo sapiens
acactacacggctctcagctctgggcactcagacatcatgagaggtgcctcgcacccccggaatttaaatctctactgctatgctcttttatattctctcttcaacatgtgtagcatatgtggctaccagagacacactggtgcatcttagatgaaagattcggtaggtattggccaactacctgtggcattgcagatattctggctacttatcaaacccaagtagacacagggtctacaggctttggaagacatcttacattaagttgaaaacacaacattagaaggcaaacagctgagagcgatccaacttacttataatcctgaggaatcattcccaatatgatagacactgttactttggtcccg

SEQ ID NO: 536742 - DNA, 140 bp, Homo sapiens
gcctcccttatccttgtttgactactccgcatccatcttgctatacctcaacttatctggcttttacagtatatgccacatagttctaatttagatcttacaacaaaggaagaaaaaaagacactggcctggagcatggg

SEQ ID NO: 536743 - DNA, 461 bp, Homo sapiens
ctagctaataagctgattccagtagtccgtgatgggtgctaagtcgacaaggaatggacttaattttgggaatacctagaaacctgacaaagcattgcttggggtgtgtctgtgacggtgtttgcagaggaggttagtgtgtgcatctgagtggaccaggtggggaagatccgccctcagtgttggcaggcaccagctaattgcctggggccctggagagaacaattacagaaggtgaactgtctctctcagagctgggacacactttttttctgccttggacatcagaaatttgattccatgaaagtgcattatcacattgactttgtaagccttgtgcatgtacataaaaatgttgaaacttcctcagtaaaagaggtgtgctatttgtgcacctgcgcttgtgaaagataaaatttctcaagatcttggttctttggttgactacttgtgcagtggtg

SEQ ID NO: 536744 - DNA, 735 bp, Homo sapiens
gagagaactagcctccagtccttatctttgatctaggtatctccctctgtgtgagggcaccctctattgctatctgtattaaccctatgaaaacaggaatacacagatgccactccacacatggacatttagcttgcctagaacattgagccagtggatatgtgaatgaattatatcctgtcccccaactgaacaataattccggttattggctcaaggcactggatcaaaaggggccttccttaactcctaacataataagaacaatgtggcacaagagctttccatacctctaaggacctaaaccattagtcctgagaacataattttaagggatactatatggaaaatggcgctacctaagaggtcatgagaatcttatgaagagcttgggatgctaattccatgaaccttagacaattccttgaggtcccggggatttctcaaaaattaaggaagaaaatctcaatctttatacacaaagcgcacaacaaataatggggttagtttgttgaccacaaaaccaaaaagaattatatggcgcctaaacgcgggggcctcttgggggagggccccggcccatttacaccccctattgagacctgttacacattactgggccctgcccttcacagggaagccacgggaaaacctggggttctctacgccttagctcttaacacaccccccctgttgccccagtgcccaatttcccgccccggccttgccccttcc

SEQ ID NO: 536745 - DNA, 290 bp, Homo sapiens
ctggccgtggaaaggggcctggggccctggttccggctgtgtttggtggtctggcttcggggaaggggcaaaaaggcgggcaggccttccctgcagccctgagcctcaaatccgctttggagcattagggtggatgcagtggtggtgaggccgccccgctcccttccgaggcagccaggggttgttttgggctttcctgtcccaaatgctgccctattgggttttaagttttttatttcccggtccttatttatgcctatgccaaaaataaatgacgccccagagctgga

SEQ ID NO: 536746 - DNA, 1381 bp, Homo sapiens
  misc_feature (361)..(361): n is a, c, g, or t
tcgcgggtgcgagtgtgcctggtggatatccctcggaccgggaccaaatagtggggcgggctgagaagcgacttgtggaagtgaacaagagtgcgagtttgagtcgccctctggtgctgggatattgtggttgcttcctgttccatgtgcaggacatcacataatggatctaagtactcatgagactgttcacatcctaaccagggcgtgcgcatacattccacaacgacgtagtacctgttagccatgtggggaggtgctgtacaacactgcttttttcatgtgtcgcgaactggaagtcgtacgtcgacttgggtgtccccaacacagacaaggtggatggtcccactgtggcaggcanacctgggaagcacgtatgggtgcaaacgtgtctcaaataagaggtaggtgggttcaccatacggcgacaccacatggacgatttaccatgtacccaattcagaccggcatatagaggatggggatatcccgggtaaggtcccaccttcaaaccaggtggaccgcttgttctgcccttccatgaaccattggctctaacccctaaagataataagctagaaaaagttcgcgtgacttcggggagagcggcgggttacggttatgtgtgtattttctgacctagaggaggtgttaatgggtggtttggtgtacaagaggtatacgagcgtgggtaaatgtgcggtacggttaaggccccaacttcatttggggtaagtgtacgtaaggtgaaggttctaacaaatattaagaaaggttgccccaaagtgtaaggtggcattttcttaggggagggaaaaggaagactaaaaagccgaggacataccaactaagaaaggggacattaaaccgggacacaaacaatgatggagccggcaggcaagagggaaagccggcttggtgcacgcaaaaggaaagaacatcttcggaaccaagaggagtggagcgcgccacgcgcaacgtcgtactcattaacgagaggaaaacccccaacgggggcacctgacgcgtggggcaccaaggagaagagcgcggcgaccattaaacaaaggaaacagttgcggctccagcggttaccctgtaaccgaacgaagcacgatagagaacaacagagaggggggcgcgagcgcacgcggtaaccaacaaacaagggactactacgaccaactcagcggagggcagaaggcagccctaggcggccaacatcacaccgacgggacggaaaacacccacaggggcagaggaaagcacatgatggccagcacccacacaacaaagcgtcggcgccgcgcaggtagaggtaggtacgacagcgacaacagatagagagaggagcgaacacgacagcctacaaacagagacg

SEQ ID NO: 536747 - DNA, 166 bp, Homo sapiens
cccgattaccgtcgggcgccactgctcgtgattgacccttgatcgacggcgctaacggatcgcagtcggcgtccacgcggaacacgcaagcccgcgtggtggaggtggcgcagcgcttcccgcaatacgacctccgccccttcaacacggccagcctggaaagcaa

SEQ ID NO: 536748 - DNA, 821 bp, Homo sapiens
taaatcaaaaggctgttaatggacaaaatagggtgtcacaaatacttcatttatagggagagaggggacttgaacaagtccaaaatcttatactcgtgcacagaagcccagcgagggagtgtcctctctagaagagtggtttatcaggggtaccccagtgagaagggcagcctccgtgatgcagcgtgccggaagaagcatcgcacaaccgggtcccctcttccgtgggtctcttccccgagggttagtggataaagtcgtggccgtggaagttaacgcgagcgttcccgtgaagtgcgcctctgtggacagtctcaacctttgtgcaaaactagtctcgtgggcctctccagtgggagggtctcctcgacagtggcgagcctctccaagaagcctttcgtgcaatattctatccgggcggtgaactcggataggaaagctgtgcgtgaaagcccacctggtggccacttggggcccacttaaaacacacagtgggccaccgaacctttgggtcccagagaaatagcccccggaacccgccaaggaggggggctctcgagtgcgccacggtgtggaagacaagacctcacagggcctgtggtcccgggagacactctccccaaaagaaactgggatcgccgggcgcgcaaacaaacgccaaaggtatccaagggacgtggtctactacacagaggggcccaacggtccctgggtgaacccggggcgcactcccctttgggaaagagggcgccaaagaacgcctttggccaaggcaacaccattgggggcaacgccgcagatggggtatgggggagaagact

SEQ ID NO: 536749 - DNA, 262 bp, Homo sapiens
agacgtgtaggtgggtaggtgggtgatatggatcagctctgtgtccctggccaaatctcacactgaatgtaatccccactgttactggtggggcctggtgggaggtggatggatcatgggggtggatttgtgatgaatggtttcacaccaccccttggtgctgttcttatcatagtgagttctcacgacatctggttgtttagaagtgtgtagcgcctcccccctcactctctcttgctcctggtcccggcatgtggagaga

SEQ ID NO: 536750 - DNA, 182 bp, Homo sapiens
  misc_feature (25)..(25): n is a, c, g, or t
gaaaggtgatccttgttataaagtngcaaataagctggatgtggtggctcatgccagtaattccagcactttgggaggctgagctgggaggattgcttgggcccaggaggtctaggttgcagtgagccatggtggtgccactatactcagcttgggtgattgattgagaccctgtctcaagt

SEQ ID NO: 536751 - DNA, 519 bp, Homo sapiens
  misc_feature (25)..(25): n is a, c, g, or t
  misc_feature (131)..(131): n is a, c, g, or t
  misc_feature (135)..(135): n is a, c, g, or t
  misc_feature (148)..(148): n is a, c, g, or t
  misc_feature (154)..(154): n is a, c, g, or t
  misc_feature (168)..(168): n is a, c, g, or t
  misc_feature (170)..(170): n is a, c, g, or t
  misc_feature (172)..(173): n is a, c, g, or t
  misc_feature (181)..(181): n is a, c, g, or t
  misc_feature (186)..(186): n is a, c, g, or t
  misc_feature (195)..(195): n is a, c, g, or t
  misc_feature (199)..(199): n is a, c, g, or t
  misc_feature (212)..(213): n is a, c, g, or t
  misc_feature (217)..(217): n is a, c, g, or t
  misc_feature (228)..(228): n is a, c, g, or t
  misc_feature (235)..(235): n is a, c, g, or t
  misc_feature (241)..(242): n is a, c, g, or t
  misc_feature (276)..(276): n is a, c, g, or t
  misc_feature (309)..(310): n is a, c, g, or t
  misc_feature (507)..(507): n is a, c, g, or t
gtattgctgccattgtggggaaaantactgcttattttcatgacattttcagaacttaactaggtaaaatggggatactaccctgtgcagggttatgataattaaatgagacacttttaagggaaaagaanctgncatagaacctggnacagantgggtatacaaganangnntaattttnaaaantaaaaactnaggngggtaatatacgnnatanggggagaaagnaaccaanccaggnnaccataatacatcagtagtagaatgtggggtgcngcctacactttccactgtgaattgcttgtattnntatctcaacaatcatataatgtttgcagtttacaaatatgcatcacatttactctttcacttaatcattgatacaactgtgagacaggtagagtgcatgctgttctccccatcatagagataagggaatggaggcgcgcaatattttgtcaatattttatcaagatcatagtaagtggcagaataggaatttttacncctaatataagg

SEQ ID NO: 536752 - DNA, 215 bp, Homo sapiens
aggatgaggtgtgagagatggaagtatgcctctcctcatcctcccttcacctcgaggatgccctgtgggagggtctgtagtggtctgtgtccacctcctacatctattcacatgcaggtatgtgctcgaatcacgaagttcacttgactgactttgtgcatagtgtttctggtgttcccaacttaggaaacgacgtctctagacacgtggtttcc

SEQ ID NO: 536753 - DNA, 205 bp, Homo sapiens
  misc_feature (8)..(8): n is a, c, g, or t
  misc_feature (37)..(37): n is a, c, g, or t
cgatcttnaacacgcaatctgggtgcgcacggcgttnggccaaaaacgggactggccacggtgagggaaaagacgctggataaaacccgatgcacaggccatcctttgcgctttaagccgcgctgtgcgcgggctcgaggtttaaaggaaatgccatgcacgcccaaacctcctcgctccccgcacgactttcgaaattccattg

SEQ ID NO: 536754 - DNA, 213 bp, Homo sapiens
actagaggacccattgagatgtgcagcgcgagaggtgtcagcaagacgcctgagtctacgcttcacataagagcgcgtgaggatgaggggctcagggccagatcaggcgtggccggaccaagaagaacggtgctggacaagtgtcaagaggtcatctcgtggctggacgccaacaccttggccgagaaggacgagtttgagcacattcttaat

SEQ ID NO: 536755 - DNA, 521 bp, Homo sapiens
  misc_feature (2)..(2): n is a, c, g, or t
  misc_feature (49)..(49): n is a, c, g, or t
  misc_feature (62)..(62): n is a, c, g, or t
  misc_feature (74)..(74): n is a, c, g, or t
  misc_feature (106)..(106): n is a, c, g, or t
  misc_feature (127)..(127): n is a, c, g, or t
  misc_feature (179)..(179): n is a, c, g, or t
  misc_feature (198)..(198): n is a, c, g, or t
tnggggggccccgaaccccaggcatctgacccatttagaccatgctcanccaaaggttcctnggaagaaacccngagggaaggagaaagcctcaccaaaaggaaancaaatgcctattttatctggncttctcacttctacggatagttgttttcacttaaaaaccaaatcccccaaantgtttccatgatagggccnaagtgacttttaaacacaatctagtttagtagatagtatactatactattttaagggccaggcgtggtggatcctgcctgtaatcctagcacttcgggaggcagaggcaggaggatcccaggagttttgagaccagcctgggcaacatggggagatcctgtctcttaaaaaaaaaaaaagtgtactatactattttaaatgtctacttttaaatgaattcagtgttatctgttatttttaatgttatttttcagatcaagtttgaatattaattgtacatgtaatggctaaaaaattaaatcatgatttgagatcttgattat

SEQ ID NO: 536756 - DNA, 216 bp, Homo sapiens
gtggtcgcctgtatcccagcacttggggaggccgaggaccgtggatcacctggggtgggaagctcaagaccagcctgaccaacgatggagaaacctcatctctactaaaaacacaaaattagctgggtgtggtggcacattgcctcattaatcccagtctactcagaaaaacatgaggccagaagaacccggcttgaaaccacgggcaggcggaag

SEQ ID NO: 536757 - DNA, 716 bp, Homo sapiens
agaccttgacactatgtgtctcgaaggaattctgccacttgatcgtattcacaggagccctggtaggctcctttataaggaccatttctgttcctagagcttaactagaattcattcttcactgaaaaaaaaaaaagttacttaagaaagcatttcgtttccataagtcatcactcaagatctgcagaagttattgtggtacatttagtaattacagaactctggccaaagggagacttgtaaactagcgtaaagtggtgtcttatgctaaacggttggcaaatgtataggcacgagaagcctctttgaagttgtcagcactgagctgggctcagcaagcctgagttcaaacaggcgtgtcggtcctccatctcaccccttaagtactggtgcagcccaaacttcctaggactcttgaacattctgagcagtattggtgctttgagccacttttggacaaaaatggctccatttttccacagcggggtttctcttaaacactagtttaactgtcttactagtctcatagtacgtagtgtggctttctaacgctataacagctcgacttatatccttctactctgaaaaactcttgacttgtctggacgtgtatatacatatatataaaggggagccttaatggatgggttctcataacttaatactctcggtactcgcccctgtataatggtccacaacggaaacgttcacacgaa

SEQ ID NO: 536758 - DNA, 1016 bp, Homo sapiens
aagcagtggtatcaacgcagagtgcccattacggccgggcggcggggtcacgcctgtaatcccagctctcagggaggctaagaggcgggaggatagcttgagcccaggagttcgagacctgcctgggcaatatagcgagaccccgttcgtccagaaaacggacaaacaagacacacaaaaaaatgtgtttgggccgccttgggccgtggaaaaggtttactaaaccctttctcgttgggggggcggggcccaaagttgggtataggtgaaacgtgggcaaaaagcgggcgtcccaaagagaaaccccggcccattggacaaagggcggggttcaccaccaatattaaaaaaggccgggcgggaaccggggcggtttgggaacaatccccagggcggggaggtcgcagagacggccaaaacaggggggcctcaacttaaaccaggggaggcacaaggggggacggcggaattattcaaaaatctaacgccccggggtgtgggtaaacgacaatagaatcggacggaaacaacacacaggacaagaggacagcagcacagcatcaacgtactgaaataaaagaacagcacgcgaagagaacgcagaacacacagacacacagacactcaaagcagacactacatcgacaagacacagcaagcagacgaaagaaagtacgacacacacacaggagaacaaaccgatagcaggagggagcaccaaacagagaaagacggaaaacgattcgaggagagtactgaacgacgaccaaggagggacaacaaacaaaccaaggcgtccacacacaccagtcaccaggagcatgatgacagataatcagaagagtgcgacacacacgcacgctgtgtggcacaatatcacacgtcccatcagaaaaaacccccgagacggacgcaacagggactgcaagattgatgcgacgcaaacatcatgcaacctcgacgtcggacccgtgacgacaagcagacggcggaacatcacaggcgagccaacggaa

SEQ ID NO: 536759 - DNA, 1288 bp, Homo sapiens
  misc_feature (1)..(1): n is a, c, g, or t
naccccccgcctgcgctcggcggctgggtgggtaataaacagaaggccgctccttttattgtggaccctcctctcctacgttttctctcctcttgtgtggatacctccccctttcgctcaccccccgcgttgtttgtgggaccagccccccccctcttggtaatgaaactccctctctcggggggtcctacaatttactatccccctcctctgccgggattgttttttgtactcttgtagtgtctctcgtctgggggcgcggtggtagttactccactgttgtgttgcacacacccggggggtgccatgctgttgttgtggtcgcccctttttggggcccgcattttttttagtgggggcgccaccctcttgttatgacacaccagggtgtgtgccccgccacaatatctctccagggcttgtttgtttccccggtgtccgcgggttttttccccggggggatttttttttctggtgaggctcccactacgcgcgctttccgcgtgtgttctgccagcgcccacgacggtttttttctcttggggtttctcccctcctgaaagaatgtttcccccgcccacacaattttttttgcgcgcgtgatatcttcctccccccctctactcctctctgatttgggcgtcgcgccggcgatatatttacagctccctcttttctcacacctctctctctccgcccccttttaaggaggtgtttttgggtgcgccccgcgcagatatatatatgtcctcacatatctgtggggttctgtgaggagtatgtcacgccccctcttgtcccctcttctcccccgagaggggcgcggaggagaactttctctctctcgcgagagagagagagcgggtgagatacactttgtgtgtgctctcccccttttttccgcaatatctctccgctcgcgctcgctccacaagagagtctccccacagtggttgttctttgaacacaccaccaaaagagagattatataagagagagtgtggaaaataacacccccgcggttctttcgcccacagtgtgttttgtgagacgcacacacacacgcactctcctctgatatataccctgtgggcgcgctgttaaaaaatttgggcccccagagagaggggggtggctcacacttttgtggcgccctttttttctcggggcgcccccccccccagacccccctgtgcccccctggcgcccccccgtggggtgttccccaaaaaaaaaaatttttgtgtgccttttttttttaaaaaaaggttttaataccctctattga

SEQ ID NO: 536760 - DNA, 104 bp, Homo sapiens
tctggaaaggggagctgtggctctttaagggtacccagagactctgtgagaacgtttgacacagttcaagcaccttgaatgtcagaggactgagatgaatggcg

SEQ ID NO: 536761 - DNA, 421 bp, Homo sapiens
actgacaacctatggaatgggaaaaatattttcaaactgtgtatctgataacagggcgaaatccagaatatacaaataactcttacaatgcaacaaaaacaacaaccatttttaaatgagcaaacagatattttttcacaaagtgaaaagatacttaacatcattttcatgatttgcattagagaaatgccaaatcaaaaccacaatgagataccacttcacaactactagaacggctttatgataaacacaaaacaaaatgggctgggtgaggttgggctcatacctgtagtcccagcactgtgggaggttgagggcaggaggatcatctgcggccaagagttcaagatcagcctgggccacatagtgataccctatctcttaaaaaagaagaagttttaaatttgacatacttataggt

SEQ ID NO: 536762 - DNA, 250 bp, Homo sapiens
caggtaaacagctacgaatgtagggacactgtatagctgagcagtgtttacaagattgcttccgggactaagcaggcagggaataggcagacacatgtccacattaccacagctgcggccaattcctcagaattatataacagcacgaaacatttaagagtattttaaatctgagagctctaagtgttccgctctactttttcgcattttcagaattctgtacctgaacatctaattcctttcaaaacta

SEQ ID NO: 536763 - DNA, 457 bp, Homo sapiens
cgtctgactccgcttaaggcaataacctccaagtgacatgcctaattaatgacaccagtgctgatattcaaagacggatctctatgacccctaagcctgagctagtttatgacacgcacacactgatatgccagagagaaagcatctttttctccttcaaggcacccaatatgaaaattcaacgagctgacagacatctgtctggggttgaaatcatctgcctttagaagacagggagtgcctgcgtggatactcagttacccacgtgcatgtgggcatgtgggtaactgcagagtgggggccaaaactgagcttgtaacgtcatcatcaagaagcccggtgtcatgtatttgtcaagagctaaggacgctcccttgcccccatgagctcctgatactacagcgctatactgactggccaaggccctaaagcggaatcaggaggtacccgagcgtcg

SEQ ID NO: 536764 - DNA, 404 bp, Homo sapiens
aatcctctggggagaggtgtgaaccacacgccactccacgcccaggtgccggggtgcataatacaagaacagagttcttccggttgggatggactccgtaagatatgctttacccccagatgtataaataagggcaggttctatctagccgtagtccatcccgctcgttcccgcagcttgggcaagattgtagtgggatggtcccagcgtccagcccagagcgccctcggcacaaggagccatttgggataagccgttgacccatgtctcccagatcctcagcaggtccaccttagcccatcccagttaatcccgtgtcatctgagatgggattccctcatcctttgagttggaagtcccttctctagtcttcaataaagtcttttgacccttgaatcacatta

SEQ ID NO: 536765 - DNA, 204 bp, Homo sapiens
  misc_feature (55)..(55): n is a, c, g, or t
  misc_feature (59)..(59): n is a, c, g, or t
  misc_feature (61)..(61): n is a, c, g, or t
  misc_feature (67)..(67): n is a, c, g, or t
  misc_feature (74)..(74): n is a, c, g, or t
  misc_feature (84)..(84): n is a, c, g, or t
  misc_feature (94)..(94): n is a, c, g, or t
  misc_feature (97)..(98): n is a, c, g, or t
  misc_feature (112)..(112): n is a, c, g, or t
  misc_feature (122)..(122): n is a, c, g, or t
  misc_feature (187)..(187): n is a, c, g, or t
  misc_feature (191)..(191): n is a, c, g, or t
  misc_feature (196)..(196): n is a, c, g, or t
agttcggaccactgcaccaacactgtcgtatccttgttaaaatggtgtgtacctnacananttatantttatgngccaggttcnttttgtactnaanncctattattgtgangtgtataaantctttaatcttggttcttagtactttgatttggtctacaggtatattcctgggatgaaaggattnccanacccnaatataga

SEQ ID NO: 536766 - DNA, 718 bp, Homo sapiens
cgcagtggctcacgcctgtaatcccagcacttgggaggctgaggcaggcagatcacaaggtcaggagatcgagaccatcctggccaacacggtgaaaccccgtctctactaaaaatacaaaaaaaatgagccaggcgtggtggtgggtgcctgtagtcccagctactgtgggaggctgaggcgggagaatcgcttgagaccgggaaggcggaggttgcagtgagccgagactggccattgcactccagcctgggcaacagagtgaaattctatctcaaagaaaattaaataaaatacataaattagaatgtagtggtacaatggaatattatacagcagtgaaaatgagtaaaataaagctatatgcattaacatggatgaactttacaaattttgtgtgagtcaaaaacaaaaaacaacaaaaaaaaaattgggggggggctggggctggaaaaagtttttaaaaaacctttgttggggggcggggcccattgggtatgggaactgggccccaagcgggcaccaaaggaaaacccggccggcaccaggtgcggtttctccaccaaaaaaaagggccgggaccacggaccgtgtcggaccacccagaaggtgtcgggagcggccacaggggtctaaccagggggccagcaagtcggtaataccgcgcgggggggggaggaaagacaaagcaagaagaaggcgacgacagagacgacaa

SEQ ID NO: 536767 - DNA, 1298 bp, Homo sapiens
tttttttttgcgcgcccgtcgctttgctttcctctcccgtgcgtggtgtgttttgttctcgtcgtccttgctctaggtggctgcgtcttctcggtgggccggtccccctgtgttcctgtggtggcgtgtctctcgtcggtgctctgtctccgccgccccgtcctctcgtttccgtttctttgggcgtgttctcctggttgcttgtgtactgtcgggcctgcttgtcggttcggtgtcctctggttgggggcttcggttgccggttcgtgtggggctgcgggctctgggggctggcctcccgtcgtgcttgcgtccttcggtttcgtctggtgctctcgtcgcccttgcactggtccgtgctccctgctgctgtcttcggtggctgggggccgcggtatgtttgttctgggagcccttcctagctgtccgttgggcgcgggtgggctttcctgtgcgggggctgtcctgggtttgtgtcttccggtcggttcccggtttaggctcgagtgacgctcgtggccggctgtggccgcgtcgtgcccgcgccctctgtagtctcgagctgttccgcccgggtcgcctcgtatggtcgtcggtctgtctccgtctcccccctgtcccgtgcttgtgatgcgttcctgtgtgctccgtagttcggggtctggatgctccgtgtcgtgaatcctggggctccgcgtggggacgcgtgcgtatgctccggctgtcatgattattggtgttcccgtgcctgtgtcctgatagtcgcgtccgacctcgagtccccgcagaggatagcacaagtgccactacgcgggtctgcgagtaaagtttatcgggaaatcttcgcacctcaaggctgcacctgagaactctacacaggtgtagaggcccgtcgcctgcagtctggcaggactgcaaccaagaagttctgcgcgctgcgcgacgtagctggtcgcgtgcactaccgtcacacacacgggcgatgaagaagttctagctgccccatctgtcgagatagcgcttcatgcgctagctgacctacctgtaccaagcacgcgtcgcctgccacgccaatcttccaccctgggaatgctgcagtcggcgcggtcgtggggcttcgctggacctggctccctcgagcgactatcagccgctccgacgtccagcagccccaccatcagcccggtccagctcgccctgagcccgccacagtccagtgagcatgcctgctcccaccccctcgtgagttcctggccgttccttttgtaataagaatagaaaagagagagctggatgca

SEQ ID NO: 536768 - DNA, 385 bp, Homo sapiens
  misc_feature (94)..(94): n is a, c, g, or t
  misc_feature (119)..(119): n is a, c, g, or t
accttcgattgtggactcagagccgctgtggggaggaaattgctgttcagttcgtggacatggtgaaggggaaatctctcacgggggttgtgantgcccagtcgccttaccatgtgccnttctctccacacaccaatgccttggatttggtcttggcagacagctactgggtgacacttgattgcgacgcctgggcttgggtcccccaagaggaccaatccagtgtgataaccacatgggacacatcccctgacagaactgcttgggaacttgcctaatgccccgcaggtcatttgtcgcggctccgtgaaaggaggctttccaagccagggcggattgtgaaccttgtgtgacacgctaaagcttgctgggtgaaaagcaggct

SEQ ID NO: 536769 - DNA, 257 bp, Homo sapiens
  misc_feature (24)..(24): n is a, c, g, or t
  misc_feature (47)..(47): n is a, c, g, or t
  misc_feature (69)..(69): n is a, c, g, or t
  misc_feature (99)..(99): n is a, c, g, or t
  misc_feature (118)..(118): n is a, c, g, or t
  misc_feature (163)..(163): n is a, c, g, or t
gtggcaacttctctcccaccgggntctacactgagaggtaaccaggncttgtgcatgcccttgtgcagnaaatcaagggcccttgaatttgtcactgtncgggcgcattttttataanattgtcatatagtgcactgcacaaatattgtattactgtacatanagagaacaggtgggcatttttgggctacctggttcgtttttataagattttgctgggttggttttttttttaattaaaaagttttgcatctttt

SEQ ID NO: 536770 - DNA, 114 bp, Homo sapiens
tggaggacttctacccggaacatcagcagcgaagaaaaggcttcgtggactcgaccagagaagcaagagactctggatgggcacatggtggtgcgtagccatgcccgtgtgtcg

SEQ ID NO: 536771 - DNA, 449 bp, Homo sapiens
ggatccccttcgaggagctcagtcagtctgattctttattttatctaatcttactttgtggttggttcttttgatttctagatcttcaggtttggtgttagattggtggattggagatttttctaactttttgatgtgggtattagtgctacaaactgtttactcagaagtcattcaggagtgtttgtttaatttccttgtaattttatgattttgagtgatcttcttggtatcggtttcaatttttattgctcagtggtgtgacagtgtggttggtattatttcgtatttttttctcaatttcctgaagattgttttatggctaattgtgtggtcaatttagagcatctgcaatatacaaatgagaagaatgtatattcttttgtttttggctgaagagttctatagatatctgttaggtccatttggttgaatggtccgtgaagttg

SEQ ID NO: 536772 - DNA, 154 bp, Homo sapiens
tccaacgggccctcggccagcccaccagctctgaaccccggtgataggcgatctcatagccatcagggttcatgagtgggcagcaggtgaatgcgcatctcagagagcagccgggtcaccctgtgggtacccatcgcaggaacctcatggcaca

SEQ ID NO: 536773 - DNA, 243 bp, Homo sapiens
ccccccaaaaaattttttcccccccccggggggggggggggggccccccatttttcccccccccaaagcccaaaaggggggggccttttccccgggggttgggggaaattttttttccctggcccttctccccccccctgggtttttttttttgcccccccggccggggcccaaaccccagggggggttccccccccccccaaaaaaaaaaaaaaaaaagggtttttttttttttttttttta

SEQ ID NO: 536774 - DNA, 108 bp, Homo sapiens
gcatgtctggacagtgtgtgactcttgtgtacgtatgtctatgtgaatgtgtgcatatgtgtacatgtctgttagtatgtgtgtgtgcctgtttgtggaggtagcact

SEQ ID NO: 536775 - DNA, 117 bp, Homo sapiens
aatccagtgaaccatctatcacgaataaaaattctacctctttctactattctctcctacataatctcctacagtataagattcacagcctcagaactaattcatattcgatatcta

SEQ ID NO: 536776 - DNA, 411 bp, Homo sapiens
tatatataataactatatgtaaacttttatacacaactttatatatgtatttgtatagggaacaatgtgtctgagctgtgccatcttttcccaacaaattggaattattttttaatttcatgtaaatgaaagcattggggtctagagcttctttgcatgaaagttttttgtttgtttctgtatagaataaaatataagtgtatgcaaagtttttagtatctatacctcaaatggataggaatattcagttttccatttttttgtgcatttttttaacattttactttcttaatctctataacggtccagaaatgaaagaaaggaatgttcatagtccatacagaatacaggataaaggtctgtattctgttttacagagcaatttttcccctctagatgtgatatttaatc

SEQ ID NO: 536777 - DNA, 230 bp, Homo sapiens
tatcacttacatcatatcttaatggatattagacattacattaatggtatattaatatgttagggcttagtctgctatttatttttgtttctgtcatcatagttgttaggatatagctcctctctctctcacactgccggtgcgaccccggggcccccaattccacactcaacacaagctctggccaggaggctggcccagggcacagcatggtcggcgtcagagagccc

SEQ ID NO: 536778 - DNA, 272 bp, Homo sapiens
gcatgtgcgtgggcaagccgtagtgtgtggttccccagtggtgctctaacagatcaccgatcttgccatggcttacgaagctgcagattatatattgttacagttctgtgaagccagaagtccacaatcaaggggtcatgtagagtctctctctctgagacctgctgaggatgatgcccctggcctctccccagcctctggagtacccagcaggccttgggattccttggccttggtagatggcaaactccgatctccacctctatcctcac

SEQ ID NO: 536779 - DNA, 387 bp, Homo sapiens
agaacatggtcataatatttaaagggtgatttcactttccacccactcgctctagcttcactacaataaattcatcttcctatgacggcagggtggcatagcccaagggcaatggtcaaggtgggcctctcctgacctgatccctcattaacatttatcagctcccaaggtgaatgttctcaagggttatccagaaatgctggggtggctctacgtaagcgtgcagaccccttgctctcagaggcacccctcaggaacgccatcatattcgctcattcaccactcgttccctcctatctccccttgtaccggtgggtctctcagtgtcgtcattctctgggttgtgtccgtcatgcccctgaaaccttgatctatactctctggctc

SEQ ID NO: 536780 - DNA, 422 bp, Homo sapiens
cgttacctggttttatattctttgaaattacgctgagatgcatgaataaccagctcagggacaatgaagaaaccacccctagtgtaattacagctcataaacacgcaacttacagatggcccgtgtgcatgaacctccggatgctggctcctctagactctgcacagacaggcagggcaggaggcagtcccgcctacagggctctctgtctcccagtataacagcactgttttatagcgattgcatttgtttagatattctcacatcagagtgggatggatgtggccaggttctgggggaaacatcaccactttgcctgccactgggcagttcagctggactagttagtgggccatggtgaccttcgctgcccacgtagatgagcaaactacaggaagagacaactcatagaaggtgagagc

SEQ ID NO: 536781 - DNA, 881 bp, Homo sapiens
  misc_feature (342)..(342): n is a, c, g, or t
tgtctgtctactcccccctgttgggtggtctctcaggcgtgccatctgtgcctacccccgcagtttgttcggcccccgtttttctacggggggcgccccctgttgtgacaccgggtgttggttccgccgggtggcggcgagccccccgtgtggcccgcccttttgggtagacgccaacgggttgccctggtctccccccgagttgcgggggcagtctccccccctatggggggcgcaaccctccggtccacccatgcgggggatatcatgcgtgcgtagtggggccctcaccaggggttacccgcgctgtctttttcgtcactcaagacttggctcaggcancccctccgtgctaacactcgccgccactattccaaccccgcgcggggcatcaccacttcccctttgagggtccccctgggcgccaccgcacgtgcgcccatgtcttttccgggcctaggcctcaggacgccccccgattgtcagggcacggccccgaatgtcctctcgtgcatctctctctgcagcgcggtgagtttatttgacgtgagtcctattgtcacttcgttgaaacgtctcccccctgcggcggtccccgcccttgagatgcagacctgctgtggccactcttctatgcactcgcagcgctcttctcgagcacgcccggttgttgtgggctccccgcctggggaggcaccgagtctcctccctttcctttaaccgtctcatcgtacggcccgggccccatgcgtcgctccctcgcatgccccgccccggtggtgcgcccccgcccggctgcgtcctccgtcgcgttcccagggcccgtctgcccgatcccggcacaccccggggaatactcctttgcttcgcacaacaaaacc

SEQ ID NO: 536782 - DNA, 237 bp, Homo sapiens
gggcacagtcctgtggccccagcgcatgctcactgctgtctctcctgcgagggcgatcccggctggagaggacgttatccttcaccaggcgtcagagattccacaagtgtctctcaatatcagtcagcaggtacacgcgtaaacatggagaagtacaaattcctgggtatctccatagggggccagagcaatgagcggggagacggaggcatctacagttggctccatcatgaaggg

SEQ ID NO: 536783 - DNA, 520 bp, Homo sapiens
  misc_feature (307)..(307): n is a, c, g, or t
  misc_feature (422)..(422): n is a, c, g, or t
  misc_feature (479)..(479): n is a, c, g, or t
  misc_feature (486)..(486): n is a, c, g, or t
tgtgagcccagagctcctgacaaagccacccgggcagaagctttttgttttggccaaagttgatgactccttccttccttccttcctctttaacaagccacaagaataaaaggaagcctccatgaagatggatgtagacacagactgttgctagcctgacctcattatggggattagggtgatcttcaaggcctttctggtctccgttctcccatgcagggcaatttggactgtttttgccccaggctgtttagctgccaggacaacactggcagagagaggctgaggcgctgggctgcagtagcanaaggcaacagcctgatgccctgtgacagtgccccaggaaggttttcaggcagtgccttgctccctggaaccctgacccaccgtgttgcctctgttgatttggccagtactgtcantttccatcctggaagaatgtgtttggaaatcagcatttaataaaaaacccaaattcngaaaggntaaatttgcttgcctgggaaaaagggcttttacc

SEQ ID NO: 536784 - DNA, 319 bp, Homo sapiens
  misc_feature (9)..(9): n is a, c, g, or t
  misc_feature (40)..(40): n is a, c, g, or t
  misc_feature (124)..(124): n is a, c, g, or t
  misc_feature (204)..(204): n is a, c, g, or t
  misc_feature (258)..(258): n is a, c, g, or t
  misc_feature (296)..(296): n is a, c, g, or t
gaattcggnacgaggagagagagaactagtctcgagggtnagggataatgatggggtgaggggaagtggaaaacaaaacctcacaacagcactcccagacagttctgtgccttttacccatggnaccatgttgcatgcatttgggacttagaggccgatacaggctattggagaggctgcttataaaaaatcctaaccccctgncctactcagtgaagaaaataatctcttttatggttgcaagtgtgagaatgaatnttgtaaatgtaatgttcataaatttttaaatgaacttncttgaggatgccaggcccttaaa

SEQ ID NO: 536785 - DNA, 189 bp, Homo sapiens
  misc_feature (136)..(136): n is a, c, g, or t
ctcaaactcctggcctcaagcagtccttccccctcggcctcccaaagtgttgggattacaggcgtaagcaccaggctgggccttaaacttttcaatggatctatgcttctcttctgttgcttttttttttcgaggnactccagctctgtcggccaggctggagtgtagtaggtccaatctcggctcact

SEQ ID NO: 536786 - DNA, 247 bp, Homo sapiens
cccaaagtgtgggattgaggcgtgaaccaccgcgccggcctatatatcttttctttgagacaggtctggctctgtcgcccagggtggctggagtacagtggcacaatctcagctcaccacaacctctacctcctgggctctagccatcctcccacctcatcctcccaagtagctgggactacatgtgcatgccaccacacctagctattttttgtattttttgtagagatggagtcgcgcttgtcgt

SEQ ID NO: 536787 - DNA, 160 bp, Homo sapiens
atagctgctggccttctcactctaccttggactttgtgcagcttatctttcctttttatctgggagacagcccattgccttgacgccaagacaggatcgcgctgccgcaatctgagactcagtgcaacctctaactccatggtatcaagggacgatcctg

SEQ ID NO: 536788 - DNA, 185 bp, Homo sapiens
cgacttagaccccaggaggccatggaaactgtgatcttacctgtgatcctgagactccggacacaagctaccagtgttggatgattggtcagagcctccctatgactcacaggtttcagctgtccgagtccaacaggaccctctttctatttggtgtcacccagtattctgcaggaccctatgaa

SEQ ID NO: 536789 - DNA, 227 bp, Homo sapiens
agcacgactccgagcctctggtgatagcatcagggctgtgcagtttgaggtgggtagttgagctcgtcaggaaccgagtccattgcgcttggatctcctggctgacatggaaggtcgacgtcccaggtgtcatctttccgggcgatgaatgtacattgttcccgaagtgcctgggaggcgatcgagtagtcgtcagacttgatcctacaacgtcgacgtgtagaact

SEQ ID NO: 536790 - DNA, 1182 bp, Homo sapiens
gaacatctacacagcttatgtggacctggaaccaggacttctgctgctgaggttgtacatcctggagacctgagacgaattctgttgatatgtcagcactggagacaatgttgcatgagatccaaatccagggaaaagtttaataccaccatgtcactgtaaaaagacgtggccagcgcatgcctacctcagatcctctcaggagcatgaagccaaatggcacggaatggcccatgtcgctagagcaattcaggaacgcgaggagcgaggtcatcgcgcatgcccggcctgggaatagtaccgatgtgtgcggtaaaactcaatcagcgtgatggaagaaagcgagccgcagagtggcagcacgagcctggtaatgctagagtaagagttgatcgctggcgggaaaagctgaaaaccgacggggactagtagtgtgtgacgctgcggcctgggcgtaaccatgtggccgtgagtccctcaaagagacgtgaggcgtaagcaatgggagacactgcgttggggtcagggtacgagtggttccgtttgcaaagccttcgaaatcctctcaagaaaccgatggacaaacgtgaattgcgaatgtttgccgccacacgagatccatggggcgtgttcatgggttgtatgccctatccttgagttgatgcccaggggggggcatctcaacacttacagcgaccaagggagatgggaaaggacccgtacgtggtgagggcctcgtacctcgtgattggagaggcccttgccgtgaacttttcccgtggtgaatccgggaagaacaagcggagttggatcaagtggatagaaaccagtggcggccatacatttggaagccaataccgtggggggcccgcaaattgcgcacaggcagattgaagacgtggcaccggacttcttacaagggctccgcgcataccgggaaaaagctggacaagacacaggtatccgttggtccttgcaatggaaaacgaggttttgggcagaacgatggccttcgggaaccctttttccaatacgacaagttcgagtaccgtaggaagcggagaaggttagacagaattacgtgacacaccacattgcgtagagtcacaagggcttaaaaattcggaaaaaatatatccaatttgaaaccccagagaggagcgttggggcggatcattccca

SEQ ID NO: 536791 - DNA, 675 bp, Homo sapiens
aggaacagtctgagatctaagtaagatccatttcctcgctctgccgcagcagcgtcattttagaaggactgccaggcacaatgaaggttctcttactaaaagacgccaaggaggatgacagcggcctggatccatatatccaggagctgcgattgtgtggcctagaagccacacatgaattcctgtgctgtcatttgagtttatgtctctccccagtttgtcagaaaagctgtctcatcctgaaggctttggaggactcattttcaccagccccagggcagtggaagcagtgaagctgtgtttggagaaggacaataaaactgaagcctgggagaagtctctgaaagacagatggaatgccaagtctgtgtacgtggttggaagtgccaccgcttctctagtgaataaaattggtctggatgcagaaggagcgggcagtggaaatgcagaaaagcttgctgaatatatttgctcaaagccatcttcagagctgcctcttctctttccgtgtggaactatcaaaggagatactcttccaaaaatgctcaaggacaaagggatccccatggaaagcatgcatgtctatcagacagttccacaccctgggatccaagggagcctgaagagctactatgaagatcagggtatcccagccagcatcacgtttttcagtcc

SEQ ID NO: 536792 - DNA, 361 bp, Homo sapiens
agggttgcttggttcacagaatggtggcttatggacgctttgaagacacataaagaaacccacatggtaaaaggctgggtgcggtggctcacgcctgtaatcccagcactctgagaggctgaggcgggcggatcacaaggtcaggagttcgagaccagcctggccaacatggtgaaaccccgtctctactaaaaatacaaaaattagccgggcatggtggcatgcacctgtaatcccagctactcgggaggctcaggcaggagaatcacttgaacttgggagacagaggtgcagtgagccaagatcgcaccattgtactccagcctgggcaatggagtgagactccgtcccaaaaaaaaac

SEQ ID NO: 536793 - DNA, 132 bp, Homo sapiens
ctacccgccataaccaatcaccataatcgaatattataacactgagactgtaaaaaacactccaaaagtccagagtgataggcaacaaggtttcaattgtatacgattaaagattaactattggtacaaaat

SEQ ID NO: 536794 - DNA, 1653 bp, Homo sapiens
  misc_feature (322)..(322): n is a, c, g, or t
  misc_feature (338)..(338): n is a, c, g, or t
  misc_feature (342)..(342): n is a, c, g, or t
  misc_feature (349)..(349): n is a, c, g, or t
  misc_feature (355)..(355): n is a, c, g, or t
aagggtgatgcggtggggaggaggaggagaagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatnccaatgacccctcccncatntcagtcncccacnctcctcccaaggacaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaacaggggctgggtgtggtggctcacgcctgtaatcccagcactttgggaagctgtggcgccg

SEQ ID NO: 536795 - DNA, 1589 bp, Homo sapiens
tggctctctgctgtacatccgtggatcctcaatgtccattttgagacgggaagatagtcttcaggaaagacacacaaaggtaacttgtgcagagggagatggcaaatttatactttctcagaaacacagtaatgataagtaaccaaggacttccactaaagtcagtcccacgatgacgatgttcagccagagtattgataacacttaaggttatatattttggccaggcgcggtggctcacgcctgtaatcccagcactgggaggccgaggcaggcagatcacgaggtcagagatgagactatctggcgaacacggtgaaacccgtctctactgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaacaggggctgggtgtggtggctcacgcctgtaatcccagcactttgggaagctgtggcgccg

SEQ ID NO: 536796 - DNA, 469 bp, Homo sapiens
  misc_feature (61)..(61): n is a, c, g, or t
atggccagtccttaaagtgtcatccaaacgcttttgcttgctttgtgaaaagccacaggcncctccgggaaggttacctaaaagagctgctgtccccatgggggggtcggtttacccatgaggaagtggattagctgtcaccagaagcccccattgcccaaaagggggatttccatttcctcgaggtcacccgcctccttaaacctggggcccaaggccaagatggctgaaagaactttagctaaaattttcccggtaccttgttttactctcttttacttttcagacccctcccccccccccatagaacctgttgcatgccacttagtttccccgctttgcctcttctttttgatggatttattcccgccccttttgccccttagcccttggataatccgcctgggaatgggggtgaggggggtaattgtttttaaaaaggtcgcgaataaaaatcccccaatgtgga

SEQ ID NO: 536797 - DNA, 453 bp, Homo sapiens
tggacacgcggggcgggagacagtgcagggggcataatctggcgctcacggcagcctcggcctcccaggttcaagcaatgctgcgcggcctgggccttcggagtagctgggtttacaggcgcccaccaccacaccgggctaattggtgtatttttagtagagacggggtttcaccacatgggccaggcgggtttcgaactccgggtctcaagtgatctgcccacctcagcctcccagagtgctgggattataggcgtgagctaccgcgcccggccctagggaagtttaaagccaattctatctcgtctttggcagtacaacctgccggtggccaccggaaggtggtactgaagctgcttataaaactgctgacttcgggatatgggaacgtggagacaagaccaaccaagggatctcagagttgaatggccagttcagtgggatgggcaaagg

SEQ ID NO: 536798 - DNA, 314 bp, Homo sapiens
cagggtccccaaggtcttgggcaggaccggtttcagggacagtgcacccaggtgggggtggaatttatggccgacccgagccgatccttcatccccaatgtaaaaggccccgtgggcgagggggacgtgctcccccttttggagtcaaagcgaaaagcccggaggttgcgttgagcttggctgctcgctgggttttggatgtcgggttcgcccccttggccgatgggaatggtttgtcccagtttgccccttttttttgtcccccccccggaactgaaatgctcctttaaataaagggtttgtgtttcaagtta

SEQ ID NO: 536799 - DNA, 640 bp, Homo sapiens
cagtgcgaatacctgatacaccttctatggctgtcccaaggatgagctgcaacctgtttgtgctgaatgtgacacactacaagaagatgcagaagttcttgggactgccccgagtacatggtgactcttgtagcaagaagtagccactcgatgaccagtgcgagaagctgagcgcatgccggtaaaacccaggagtgctgcgtccaagctaacaagctctcattcgcctcgcgaagcccaagtgggacaagaaccagatcacatacaggatcattggctacacacgctgatctggacccagagacagtggatgatgcctattgctcggtgccttcgcaagtctggagcgatgtgaccccactgcggttttctcgaatccatgatggagaggcagacatcatgatcaactttggccgctggtgagcatggcgatggatacccccttttgacggggtaaagcgaacgggacctccctggtctcatgcctttcgcccacaggcactgatgttgggggagactcccatttgatgacgatgagctatggaccttgggagaagagcaagtggtccgtgtgaagtatgggaacgccgatggggagtactgcaatgttccccttcttgtcaatggcaaggagtacaag

SEQ ID NO: 536800 - DNA, 443 bp, Homo sapiens
  misc_feature (300)..(300): n is a, c, g, or t
  misc_feature (302)..(302): n is a, c, g, or t
ctgccaggattcggccacgagtggaagatgaggatcacttaccagagaagtcaaggtgatcatctccaaagaggtttacagtgcttggtaggaatggaaaatgaggacaagaaaaagaggagaaccatggagaaggcccaacatggcacggacagcagccagctccaaagtcacgaactctgggattcaagaagagtcgtgtagtgctttcaactctcatccgcagcagctcactgtgtgtggactctgagctgacacgggagttggcttctttgttccatagattttctatccacaggnantattattgttcttggaaagttcattatttttttaaattaccttactctcagaaagggatttttttgaaggattctgtcatatatctttggaaaacagaaaatcagtaatatgtatatttttatgtatgttcactggcacta

SEQ ID NO: 536801 - DNA, 143 bp, Homo sapiens
cacagaacatgaccagtccccgaaggtgacgattttagcggcccatctccaacgtaacctcggcgccgggtgacgtccctcccgcttggtcaccactcgggcaccagaaacctgtgaaggtcgaaacagctgcgtttccggtt

SEQ ID NO: 536802 - DNA, 236 bp, Homo sapiens
tggatgtcgtgtttcttgtagcacaacttcttgtagaagttgttcttggcttctggaggaggttacggtaccacaagaccagtctgagcggaaacaagacatttgaataggtcaaaaacttcggtttaaccacttgcataggaagaggatgcacattcggccggaaaacgattgtttcataaatgactgcagtggtcgacgcggccgcgaatttagtagtagtagtaggcggccga

SEQ ID NO: 536803 - DNA, 114 bp, Homo sapiens
gcggccagctagctgttatgacaaggactgtctgtacagagacagagaggaacttcctacatgaattttcataattcaggtaacagcaataggcattccaggattcattggggg

SEQ ID NO: 536804 - DNA, 94 bp, Homo sapiens
agcctcacctgggggcattttgtgggtggagggccagagtgtgtatacccagccttgtctggaaggataacgttttccctgcctaaaagtcaaa

SEQ ID NO: 536805 - DNA, 493 bp, Homo sapiens
cattattcatttcttaacatagcgtgttcagctgtgacgagtcaagttgatatcctagaatatgccagtgacctttcaaactcgacacaagtgtgttctgaaactgtcgtgactcttaccacgcgctctgtgatcaatgaactatgtggttttgaatcggatgtagaccattagtactactacttgagctaaacttctgcatggttcataatttttaaagtgtgtagttaatatgcatgttatcgtcctttcttccattcttaccagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttagcgcgtgctgt

SEQ ID NO: 536806 - DNA, 302 bp, Homo sapiens
gcgttgtcgttacgtcctgtaatcttacactttaggaggcaaggcgggtggatcacttgaggttcaggagttcaagacgagactgggcaacatggtgaagtcccatgtctatgaaaaatttaaaaagtaagctgggtatggctgggcacggtgactcatgtctgtaatctcagcactttgggagggcccagttgggtggatcacttgaggtcaggagtaagagaacagcctggccaacatggtgaaaccccctgtctctactaaaaatgcaaaaacttaccctggccgtgctagcgagcacc

SEQ ID NO: 536807 - DNA, 144 bp, Homo sapiens
tgtatataatctcacattgactcgaacttcgtactcccggcaacaggcattaagcggagtgacagtccccgtcagacggaatatgtcccctttaattaaattatttcatggtgtgtcgaaagacggaacgatcggtaatccccg

SEQ ID NO: 536808 - DNA, 617 bp, Homo sapiens
  misc_feature (1)..(1): n is a, c, g, or t
  misc_feature (153)..(153): n is a, c, g, or t
  misc_feature (157)..(157): n is a, c, g, or t
  misc_feature (159)..(159): n is a, c, g, or t
  misc_feature (162)..(162): n is a, c, g, or t
  misc_feature (166)..(166): n is a, c, g, or t
  misc_feature (169)..(170): n is a, c, g, or t
  misc_feature (172)..(173): n is a, c, g, or t
  misc_feature (175)..(176): n is a, c, g, or t
  misc_feature (178)..(178): n is a, c, g, or t
  misc_feature (181)..(181): n is a, c, g, or t
  misc_feature (183)..(183): n is a, c, g, or t
  misc_feature (190)..(190): n is a, c, g, or t
  misc_feature (229)..(229): n is a, c, g, or t
  misc_feature (295)..(295): n is a, c, g, or t
  misc_feature (300)..(300): n is a, c, g, or t
  misc_feature (379)..(379): n is a, c, g, or t
  misc_feature (407)..(407): n is a, c, g, or t
  misc_feature (464)..(464): n is a, c, g, or t
  misc_feature (524)..(524): n is a, c, g, or t
  misc_feature (527)..(527): n is a, c, g, or t
  misc_feature (532)..(533): n is a, c, g, or t
  misc_feature (608)..(608): n is a, c, g, or t
nttttatttttttttttgttatattttgaagaaaacatacaatacaaaatacagaaaaagttggttccgtcccctcccactcccccctctttacccacccacccccaaatactcatcatcatgatttggtcagaacagggctcagagccagangttngngtnaccnagnntnnanngnttntnggcaatnggttcgtggctgtcacaataatgctgtgataatgctgtngtttcccagcagggaggtgggagcggggagggggctgcagcctgatgagagccagctgaaggaagnttctncctctcccttcctaagccccttcccaaggtctgccccaccgcccaaaccaaagaccactccgaacaaagtgaggatgtngattcttcttgctgggtccgctgttccncatgagggaatagaaagggtagctgccctgaccccactgtccccatatacaagggtnggggggcaagaacatgtggctactcccagcaagggaaaatgggagatcagtaaaaagggnatnaagtnngaatagcagaagatcatatatattaaaaaagttacttaagactttaaaattgaattagtatttgtacagaaaggntggcatgtt

SEQ ID NO: 536809 - DNA, 573 bp, Homo sapiens
gcacgagaaagggtcaatgacttggatgaagatattccaaggccgcctttctcctcacatagtgacaaaacggaagataaagagggagtttctgaggcctgtcctgtttgcgaaaaaactgtacaaaacccctgtgtattggaaacaggatacgtggcatgctacccgtgtgccataagctatttagttaataatgaaggccattgtcccgttaccaataaaaagctgctgggttgtacatacaacaaacacacgaataaatgggaagttgtgacaggtattaggaagctactaatctgatgacggaggaagtgaagaaaataattctgtgtaatatatatattctagttatttttttaacatatttgaaatttcccattgtttacacgaaatttctaataattttatttcattaattttgttatccaacaggtaattcatgtcacttgttccacctctttgcagttgtgttacaagcattgatatttttcgaagtattacctcttgtgtggcagagaaaggcttgtcagaggcatcataatttttcaagaatattatcattcgattaatctt

SEQ ID NO: 536810 - DNA, 1472 bp, Homo sapiens
gctcggagccgcgagggaaccgcgacccgcatggccccggcccgccgacccgccggagccctgcctgctgctctgtctactgctggtgcctgctgtgcctgcctgccgcctgcagggccatgggtgtcccctgtgacgcctggtggctgccctcgatggagcctgcgccctgcatgtggagcctgcctgccctggtgaacagacgctgcacccagagggccacacggtggacgcagccagcagctgtggtgccagtgccgacatcgtaccgccagagcagcacacacacgattgaggacagtgacacaacgagcagatcgacaccccaggagacagacctgagaatagcatctttcagatcacgtgcaaagacggttgacaaacgtggagttgtccaaagtagagcaaaagaaaagcaagagacgacacaggtgtgcacaaagggcacaaacgacacgcttagacacgatatcagggaatatgcaccaagagggaacacccatagaagaacatcacacagagaaccaccaaagagagacacccacaacaaagggaccacccaaaataaaaatccacaagacacggagagcgacaaagcaaagaaagagaaaaataaccacaaaaatgacatagacagaaaaacacgatgaagcggaagcgaagaaaagaagagaggaagaaaaaaaagacaaaaaagacacagaaaaaacacagtgaaaaaagaaaagatagggacaccaaacggaacaaagagaccagagaacaagagagagaaaaacacaataagacacacagggacacaaaggagaaccaaacaaggaacaagagaaaaaaaagaaaaagaaaaaaaacaaaacaagaaagaaagagaaggaagacaaaaagaaaaagaaaacaaagaaaaaaaacaaaagaacaaccagaaaaaacaacacaaaaaagaacaaaaagaagaaaacaaaaaaaaaagaaagaaagaggcccaaaaaaaaacacaaaactaaaagaaacaaaaaaagaaaaaaacaacaacaagaaaaaagaaaagaaaaacaaaaaaacgaaaaagacaacaaaaaaaaagaaatagaaacagaacaaaaaacaaacacaatgacacagaaaagaaacacacgaagacagaaagcgaaatacaaacagaaacgagagaaaacaagaaaagaccaaacaaaaaaaaaaaacaaaaaagagaacaaaacaacacagaagaacgagaccaacaaagaaaatagaaaacataaaaagaaatacacaaacacgaaaaaaaaaacaaaaaaaaaaaagaaaaaacaaagaaaacaacaaaaaaaagaaggaaaacaaacaacaaaccaagaaaacaaaaaaaaacacacagacaaaaaaaacaaacaaacaacgaaataaaagaaaaacacaacaaaacagagaacaaacaacaaagacagaaacacacacaagagagaaaaaaa

SEQ ID NO: 536811 - DNA, 304 bp, Homo sapiens
tatgctggaaccttcctctcctcccacctcatctgtagcaatctgcccatttctccctcgcacaaggctgaggcaggagaactgcttgaacctgagaggtggaagctgcagtgagccgagatcgcaccactgcactccagcctggattacagaacgagactgactctcaaaaaaaaaaaaagctacggatgcatgaaacaacagggggcggtccctcaagaaatagtggtggtcaagccacggggcgcaggggctcacaccggtaatcccagcactttgggaggccgaggggggaggagaggaa

SEQ ID NO: 536812 - DNA, 139 bp, Homo sapiens
gagtcggcccgctctcctggtgttgacttagggatgaaggctcaggctgtgcagaaatggagtcaccagcagaagaactgtttatctctgataagggatgtcccaccattttcaagctgttcgttaaagttacacaggt

SEQ ID NO: 536813 - DNA, 407 bp, Homo sapiens
aattcaaatgaggcagacttggtgctggcgaaagaggccaatatgaagtgtccccaaattgtaattgctttttatgaagagagcctaacttggccttcttgtccagaagatgaagctcaataattgttccccttgttcttttatatatatttatataaataaataaaaattgggtcttagattttgatttcctagtgtgccaaaatacccccctcctaatgaaaaccaagtttgatatgtttgttttgaaagaagcgttggaaaagttgttgggggttttttgcacccaaacccctggttcctttgaacaaataaataaaacctttctgtagttgcttcctttatcaaaaaaaaacatttgaacccatggtaaatcatttcctcttcattaaaaaccccctttttta

SEQ ID NO: 536814 - DNA, 122 bp, Homo sapiens
gactctaccgatcctaatgctttgggacggcgatccacccctgtattaaagaaggaaaccaggccaggcgcgatgactcacgcctgtaatcccagcactgtgggaggcaaaggtgggcagac

SEQ ID NO: 536815 - DNA, 421 bp, Homo sapiens
  misc_feature (143)..(143): n is a, c, g, or t
  misc_feature (208)..(208): n is a, c, g, or t
  misc_feature (246)..(246): n is a, c, g, or t
gttggagtttcttttatcaggcctcaaagcagaagaataattctccgtggttctggctctaccctctagatctgggtttgtcttctgagtcttcctttttcatcaaagctagagtgtgtttttacctgcagttcttttctcanggctgcttctttccagatagaattttagcgggaactatgtggtctctatatttgtacatgtttcntgtcctgtttatgttccataaatggcgagtgtttctanctgagtacagtaagattttggtgggcctgcctgtgattctccttgcggatttactccatttagacaaaagccacactcataaatatcttctttatgagacctaagcttcttacagactctgtttatcggttgaaaggatctgtgagacataatcttctgaacagccttttgtatg

SEQ ID NO: 536816 - DNA, 271 bp, Homo sapiens
ttgaatgtctggagtgtggatccatgcatgaacgcggatgggcaggtcaggcagaggctgtcgccatggttattatgagatggcacctagggatagtcagaaaagggagcaaagtaaaagatctagaaatatgtcggaggcactatgctgaatggataccatataaggcgggatgaagaaaaagagaatcaaggataatatctagactccaatttgaaccaatgatgacgtggtggtaacgtgttaacgtaaacactggggacgaatgaga

SEQ ID NO: 536817 - DNA, 180 bp, Homo sapiens
cggggggactgtcacgggacggtccctgggttctgctccgaggtcgccccaatcgctatttttaactgcaggttcggtagtttacggacctgtgtgtttgttagcgtcctgtttgcatttataaattaaagctccatagggtcttctcgtacttgctgtgttattgcccagcgagaacct

SEQ ID NO: 536818 - DNA, 339 bp, Homo sapiens
tgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatcggataattaattgtgtactttttgtagaataaagcattatgttctttatatccatttaataaatttctaacttgtatgaattttgtactctgaacatcatgatttctgaaagtacctgttggttttggaaaacatttctagctttggggaatgtgac

SEQ ID NO: 536819 - DNA, 468 bp, Homo sapiens
  misc_feature (35)..(35): n is a, c, g, or t
tagttagtgtgtttttcgcacacatttatccttgngtttaaaaggacacacatacatgctcacacacaatcctcctaagtgcgtatacttgctgtaatctaaataaaatacagctctaagaatgcaactatcattttttaaaaatcgactcttccacagtgatgatttaaaatttcattaaaagacataactgtctcaagttacccaaataaaatgaagctacatttttcatatcattttcaattgcccaattagacaaaacactctaaatgtcactagacaagtaaaatggcaaaaaaaaaaaagaaaaaaaaattcagctggctacttttcctaatttactcatataaacaatcatttcattgttaataatcagtaaatttgagaaaatttaccaaaagcaaacttatctccagtaaacaggacaaggaagaggcctcataagtttttaacttttaaaaacttggg

SEQ ID NO: 536820 - DNA, 799 bp, Homo sapiens
ggctcgggtggtgatcgcgtatgacacaccgctggaactaagggacgcttctacacagacagcactggccgggagatcctgctgaggaggcgggattatcgtagcctcctggaaactgatacccagacggagcccgtggccatggaatactactatccagtcaacaccgcgtgatttacatcgacggatgtgatacactatgcatctgactgtgctgactgaccgctcccagggcgggcagcctagctctgagagatgggctcgctgtgagctcatggtgcacctgaaggctgttgaaggacgatggacgcggagtatcggagccactaatggagcaacgggatcgtgaggcgtggagtgcgaggagcagccaccatgtggtgctgcgtggacacagcccaggctgcagccgccggacaaccggctcctggcggagcaggaggtcctggcccctcaggatggtgctggccccgggtggcggcgccgccatactaagtctcggtggctcctccgtcgcacgcacgctgtctcagggactgccgcagggtagcctggccgggccctcggtgcacctgctccacgctgagccatgctggggtccccgcaaatggtgcctgctagcgcttggagctaccgagtattgccgataggagaggattccggacgtaccctgagcgcccccgttaccttgaactttgagggacctgtactccagcttcaccatcacccggctgcaggagaccacgctggtggacaacaagctccgagaagaaacctcaagctcaagtggacacaatcg

SEQ ID NO: 536821 - DNA, 296 bp, Homo sapiens
tggtgactggaagtgtgggatccaggaatattgaagactcgacactgtaccatttgatgaacatcatcctgttgcaacggaaaatagatggtgattctacaaattctgaaggggaagaacctactgcgcacgtgaactgacagcacttggaatttagacgagagaaccagcttcatctcatatcgttctacgtgtggctgacaaaacctccgatcggcctggtgctcatcctaactgtgcagaagccaaatcacctgtcggaccggcggcggcggggcccccggctgcggcggccg

SEQ ID NO: 536822 - DNA, 846 bp, Homo sapiens
  misc_feature (36)..(36): n is a, c, g, or t
  misc_feature (113)..(113): n is a, c, g, or t
  misc_feature (174)..(174): n is a, c, g, or t
  misc_feature (224)..(224): n is a, c, g, or t
  misc_feature (242)..(242): n is a, c, g, or t
  misc_feature (324)..(324): n is a, c, g, or t
  misc_feature (501)..(501): n is a, c, g, or t
  misc_feature (529)..(529): n is a, c, g, or t
  misc_feature (571)..(571): n is a, c, g, or t
  misc_feature (592)..(592): n is a, c, g, or t
  misc_feature (627)..(627): n is a, c, g, or t
  misc_feature (631)..(631): n is a, c, g, or t
  misc_feature (648)..(648): n is a, c, g, or t
  misc_feature (684)..(684): n is a, c, g, or t
  misc_feature (687)..(687): n is a, c, g, or t
  misc_feature (697)..(697): n is a, c, g, or t
  misc_feature (725)..(725): n is a, c, g, or t
  misc_feature (757)..(757): n is a, c, g, or t
  misc_feature (785)..(785): n is a, c, g, or t
  misc_feature (844)..(844): n is a, c, g, or t
ttctaaataagtctgccaaattaaacatcatgattnaactacacatgaaaggaacatgcataccttacagcaacacccacagagaatgagctgaatacatgacagttacagtnaagaactaaagaaaccggcaaaaccgaggactcgctgccatgcaggttttacatgtctgcnatctgaaaacaaaaccataaaatagagtgtaacgggaatgtaagaaaatnaaatatatatcccaagtngctgacaatgtagagcccataacccagttaccaaatgttaaaaaaagttatgtgcctctccttcccaaaatgttagtgtgtngccatccttacaaatgagggggggggagacggtggacctgggggctcggaggccagaccagggcattgccctccacaccagcgggaaccgcatggacccccccagaccctgccctggcagaggaccccgaagtgaaaggatgtgttccccataacgaatgtccaaagttcgtgcatnactctgccgtgccctacacataaccgcncacacaggtttaatccaaaatgtaaccaggagaacccccgtncccgccccgcacacgccttangtgtgatggctcggcttctagagttgcctggtgtntgcnttattctaatggccccnacggagaaggggacgccacgcacgggcacaggtgangtnacgggcacanatgaacacgttgcgggtacggagaagancacaggctgggctcacacgaggggaaacattnacactgtgttctctctacagggtcaggncgtttttcttcatgtacgggcgggaaaaggaatacctttctccttttctaaggcaagcngc

SEQ ID NO: 536823 - DNA, 541 bp, Homo sapiens
tagccgtaccgtattcgccatgatcccaaatgcgactgttagtgaacacctgttgctctcgcgtattcaagcaaacgtccatgagcggtcgggccatgtgcgcgcgcggggacctcaggtgtctcaaggcagcatctcctgtatgaatacctgagcccattctttctgggtccaggtcacctgatacgcatgggtaaagtattttcgtgtgccactgtacaaaagcgtctttaacttttcccctgtagcgctattgttcgaaaaacatcagctcattttcttgagcaaatctggaggctctaagaaaggtaacttcacgatctgcatccggtcctcttgttccacaaaggatgatcaccaatggtctggctcgctagcaatcgggcatctgtaaaccaattagatagcgcattgtaaggtatctcggctggtgatatcatagacgacgagagccctggccgcgcctcggtaataacttctcgtcacggacctgtaatcacagctactcaggagggctgagacaggggacacattggcgaaa

SEQ ID NO: 536824 - DNA, 232 bp, Homo sapiens
ctgcatgcccacacatttgcctccaaacgtctgccaagggagggagggcgcggaacccacccatggcaatgactcagcacgaatccactcttctgcttgctgacccctgacctctgactcgaagtcagggccctcagctggccttcaaggaccccatcctctccaccctggcaggaagtggggttcctgagtatctggaaggaggaccccatggaaggatctggagttccta

SEQ ID NO: 536825 - DNA, 223 bp, Homo sapiens
acattggcagaagctaagctctgtgaaatagctaccgttataaatcttgaaaccctactaagtaccgtgggctaccatatgggagcctgataaattactggcaatcagaaacccatacctaacacatcagatgatagtaggttttgacctagggaagaagaggttgagcgaagaacccccaccaggtatgatttgagagtctatagttgagggttaattgggg

SEQ ID NO: 536826 - DNA, 166 bp, Homo sapiens
atggaggaggctttggagtcctgctctgtgtggtccaggtcctttcccccctgagacttggctccccccctgatatcctcctttggggaaaggcttggcccccagcaggctttcaaaaagtgccagttgatcaatgaataaataaacgagcctatttttctttgca

SEQ ID NO: 536827 - DNA, 315 bp, Homo sapiens
  misc_feature (9)..(9): n is a, c, g, or t
atactcggnctattgctctgttgtcgcgctgcgcccatgctgcggtactgccccacggtcatctgcatcgaacgctgcataggcctgctgcgtaccgtcgctgctggatgcatcggccgacgacggcggtcgcggcggcgtgatcgcgtggcttgcatcgcttcctgtcagttcctgcagactcaatgccccgctactttgtcggtctgtcgagcaggtccagcagctgcgtgctcgacgcgatgtcgccattgaccagtgtgctcaattcagcgctgctgacactgtcgtcaccatcgctgtccaggccggcca

SEQ ID NO: 536828 - DNA, 148 bp, Homo sapiens
ttacagattacctgcatatggctagccagtatacccaacatcatttattaaatagggaatcctttccccattgcaaaagctcgggatatgtcaaatcatgagactggacgaggacactgggcgtgagggagatccatctagagctcga

SEQ ID NO: 536829 - DNA, 355 bp, Homo sapiens
gatccatgcccttaccacttatcacgcaagagaagaatatccataaagtaatgtctggcttgctatgtcaaagcagtcaactgtacgaagatctacgtgttacactctaaaattatgattttaaaagtctattaaaaacaagaatgccagcattctatcatccattatcagaggctttaaaactgttgcaagaccatatagtatatattagcttttatactgctaatgcacaacttacagcaaacttgattagattaccagaactctgtcttaattaacgcctttatatatcacactagagacaaatgccacaagatctgcagaaacattcagttctgagcactcgaatggcagg

SEQ ID NO: 536830 - DNA, 300 bp, Homo sapiens
  misc_feature (16)..(16): n is a, c, g, or t
  misc_feature (60)..(60): n is a, c, g, or t
  misc_feature (81)..(81): n is a, c, g, or t
  misc_feature (115)..(115): n is a, c, g, or t
  misc_feature (148)..(148): n is a, c, g, or t
  misc_feature (244)..(244): n is a, c, g, or t
  misc_feature (249)..(249): n is a, c, g, or t
ttagctctgtgatgcnatgccctgttacagatcacattcaccgtaggtctctgagaaagnacctgctccttaagtcttccntgcaacaagtgccactgtttttaggaacctgggngtccacatagacatctcaccagcactgaaaccntcacaagtcctctcagccttgcctttggatgcccttctcttgggaatgtccccagtcctggtcagctgctcacaccttttgcaattttgtctgccnccccntcagcctaaaagtgtgcagaacccttcaattctgttaagtcacaaaaaaaa

SEQ ID NO: 536831 - DNA, 188 bp, Homo sapiens
atcattgttcatttgttgggtcttcaacttttccctccccaaatcctttttttaaaaaaaatgcaaaactcccctaagtgtcaagggtataaacatttaaaaaagtcagctaaaattttaattccccccctttaggaaaacatgtaattttaaccaggaaatgtcattaaaccattccttcattttca

SEQ ID NO: 536832 - DNA, 1014 bp, Homo sapiens
  misc_feature (468)..(468): n is a, c, g, or t
tggacggccctaaatggtttataaggtatgaatttcccaaactttacttatataagcggaaacggtggagctgggagagtatggcgccttctccaagctgcccggcgagagccaccaattagtgtggtgggaactggtgggccctttccagggccagggctctttcggcctgcagatgtcagcccacgcatctccctgtgctggtggcacgggttgggtgactccactggggtgtcagggatatcttctggatacgcttaatggcgaatgggttcaatggaggataacctcaaaaaattttggcatggtgggaatcttcaccaacccagtaaagaattcacgagactctcaaaagccccaaaggggctgtccagtctcgctcctcctggcaacgggatttggaagggcttcagagcaaatcttaagctggtgttaaccccatgatgggacaggcttcgccggtaatgngcgcacaccttagagaactgggcgcgtatccgggccaccagggggaacacgaatcctatatataacggtaacctggtctgggcctggtaagcccagtgggcgcgcttaaatcaggccgggtggggcgcgggaacgccctggtgggaagagcaaaagacgctgggggggaactggccagcacgggggaccctcaagaagaaacggcgcatggaaatccaagagcgggtatcttttcttccataaagtcccctggggatgcgtcactcttgttatggccccccattattgggtaaaccctagaatgcgctcgtttactaagccaagaagcgccacacagctgggcgacggggccggaggcatcacaaaaggtgcgcccacgctgaaagccataaagccctacaagcagggttggagcccgcggcttggggtccccaaagaacacgggaaaacccggttgggtggcccgtgctcatacacccaaaccggggctatggcgcaacctgaaagatgcgaagaaagacaaggcctgccaatcgcggaacgcca

SEQ ID NO: 536833 - DNA, 563 bp, Homo sapiens
gaaggcctcgggcacgtttcgggagtacaaggtggtgggcgctgcttgccaaccccaaaatgccacacaccaccactgtaccgtatgcgaatctttgcacccaaccatgtggtggccaagtcccgcttctggtactttgtgtcacagctgaagaagatgaagaagtcatccggggaaattgtgtactgcggacaggtgtttgagaagtcacccctgcgtgtgaagaactttggcatctgcgtgcgctatgactcccgcagtggcacacacaacatgtatcgggagtacagggacctgaccactgctggtgcagtcacacagtgctaccgagacatgggtgcccgacaccgtgcccgtgcccactccatccagatcatgaaggtggaagagattgcagctggcaagctccgccggccagctgtcaagcagttccacgactccaagatcaaattcccactgccccaccgtgtgttgcggcgccagcacaagccacgcttcaccaccaagaggcccaacaccttcttctagacacagagacccactgaataaaaacttgagactgt

SEQ ID NO: 536834 - DNA, 130 bp, Homo sapiens
gaccatgacccaagcatgattgttgctgcaggtcgacgtgtttcaccagtgcggtgcatgcctccctgttacaggttccgtcgagacgttagcaccgtgctgagctccaaatatcgttatgctggagcct

SEQ ID NO: 536835 - DNA, 615 bp, Homo sapiens
caccagtctcaagcgtgtgcaagcctgtcctttgactgtggttacagtgctacttgttgattgtgttacacattgcctctgacttactccttttcaggtctctaacatcttctatagactggcgtggaagtcagagatcttgcgtctaactcttctgaatcgagagattactctaaacttgttttttggcaatgcctaaattaaaagcgtccaatctttactatctacacgaaatcacactattgatgcctacgctgtattgcactgactagatctcagatcaatgcaacctgtggctacacctaccaaaccattctatatacctcaccctcactgattaactttaattacactttcctgtcaccatgccaagcttactaattccattcttatttactgatactgcatttaaccatgttgttcagactctactaaaactccttacctagagtgatccaaacctactaggcctatcaaagcgtctggcttacacgcattagccaatgcccaagctcaacatgtactatcttttagattccacacgtcaacctgacatctgaaccccactagactcatcattcaacctacttatgactacatgtaacctaataacat

SEQ ID NO: 536836 - DNA, 175 bp, Homo sapiens
gctccccgtgttacggcaccggcccacagctgttttccagcgggcgggtttcggcgaactcatcgcggctaagaatgcgctgcgcgccgaggtatataacgatattcatgggtgctttcgcgctcggaaaccgccgccaccttgtatcctgagatgatgcagcaaagcgaccgcg

SEQ ID NO: 536837 - DNA, 1003 bp, Homo sapiens
  misc_feature (469)..(469): n is a, c, g, or t
  misc_feature (473)..(473): n is a, c, g, or t
  misc_feature (895)..(895): n is a, c, g, or t
acagtggctgacattacaaggctcggatctccgggccctcagacatcatgagtttggtccttgcatgctccgcgtgaaatctaagtatcgtgcctacctgtctactgctctattatatattctactcattcataaccatgtgtgaggtcctaagtgttgcctacactatcgagacgaactgcgtggcatcgtatagtatcgagtagactctcgcgtagctctagttggtccagtcgtcaccgtggtgagcagttggtcagaatatgtctctagtccttgaccttctttactccaaaacgcggaacatggtagggaccacaagtgatacctacttacggtcatattgggtaaaacaaccactacgtattaacatgctacaccgttttgagacattagcgaaatactaatacaaggaaagtgcgaaaccaagtctgacttaataacggcaatccaaagacatctactttantaanttccgatgaattgaattcatctcatgaataccacaatgtgattattaaagaccgtcgatgctgaagctcttgaatgctctcgacggaagaaagtggtcttaggagaggaaaagagtataatgtaggaatactgcagaggacatcagtactttgttaatgcagcaatgaacatctaaagttagtttccgaattaattttagtagagataactatatagttatattgtcaacattaattcgaagaatgattagttgaacaccttgaagaagaggaaaggtaagtccgcattgcttatgcagaggcacaagaatgcacagagggaatcgattatgtgtatgagcacaacagagtagtgacgaatcgcattggatatcatcgtgtggaaatgaatttgtgcaaggaacaatagtgcgaataaaggngggagtctaaaatacacggagcaggtgctattgagatttatttaaaatgctcattgaaaggctaaagcagcagaattcatcggaaggatctagtggagaaaaatcgag

SEQ ID NO: 536838 - DNA, 309 bp, Homo sapiens
cccgactagcccgacagcgggcaaatcacgggtgtaaatctaagagtccaaaagctgaagaactgggagtcggaggttcgagggcaggaagcatggggcacaagagaaagatgaaggcgggcagactcggcagactcagcagactcagggaatcagctcttccatcttcttcggtctgctttattctagccacacgggcagctgatgggatggtgcccacccagatggagggtggatctgcctctcccagtggactgactcaaatgttaatctccttgggcagcaccctcacggtcgggctagtcgggg

SEQ ID NO: 536839 - DNA, 146 bp, Homo sapiens
tggtggtggtaaacaattttgataccttttgtagccaaataccagagtgggaagaatctgactataaaatggtccaactactgagaaacagcagtttctaccaatgcctacctactttgtagaaacgagaagtgaaaccatctcag

SEQ ID NO: 536840 - DNA, 257 bp, Homo sapiens
cagagtccaaacagggccctagactcatttttacattaaaaacaaaaaacaatcatttgtcataaaagttcaaagtaagctgggtgtggtggcacatgactttagtcccaactacttggggggctgaggcaggagggtcgcttgagcccaggaaagttcgagtccaagctgggcaacagaacaaaaccttgtcttttaaaaaagaaaaaaaatagagttcaaaatagataaaaaagttgttggcactgtttggtctg

SEQ ID NO: 536841 - DNA, 153 bp, Homo sapiens
atcataggctgagccacgtgcagcgggagagatctttactaaggtaactcttggagaggaatccataggcaagttctggcacttgaataataggaatcatacatgcatgtataaactcaaaatatattaagcacttctggtagtcgaagcacg

SEQ ID NO: 536842 - DNA, 152 bp, Homo sapiens
tgtcttgcgaaagtacgggtgcgagagaagcagtagtcaataaagagagtggagaagggagaggggctgagtgaatgagctgggaggaggggacctgtgggaggacaggcagagggagtgggagagcgcgagggctgtcgggctagtcgggg

SEQ ID NO: 536843 - DNA, 1132 bp, Homo sapiens
  misc_feature (814)..(814): n is a, c, g, or t
cttgtcgtgtgtggatgatgtgccccctgtttcgttcggtggtcccttctctctggtcactccgatttcttgtcccgtgttcccgggtgaaccgtattttcccgaccggtgttgctgccttgtgcttgttatcgctttcctggtggtcccgatttgctcctctgcctttaccttcggctgtttgaacgattgccatgtgaccattctcgtgtgacccctggccccttgccggtgtgaccgtgagcgggacccagtggcaagctcttctttgacatttaagcccaacctgttgtttgttccatccggggttcagatgagctggggtctaacaggagccgctgccttcacctggccacagcctccacgccagatctccacattgtcttgatccagaccagctctgtgatcagaaggacattggtccagtgtaggagagagctggtcctgggcctggcaggcaagactgtgggccatcctttccatggcctttctccactctccctcaagcctgtgctcaggttgccttgaatagtggactctggaagacgccaggggcccagaatgccgggggaggcttctgagtggcactcatggaacaccgtccctctgccagccataggccctgcctccagtgtcagggaaatggaggctgggctgcgagagtgttactgccccctgtgtcattcttctaatccaatgtagaaattgtacgtaatgtatttaaatcaacgcaaatgtatgaataacaaatacagttctgaccttttttgtccagatttcatttaggagggataaggagagatcaacacgatanggatacggaagcggaacatatgttagaggcgacgaatagaaatcctgtgcctttccagtggaacttgactgagacgtggctcctggggctatttctccctaagtaacaggatgatgccaggtcctcatatccaaagtcccaactgctctgaaaaccccaaagtattcttcataacccatttgaaaccgaacctgacctgaactcacaactgataggaagctatgggtaattatgatgtgtatccttttagtgtgacttctttgttgcagcaaatgtcaatatactgtttatgacatggttacctactagggattatac

SEQ ID NO: 536844 - DNA, 191 bp, Homo sapiens
gctatgctgcaggtgcggcgtgaaaagaaaaaaaatgtatatgcagggaccctgaatgacatgagttgaactgagcagatccacttatgtgtgaatagtttgtcttactggctaatgctgaagaagttcccaggtcaaggatggaactgtatcacagcagtgaccggagccacagcagtgaccggagccag

SEQ ID NO: 536845 - DNA, 426 bp, Homo sapiens
  misc_feature (335)..(335): n is a, c, g, or t
gtttttccccccccccccggccatttttggaggaaacttgggggtgtaactttaaatggggggcgggggggggccacaaaaaggtgggtccctttttttgtaaatttgccccacaaacaccttttttcaagtcccccccggggggatgttcctcaagttggagcagggggagaattttttttctgagggccccccaccaaaaaattcaactttggggcatggggggggccacaagctattttttcggggttccggttttttccaaaaatgggggcctgccctggggggtgttttaattccaccccgggttcccccggccagaaaggttttttttntccccccacccccccccttgcccagccaatgcacccagtggggtttggtgaatgttgttgggtgaatgggtaaataaatttttcagggcca

SEQ ID NO: 536846 - DNA, 828 bp, Homo sapiens
atggcctcggagaagccgctggcggcagtcacttgtacagcgccggtcaacatcgcggtcatcaagtactggggcaagcgcgatgaagagctggttctgcccatcaactcctccctgagctgtcactctgcaccaggaccagttaaaaaccacctataacagaccgtcatcagctaaggacttcaccgatggaccggtatttggctgaatggccgggaggcaggatgtggggcgagccgaggctgctaggccgtgcctgcggcgagatccgctgcctggcccgagaagcggagtgaatctcgagcggtgatggggacccgcgtgccctccatgcctcagctgcgaaggtgcacgcggtcatcgtgtgaacaacgttccccatcgggctgtcggtgccttggcctcgctcagcgtgcggggctatgccttgccgtagttgcagtctggcgttggggctctcgctctgtactcccagtaccttaacgacggctgatggtgggagaatgcagctgctatggccaggcagtgcatagcagcagcctgggcaacatagctgagaccccgcccccgcatctctacaaaaacataagaagaactcttcccgtctgctgtatgtggagcccctctagatggtccagtgatacgagaaccacgttcaaagctgggctcagcccctaaaagtagcgatagatgtggtggctcactgtaactgagggattccaattgggcgacagctgcgttgcaggccccgttggacccagctctctgctggcccaggccaatttgctgcgcagcttcccaccctattgtcaagagcctgtccccccg

SEQ ID NO: 536847 - DNA, 318 bp, Homo sapiens
gtcgggaccccgggaactggtttggatgccttccaaaggggggccacgccttcttgggatgctctttgggaagcttttaatccccagcccttatccaaagtttgccgcccaggagggactcctcccctggcctttaccaaggaaaaaattggtattgtcggactcacctccgacgtactccggggtcttttgggagttttttcccctaaccatttcaacctttttttggattctcactcttgcatgcctcccccgtcctttttcccttgccagttccctggtgacagttaccagctttcctgaatggattcccggccc

SEQ ID NO: 536848 - DNA, 165 bp, Homo sapiens
  misc_feature (46)..(46): n is a, c, g, or t
ggtgatctaagatcgatgatcgtgctcagaatttatatgtatgtgnatttcttttctctctcatgcataaatacagtcttttgtggggagatgaaaaagatgaggtcatagagatctggtagtgagttctaatctttcatgggatgcggagcccgtggatttcaa

SEQ ID NO: 536849 - DNA, 147 bp, Homo sapiens
ttgaaatgagtgggcacaataattttctattaccttgctgcaagattccagtgcagttgccatacagcctattgaggtatggtcaacctatagtacgtagtaattataaggggaggaagaaatggaaaatttctgtgcccatttcaa

SEQ ID NO: 536850 - DNA, 223 bp, Homo sapiens
tttctctcatgctgccggcatgcctgagtgcctgctgcccaggaggcccgcacaccggtacactcgtggacactaacacactcccataatgagatcctaggctttccagggtagggcaagggcaaggagccaggcttggagcgggggaccagtgggggctagtaagggtaagcccctgagcctgggacctacatgtggtatatgcgtaataaaaccatttgta

SEQ ID NO: 536851 - DNA, 133 bp, Homo sapiens
tggaggtgatctagaggatccctgaagatggcggttgggaaaagggtggaggctgatctataaagtccttttcatggtaagattatatgattttcggtaaacggtatattttttaaaaacagtccagaatatc

SEQ ID NO: 536852 - DNA, 105 bp, Homo sapiens
cgcccacggcgggtcagtcagctcctggatcttgatgcttagggaaagattttatatcattaaaaagaaatgggaggtcacttccaagatggctaaatgggaaca

SEQ ID NO: 536853 - DNA, 800 bp, Homo sapiens
  misc_feature (1)..(1): n is a, c, g, or t
ntcccggcatcgataagcttgattaaccagccctgtccgtctctctagctgtccgtggctatccacgatctactatactccactgggctagccggacccctggctagcctatggatatggtactagataggagggcgaggaaccctatcccaccctactgtcagcgccagggggactacagcaccccatacctcagccaggtgcagcaggccttgtgctggatagaccaggaacccagatacacggaacagcacggtatgtaaggcgtatagcaggtcaacgacgcaagcagtgttgtcatacctactaccagaaaaggcacctatggaggatagtaggagagaactgacaggggctaggtttaatacgacattaccttagcagccccggggggaatcccacttacgtatctagacagcggcctgccacccgcagttgcgagcttcccagggttaatgggaaccccttaaaggtagaggggtaacattttgcggcgccaaaggggacaaatcccatggtccaaaattggtaacctgagtacacacacgggccccccacccctcattccccctccccctcgccccaccccacccttatgaaggggagcccgaacgcggactcgactggcgaccccgggacagcccgtgccggacgactgcacggaccctccagccgcagagtgacggcgtaacagatgaggcgccctgtgccgaccgaccgacccgacccaactcttcagccctccggcccgaccattgggttcggcggcccgcgcactgccggcctgctcgttcgttcgc

SEQ ID NO: 536854 - DNA, 442 bp, Homo sapiens
gatagtgagtgaatttgacaatgtatgttaatgtgggcaggccagtagtgattctagggcctttctctgaacccacacagcaagtgcattttaatagtagaaaatgcatttattacataaatcaaaggagtggactgaatcaaatggtgtgatttctggccaggtgggtggaaatgttggcaccatagtaggccagtgtgggagacagctgtggagcctccttcagatcccactatgcaagaaccatctgtagatctgatcaagccctgggtgcaatgcccttgaaatacatgaattatgattaagacatttcacaatagaataagcacatgtgttttcttacttaacaatgtgaactttggtcagagtacaaatgaaaaaaaaaaggtaggaaataatatatatttttctgtaggtagactttcttaaatatcacaccata

SEQ ID NO: 536855 - DNA, 241 bp, Homo sapiens
tattgcgccattgcactccagcctgggcaatgagcaaaactccgtctcaaaaaaaaattttttttttgaaaaatatgactttacattgaagagacgtgataaacagtacctcagcccattagtgataagccatattgatatagcatgtacctttgatatgacgtgatgagatggcccttttacctctgtagttttcttccaaagctcataacttcaatttaattgagggatgttttcaaaa

SEQ ID NO: 536856 - DNA, 352 bp, Homo sapiens
atacaatcgagctcggtaccgcagctcgctgtcgctgggattacaggcgccgccacgcgcccggctaattttgtatttttagtagagacggggtttcaccctgttggccagggtggtctcaacctcctgacctcaggtgatccacccgcctcagcgctcccaaagtgttgggattacaggcgtgagccagtgtgcctggccaaccatgaatttcagaggccatgatggaaaggtttaggagggtgtctggtagtgactggtgaagagggcatctgatggaatggtctcaatgatgtctaggggaaagtgtctttcttgggactggtctcttgggtggcttgtagtggggaga

SEQ ID NO: 536857 - DNA, 168 bp, Homo sapiens
  misc_feature (19)..(19): n is a, c, g, or t
tcctgcctcagctacgcgngaggctgaagcaggagaattgctggaacccaggacgcagaggctgtagtgagccgagatcatgccattgtactagcctgggcaatgagaacgaaactccgtctcaaaaataaataaataaatttttaaataagctatgggattagaata

SEQ ID NO: 536858 - DNA, 1004 bp, Homo sapiens
cttccactccataacgctcctctataataggcctagcctaaccagaacagcactaaccatataccaatgatggcgcgatgtaagccacgagaaagctacataccaaggccaccaaacacgcacgctgtccaaaaaggccgttcgatatgggagtaatccctatttattacgctcagaaggtctttttcattcagctagggatttattctgagcctctttacgcactccaggccatagcccctctagcccactcaaggtagagagggcaagaggtccgcaatcgaggcgatcaacgccggcgtaagagtcccgcgtagaaggttccagatccgtataatcacatccgatatgactcggcttcaggaggtatccagtcacctgatggctccaccataggtctagatacgaagaatagaccgaaaccaaggtaattcgagtcaactggcgttagttagcacaggaggttatcgtggggatcttctaatatgttaaccacatacgcgtatcgagagcacgtcaaggagggtaccattacgcaagtagtcgccatattaagccgattgtttccggtaccgaggcatagtgctaacgggacatcaaaacagtatggtcccaggtaaggccagcagcgccatttaccaacgggaacagttttcaacagagtccagttgcaataggggccctcaacacttttatcccgttctacgtaaatcatggcgagtatcaattcgccggggcgcaaaacgctcaaagatgtaattatgtaccagcatgtgtaacccaattccccaagaaaaacaaagttcaccgtgttatggggcgtttccggaacagcccccctgcacccggctccttgggacaattgacctgcgctcacattgtgctggggtaaagaatagcatggggctagatggaactgcgtcactacccacgctggtccattgcgttcttccccgagttcataatgccggcaggcagaacggggggtccttctaaaaaccaaa

SEQ ID NO: 536859 - DNA, 1556 bp, Homo sapiens
agcggctctttctccccatgccctcgaggccatgttggcagaagggaaagtgaagctgcgctggttctactgccctttcacttcgattaagcaggcccgtacttacacaatgggcattttgcgcgccttcagctgcctaaacgactgatgccgcacaacttcatcttgcttccttttcactggagcactcgctgagcgagcagactacagaacttgacgtagcttctctctctactcgctctttgtatccctagtcgaccttaacggactcctgcgccttacgagttggccccgcaactgccatttccttccagggtaccgccaacgcaggacactttcatcccaaccacgcacttcacccaaccttgccaacccaaaccactttaccctggctgccacttgactgggctctggctgttcccactaaccaactcctggctctgccacaccggaccaccctggcgccgcaacttacttaccttctcacttcttgggcccgtcagccactggacctagctccatacactttaagcctcacacgttttacgcatcaactccccctctcaccaagcccccccgcacactagccggccctactctccggaatccgacatgccataactttacccggggtgttgccacgccgggcgctagcccccgtaagcgtcacgcaataaatccatcctcacctttctataaagtcctgaggccacacaccggtatctccgcttgtaaaccgctcgtcctggcatttaacccaaaacaaaccttgcaaaccttacacacaaccccaacgcccaacttatgggcgtagaccttcctccgtttggagcccattccgttggggagcccaagctaaacctttgccggccaacggcccttataaagcgtttcacctatcgttcgctcaacttgatcgcgccctcaagcacccccggcggtttactggggccaaagcctgctccgaatgcatcgctgcacatttggcccccccagctgtcaaccacgagacgcacccccaacactcgctcacagcccctaacaaccgacaacacgcttggtgaccccgccagacaccacttttgctctcatccgccccggtttgcgatttcccgactttcactctcacgctgggcgcgcgagctaacccccgcttatcccctttctcttcaccttcgccacccgccaaccttttcacgctcttcggcgcagccccttcgggcttatacgccccgcccgcttcacgtcttggacatccccgccgccgtccttctccccgccccttctgttcgtcctcctgttccctttcccctttttcggtctggcggccgtccggccatcgcgcccactgcccccccccacccccgtgggctctcctagccggcgctctctcccggccccttcgcgggctccttcccctcgtcgcgcgcgcctctttctcctccctctcgcccccttcgcccgcctctggtcgcccccccgccccccgcgcccgccctcctcctcactccgcgcgccttctccccccggcgtccctctccgcgctctccctcctg

SEQ ID NO: 536860 - DNA, 124 bp, Homo sapiens
aaacccggtgggggaacggggattttttttgcccccaaactgctttttaaacaaaaaaccatgggggtcttggggtttcctgcccccctttttttattaaaagaaaaatttaattttgccagga

SEQ ID NO: 536861 - DNA, 157 bp, Homo sapiens
ctgtgagagaatacacttttgtttcctttttctctgtttttgagacaagttgcctctgtctcacccaggctgcagtgcatggtgcgatctcggcatcactgcaacctctgcactcccaggttcaaagtgattctcctgtctcagcctcccgagtagc

SEQ ID NO: 536862 - DNA, 364 bp, Homo sapiens
gagcagatcgaaaatgaatgtgagaaggataatggagatactatgaaattaagagtaaaaatgtgcatgtcgtacaatcaaacatacattggatagttcattctgtggaggtgcagaaaaaaatagcccaaaatgaaggtctcagaagcaaacgcttttctctgaccttctcctgccctcctgtctctcagtcccactctctgctgaggctgaccatagaaactggaatccctctttcccaaggcagatcatagaaaccagaactccctttcctcagagctagtcataaaacataaatacattactataactttccctccacctttctgtgtaactactggccataaagaaattatctgactac

SEQ ID NO: 536863 - DNA, 2152 bp, Homo sapiens
cttaaataacacatgaatgagtcaaccacacccttgtggagttcagtgtgaaacaaatgccatccgattgcttgtccatcctctgtacacacccatgagattcatggtgccagcctagtaatatgtccctttcatgggaaagtagaatattcattgtcttagagttcaactgaagacgacaatctactgtagctggttgaagccgcaagggatttattatgcatcattagttggcttccaaaatttttggtagggttggaggagcaggctctaggctgagcttccaggagcacctactggaatcataccatggaactggcctgccatcagaaggaagacgaggaagcaggatctactctcatgtctgctgggtcctggatgtccattgtccccattgcgagtcatgatatcacatggctgccccctgacttgcctctcaacaccacgaagcgaggaatgggacgctgggatttcagttttctgtggactgccacagaagaggaagtaccttcttggctatgtctgccagcaggaacaaagaggcatccaaagcatgtcctttgggccatggcattgtctttttccttctaagtctaggatgggtgtgtctgctgaagctacatcattgtgtggaacctgagctgtggtccagctttccagcctctagtgagcagtaaggcacactgcaaggggaatgtggcagaggtgagtggatccacatggagtatttactacatccacttcattggattctacctggatcactgtgttggaggtggaaggccatctgtgatttgtggtgcttctaaaacattctaaggacgtgccctatctagttaagacacacatttgatttctagctatgcaacctttacaactgacctgatacttcctgaacttccatctgtaataatgagaaagataatgacgatgtcacatgttagtagaagataaagtgagcaaaaatacaccgaagctctgtctcagaggaaaatattagcttatttcttgggttactgtaggcttatttcttcccttttttaatcagccggtctaaatattgtacattaattccccctggactgggctgtatttggaatgagtggtcatatcagcttctagtgagttttcacacactcagcaatgagcgggaacatagaatttagcctctctggtacatactagggttaggattaggatcatacttgtaactaaagaaagcttaaaagctatattaaaaaccacagagcagggcagttccaaaatagccgaataggaacagctccaatctacagctcccagtgtgaacgatgcagaagacagatgatttctgcatttccaactgagattggaagacagtagcggttctctcagcacgcagcttgagatctgagaacggacagactgcctcttcaagtgggtccctgacccctgagtagcctaactgggaggcaccccccagtaggggcagactgacacctcacacggctgggtacccctctgagacaaaacttcaagaggaacaatcaggcagcaacgtttgctgttcaccaatattcgctgttctgcagcctccgctgctgatacccaggcaaacggtctggagtggacctccggcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaaacgagcagaaaaactgaaaattctaaaaatcagagcgcctctcctcctccaaaggaacgcagctcctcaccagcaacagaacaaagctgggccgagaatggctttgacgagttgagagaagaaggcttcagacaatcaaacttctccgagctaaaggaggaagttcgaacccatggtaaggaagttaaaaaccttgaaaaaagattagacgaatggctaactagaataaccaatgcagagaagtccttaaaggacctcatggagctgaaaaccacggcacgagaactacgtgacgaatgcacaagcctcagtagccaattcgatcaaccggaagaaagggtatcagtgatggaagatcaaatgaatgaaataaagcgagaagagaagttt

SEQ ID NO: 536864 - DNA, 121 bp, Homo sapiens
aagcagttaatacagactcagctctaaggagcaacttaactctatggaaaaccaagcagctgtagctagagttgctcagttcagtccttattttaggaaatgggagtacaactattaaacc

SEQ ID NO: 536865 - DNA, 296 bp, Homo sapiens
gctggagtgcagtggtgtgatttcagcctcctgagtagctgggactacaggcacatgccaccaagcctggctaattttttttgtatttttagtagagacggggtttcgccatgttggccaggctggtcttgaactcctgacctcaagtgatccacccgcctcagcctcccaaagtgctgggattacagcatgagccaccatgcctggccagatttacgcagaatttcttttcctttttttttttgagatggaatttctttcttgctcgcctaggctagagtgcaatggcgtggctc

SEQ ID NO: 536866 - DNA, 391 bp, Homo sapiens
  misc_feature (16)..(16): n is a, c, g, or t
aagagccacacccttnttacctatgtctacgctacttcatgctataaggcagagttgagaattgcaacagagtccatgtgctcacaaagccaaaattatttactatctgattctttacaggaagcttgctgacatctgctgtagatcttcatgattttcctaaagaggcatgcttgcttcattctgcactttggaatttaagtcacattacgcagcctacttttagcagtgagagttcacaagggcagaaaggggaatcggggtgttaattagtatatttgtgaatactgcatgctatgtgttctaatgctttgtttcatcttctcagagtcctaggacaaaggttttattatctccatttgaaagacggaagcaggccaggtggtgcagc

SEQ ID NO: 536867 - DNA, 835 bp, Homo sapiens
gcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaaaacccaacaactttgagcggaaacttctcagaagaatgctccaaaactcagcaaggtgcttctgggtggctgggtgatcaagtggcttctggcaaacccaatgaaggcgggacgcaagaatggactctggtgagccccaaggaaatccccgaatgtggagggctccaaaacatccaagttgaaaggggtacgagtggcctacaacgagtgctctacagggtcaggatgggggggctttggcaatgcctgggaaaactccacctggtgacacagatggggatgtatgacatctggtaaatccttctggtacagacgctgctaaatttggaacctcagggaaaagcatatcgtcaaaagagagcttaaaaggcatcgccaagggggtcacctccagggtcttcctcgccattcggaggtgctccaatttccaaaggatgatggctgaggtgcaggaagagtgcataccagcaagcttgaatgtgtgaagacatcgccaagacggaaacctgtgaaagccaatcactgagggtcgtcaagatgcccaatacaatatatccaaaagaatactaataacaagacttgtccgaagcctggtgcaaggt

SEQ ID NO: 536868 - DNA, 134 bp, Homo sapiens
cgctgcgctgtcacggtgctgacctacgtcatcgggcgtggcgccgcgccacgtcgacctgcgcccctatgtgctgtgcggcaaggacatccgcaccgtgccgggcggcctgtgccgcgtggcgctgaccgagg

SEQ ID NO: 536869 - DNA, 181 bp, Homo sapiens
aagagatgaggcagatgtttgccaacaaagtgaaggagacagagctgctgctgacgcataaggaaagggagctccatgacgcgtttgagcacctgacgcgggctcaccaggaggagaagcgcacggtggaggaaaagcgccgccaactggaggaggagaccaacgccttcaatcgactgaa

SEQ ID NO: 536870 - DNA, 87 bp, Homo sapiens
agaatggcctgattgaggatgaagctctgcagcgggccctggaaatgtccctggcagaaaccaaaccccaggttccaaggtacctta

SEQ ID NO: 536871 - DNA, 176 bp, Homo sapiens
cacagagctctagtgccacagcatccggatccaggtagtttgcactttgacccaaactggcggccttggctcggccattgtacagcttgccatcatcagcatggtaggctacagagtcaggcaaccagccaggctggtgatccaagctgtagtactgagggaccagccccacagca

SEQ ID NO: 536872 - DNA, 339 bp, Homo sapiens
cgtcgacgctcaaacgcatgaacttttaacaaggcacacctgttaattgaaatgcattccaggtgactgcctcatgaagctggttgatagaatgccaagagtgtgcaaagctgtcatcaaggcaaagggtggctactttgaaaatcgaaaatatattttgatttgtttaacattttttttggttactacatgattccatatgtgttattgcatagttttgatgtattcactattattctacaagacaaaccctggaatgcaagatcgaatccccgagctgataaggtacaaaatatgtcgttcggcccctgaacaagggtcgacgcggccgcgaattta

SEQ ID NO: 536873 - DNA, 2391 bp, Homo sapiens
  misc_feature (178)..(178): n is a, c, g, or t
  misc_feature (238)..(238): n is a, c, g, or t
aggcgtgctggtggtggcgaccagcaggatgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccattnggagtttctttaggaaagaaaagttttctgcttttttatagaaaatcatttcagtctccngaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacaccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgcgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccata

SEQ ID NO: 536874 - DNA, 232 bp, Homo sapiens
cgtgatgattagaccaaagaatgttatcagacatctggacatatgaaaatctctcaaagaatctttcctggactgacgtttcaggtatttacatgaacttcctccgtatcctttattaaatacactatctaccttataatttaattagctataaaaacctaactgaaattttaagcttgacacagaaaagtcaaaaaggtgtttcctaacatgatgtgtctaaatgcaatca

SEQ ID NO: 536875 - DNA, 1629 bp, Homo sapiens
  misc_feature (178)..(178): n is a, c, g, or t
  misc_feature (238)..(238): n is a, c, g, or t
aggcgtgctggtggtggcgaccagcaggatgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccattnggagtttctttaggaaagaaaagttttctgcttttttatagaaaatcatttcagtctccngaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacaccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcccatgcacggtggtccatgatctgtcgtccatgcttggtggtccgtgctcggtggtccatgggactgatcctgcacaccatgttgttttcctataacttacgtactttgagtgatgtggtatcatttcgctgag

SEQ ID NO: 536876 - DNA, 2536 bp, Homo sapiens
  misc_feature (178)..(178): n is a, c, g, or t
  misc_feature (238)..(238): n is a, c, g, or t
aggcgtgctggtggtggcgaccagcaggatgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccattnggagtttctttaggaaagaaaagttttctgcttttttatagaaaatcatttcagtctccngaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacaccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgcgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcgaaa

SEQ ID NO: 536877 - DNA, 252 bp, Homo sapiens
  misc_feature (150)..(150): n is a, c, g, or t
cctggtgagtcgacctagaggaccccaagctggaagcctgaagataaatcagctcttcctctgggaggtgagtttattccttccttggaaaccaaggggtattatcgtgtctaggatatagttagggaggaagtggtatggagtacctangagaagcccttcactactgggtgaacttctttacttctttttcttttcttttttcttttctttcttctttgtgtttttatttttctctgggagacaaggttt

SEQ ID NO: 536878 - DNA, 1178 bp, Homo sapiens
  misc_feature (285)..(285): n is a, c, g, or t
  misc_feature (302)..(302): n is a, c, g, or t
  misc_feature (435)..(435): n is a, c, g, or t
agcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcanttcgaacaagccttaanagaatatttcgttgaagatacagaatgccggaccctatgtgaggggcctcagagatttgaagaatatgagtatttagggtataaggctggtctgtatgaagctattgcagatcactacatgcaggtgcttgtntgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggtttcatcactgaaccgaattattggatcagatttgcgggagggacgggatgggaacccgggtccccttcatgacgtgcaccgcgtggattggcgcccgaaggtccgtggacttcccactgggaacgacatggtcattgcccagcaagctcgaacctatagaagagtggccccctaggtatcagaaacacttagatggtcattaggcctgcgactagttaagtcgggtacttcgcgcggacatactgcgacaaacgcacagagcgaataagaacgtcgggactccggcgagtgcagggacataatcggattgcatgaggagtataagaatagataccagacagacgaaatggtagtatcaacatcaagcaacaagacgtaacacgagtcgtatgcagctgtcacaagcgaacgtaatctt

SEQ ID NO: 536879 - DNA, 116 bp, Homo sapiens
acgagagcgagaaggactgcgggcaggatcggcgggctcctggggttcagcgcgtgccaggcatcgttagctgatgaccagatgtggttaaggacaggtgtatagccttggagccc

SEQ ID NO: 536880 - DNA, 137 bp, Homo sapiens
agccggccccaagtatgcactagaagtctggagcgtggaaaatcaagcaatcaggaacaacaggcagcacactcaggttcaatctcagctctttcctcacttctgatcccttttttgctctttgcttgttccgctga

SEQ ID NO: 536881 - DNA, 172 bp, Homo sapiens
agggaggtgacagagaaggagagtgagagggaaagaagaaagagacgagagggagacagggacggagagagagcagggcgaagagaaaacaacgaaaaatgaaggaacgcgctgaaaaaccaaagagaagaccccaaaacagccaaacagaaaaaaaaaacacaacaccaca

SEQ ID NO: 536882 - DNA, 105 bp, Homo sapiens
gtgtacctcttcctacgccagtaacttcgggtgcgtcagtatcgcgagagatcgcgactgccctggtcacgcggtatcaccgatatgcaggtcgacaaggtacct

SEQ ID NO: 536883 - DNA, 443 bp, Homo sapiens
agatcttgcctgataatcataaaggaatgcgaataggagactggtaaaatgatataggactagtgcaaatgcaaagcgaaggtaaaagtcatcacgaaccgcacagactaggacaaaactcctacatctggctagcaataggttggatatccgtcagaccaggagccagagaattggctacaaagagctactggagtagcccctccctacaaataaagtatactaaagcgtagcactgatacaacatagaagtacgcataaacttggggctaccaagtctacaatagaggggagtggatagtacagacagaggagcctacctggacctggtacaatctatcacgcggaaacttatagaatagggtaatcctactaccagtgatagtccatgtagctgacgcaagcagagcccgccccgtagcaagcctccaagcaggtagtac

SEQ ID NO: 536884 - DNA, 900 bp, Homo sapiens
taaaaattggatgtgagacgtctatctctcaccagaggtaacgagaagtaggtcgaaaattactacagaaaaaaggaacaaagtgctatacattcataatatatcccctttatattataatgagttaattccacttattatctaaagtggcactaaattggcatgatggtagcagtgtccaatagtgaagttaattactgtcagattactgcatcacagagaaaggaagggatcccatcaagagagagggggttgtctccttctgggttgtgctaaaaaaaatagggaggaaagctggagcgtggagtcaaaggaattgagtaagtgtgctggttctgacaataggttgtaaggcacccttgggaaaggatatacaagaggttcctgagttataaaatgggagagtgtaaaactagccttgtaagtagagaagtcaaatgagaaggtatgtgaggactctgtcactaaatatgaagagtaataatcggagtttagaggctagtttgagaagacaacagaatgaacaagagacagtaagagcataatccgggtgagacaagataagagcagatacaggacggcacggcaatgggcctgcaatcacagatagagacgagacctaaaagaatcacactaaagccaggaccaacagaaggaggaagtcatgaggcccaccagcaaacggagaccccgttagaataacaccgcagggggctccacgatcgagggcagcaacacacaggacccgaaaacggcgagacagcccctaggttagaacacacacagaacgctgcgggacaacccatgcatgaggagacgcaagaaatcgggcgacacgggacgagaaaacgcactccaagggatgagcaccaacaccggccgccggaaacaagtcggcga

SEQ ID NO: 536885 - DNA, 1331 bp, Homo sapiens
ggcctatggagaggctctgggtcttgcttcgttaggcggcccagaggattcgccatggtcgacgtgccctgagcactcggggatgcaccgtcaccgaccaaccggatccgtcctgctgggcctgggagaaggttcgtggtctttggacgaagaagcacgcatggcctggctgccctataaccatctgagagtaataggatacggttacaggttatccgcgtgctcttgcgatcgagaaggacgctcgtcctgggcgaaggcctatgaccccacaaccaggataaggcccaaggccgtcgtattgcctatcagtagtgtgcaagctctacccgtagatagtggaccgaatacctgaatcactcacgagctccatgtttcttggcgtctttacgctagtatccaacagtcaagagattggactggcgtagcaatggacacttgctatcgtcgactgcgtcgctagtcgacgatagacgtcgattgtctttggagcaatggatcctttcgtcttcccctctctcaacgcccccatgggagccttgagtgccatagcgctacgacctacagagattggtgggagttggtttgttgtgttctttgcttcacgcttatccgtatttagctaatgtgcgccttgttcgttcctaatcctacccaaccaagcgggctcgtgggggtccttggcgagatgtgacacctgagcacgagaggaccgatgagagtggatcgaaagcttcataagcgcgccaggtgggccgtagcccatgtgaacgcttgtgccctcgctaagccctaacgtcgtcggcttctagcgcatataagaggcaaccgtaaccacaaatgattccaccatgggcgcacagaagacaggaacgcgaatttcccgaggtatggtaggggcgacagaatggctttacagttgtctcgacgcgattggccccatagcataagtaatcccctagattggcccttctgttgcctttttagatcttcgaagagcttatagggaactagtacttgcggatcctctcccaaggtaccgcttcgtttccccgttgttccctcgtttccttggctccccccggttccaaccaatgggcatacgttattggtcaatttgtttcacacttgggttagtggcgacaacagcccccaaacttcacaggcgttccccgggttgaacaccattgggatgaacgaaagccagcaaggggccgggagactttccaacccctgtgagagaccatggtgaaagcctctccttgcaaaagaggcccccctggggaatgcgaagtggttgggagaccctccgaacgagactgttagattgc

SEQ ID NO: 536886 - DNA, 148 bp, Homo sapiens
aggtatgtgatctagaggatccctaactgggttcgagttcttgaagtgttctggatcagtgatctgcctgtgaacttagtttcacgctgaagacagtcttctcagttctcatgactgtgaagtgtgaaaatggaacgcatccttgatc

SEQ ID NO: 536887 - DNA, 213 bp, Homo sapiens
cttctgagtggtggggcggatgagctccagccaccccggagagcactttctttgtaacatcttcctatggtgacatcgtaaacttacacagattttatgagcgtggtacatacattaacttattacctcattttgttatttttcgaaacaaagccctgtggaagacaatggaaaactcgaagaagcattaatgtcattctgttaagctgcgta

SEQ ID NO: 536888 - DNA, 487 bp, Homo sapiens
  misc_feature (367)..(367): n is a, c, g, or t
ctttatgcgatactttgacttggaaagttacaacactaacacaagtcttaacacatttaacattcgcatgaacagactcagagcgaaagtcaaataaaattaaacatgtgctactttttttcctcacaagaacataaaaattatggaggggtacttagctgggaatttaaaaaaagtaacacaatttttccttttagtagtccttgggtagttatgatagaatagtttccactttttgtttctttgaactgggattttggtccaaagttttgtttgtttctagtatctgcttctgcctccccctctatcagatcggcttcctccacggccaccacctcttggtgctccgcggcttgaactgctgtangaatcacgtggaggagggtaccccctttccatagaagggggaagccctctttcttgtctgccaacccgatcacgaccacttgagtagagatcacttcggctgcttgagtaactgtctcga

SEQ ID NO: 536889 - DNA, 432 bp, Homo sapiens
ggatccggttgcagtgagccgagatctcgaggtcgagccatggccctccagcctgggtgacaagagcgaaactctgtctcaaaaaaaaaaaaaaaaaaaaattatgtttctttctattctttgatacagtactttagtgttactttaaaaaaaatcttggctgggcatggtggctcatgcctgtaatcccagcactttgggaggttaaggtgggaggatcgcttaagtccaggagttggagaccagccttggcaacatagtgagactctatctctacagaaaaactttaaaaaattaaccgagtgtggtggtgtgtgactgtagtccagccactccaggtccagctacttgggaggctgaggtgggaggatggctttagctgggaggtcgagctgcagtgagtcatgatggcatcactgcactcagcttggg

SEQ ID NO: 536890 - DNA, 174 bp, Homo sapiens
accgttatttcgtcatagctgttcctagaggtatccccccacgctcatgcgcagagtctggttccgtctcaaacttggttcggaagtcatctggaggcagacgggcgttgtctgatctgcggagggacaatccttggagttctcatatggtggcaccatagaatcttagtcccg

SEQ ID NO: 536891 - DNA, 302 bp, Homo sapiens
ctggccgcgtttacactggccgcgttttcactgccgctgttacactggccgcgtttacactgccgtcgttacactgccgcgtttaactgccgtcgttacactgccgtcgttacactgccgtcgttacactgccgctgtttaactggccgcgttacactgtccgcgttacactgccgtcgttttcacttgccgtcgtttacactgccgtcgtttacacttggccttgttttacacttgctttctgtttttcattgtcccgtttgttttaacactttccctttgttttaacaccttgtcctgct

SEQ ID NO: 536892 - DNA, 530 bp, Homo sapiens
  misc_feature (23)..(23): n is a, c, g, or t
  misc_feature (46)..(46): n is a, c, g, or t
  misc_feature (54)..(55): n is a, c, g, or t
  misc_feature (59)..(59): n is a, c, g, or t
  misc_feature (72)..(72): n is a, c, g, or t
  misc_feature (87)..(87): n is a, c, g, or t
  misc_feature (312)..(312): n is a, c, g, or t
cggcaagctgttcccgataccgntccgcatttaaaggtgccgatancgcgagcnntacncgaagcctgccgncgtattcaggcgaanggttatacccttggcaacgtcgatgtcactatcatcgctcagcaccgaagatgttgccgcacattccacaaatgcgcgtgtttattgccgaagatctcggctgccatatggatgatgttaacgtgaaagccactactacggaaaaactgggatttaccggacgtggggaagggattgcctgtgaagcggtggcgctactcattaaggcaacaaaatgattgagtntgataatctcacttacctccacggtaaaccgcaaggcaccgggctgctgaaagccaatccggaagactttgtggtggtggaagatttgggctttgagcctgatggtgaaggtgagcatattctggttagaatcctcaaaaacggctgcaatacccgttttgtggcggatgcactggcgaaattcctgaaaattcatgcccgtgaagctcttcgctggg

SEQ ID NO: 536893 - DNA, 274 bp, Homo sapiens
aaccgtccatccaccaaaaccacaagaagaacaggaagccaaaaaccagtgagagtcacaagagatggttctaacgctgctgccttacactctctcagtaatctggcgccgtgctttagattcgtttactagttgtgtgggcttgggaaaattatttcacctctcagtgccttagtttcctcatcttcaaaatggggataatagtatctacctgacaggttgctgtgatcattaaatgagttaacttattattattggtgggtcagaacataag

SEQ ID NO: 536894 - DNA, 124 bp, Homo sapiens
caagaagagtagcactctatacgggatattgatttcacggagcgataggtgttcaacgggacccctatctgagtgggggtcataccatagggagacgagacagggatttgacctgtacatgtgc

SEQ ID NO: 536895 - DNA, 124 bp, Homo sapiens
ccctggaggcaatatattgaggatggggatattgctagtgatgaggatggatagtaatagggcaacgagcctcctagtttgttagggacggatcggagaattgtgtagtgcgaataggaaatat

SEQ ID NO: 536896 - DNA, 175 bp, Homo sapiens
cggcaagatccattcaataaggcttctccatggcacattacagtcagactgtcaaaagtcaaagacaaagagagaattctaaaatcagcaagagaaaagcacctagttacttataaggaaaccctcatcacactaacagcagatcagatttttcagcaaaaacgtcacaggccag

SEQ ID NO: 536897 - DNA, 155 bp, Homo sapiens
ggggaattgaagtagatagaaacgactggattactccgagtctgaactcagatcacgtaggacgtttaagtcgttgaacaagacgaaccctttagatagcggctgcaccgattggggatgtccatgatccaacagtcgagtgtcgtaaagcccta

SEQ ID NO: 536898 - DNA, 476 bp, Homo sapiens
tggcacttggagactggtgagactatgtgtacccactcaggccagtgtggcccagaagaactggtacatcagcaatgaaccccaagggacaatgaggcatgtctggttctggcgagagcatgagcgatggattccagttcgagtatggcggccaggggtccgaccctgccgatgttggtcatccagctgaccttactgcgcctgatgtgcaccgaggcctcccagaacatcagctaccactgcaagaacagcgtggtctacatggaccagcagactggcaacctcaagaaggccctgcttcctccagagctccaacgagatcgagatccgcgccgagggcaacagccgcgttcacctacagcgtcactgtcgatggctgcacgagtcacaccggagcctggggccaaaccgggatttgaatacaaaaaccaccaagtttgcgatggggtcccggaggctcgaaattccgaaattca

SEQ ID NO: 536899 - DNA, 261 bp, Homo sapiens
tcagctccttacagggcctgcctctctacttcttctggcttcgtccccgggagtgtccaacgggctctgtgggtcactgtccccttcatcttcagcaagcctatcaggaaacttctatgcgcttcctgcggacatatgggtggccaggaaggttgtttatgcaacagagccacaaaacacggttctgtcttcaccatgcagctaaacactgggctgcccagggagttgtaaccctccgcatgggtaaacccttggttcatg

SEQ ID NO: 536900 - DNA, 431 bp, Homo sapiens
ctcccaaagtgctgggattacaggcaggagccactgtgcccagcctaatctctttttttgagacagggtctcactttgtcaccaatgctggagtgcagtggcaccatcttggctcactgtagcctcgacctccctggtttaagtgatccttgtgcctcagctccccaagtagctgggaccatagcgtacgccaccatgcctggctaacttgtatttttagtagagatggggtttccccatgttgcccactggtcttgaacttctgagctcaagtgatccaccgccttggcctcccaaagtgctacaattacagacgtgagccactgtgtctggccatttttaaacgttttttagggaaagtaaataatagctggcgtggtggctcacacctgtaatcccagcacagtggcaggatcacttgagccccggag

SEQ ID NO: 536901 - DNA, 1165 bp, Homo sapiens
ctaaaaacaaactctgaggccaccagcagatcatctttaagccagagagtgcctacaggttttgaacactattatcatctaggtatatcattgcattgcgcggtaggcttcaaaaccgtgtaggcactctctggctaaaaacaaacgtctgaggccaccatgcagaatcagtctttaatgctaagcttactatttttcacctaatttactatggatgacggagatttatggctctgtgtgtaagcccaggcatggatgtgcaggaggacacgagtctcggctcagctgcgaacacgtccggactcccaagttcaaggacgattctccgtactctcagccatccttggtgctagctgtggattacgaggatggcacccaaagccaatgatgcccatgtgcctaaatattgcatgtacctttaaaggtagaagattggggttgcaacgcaatgtttggcacagtgcgtggactctacaagactcgcagatcatcaggggtgagatcataactccgatctccctccgagcaccatctcgcagagaaagctatcagttgggcgaattataacaagtgcaccattgaaggccctaaagcagcagtcccccggggcccgttacattctcgttaaaacagtcctgaaagagttacaagggggacacggcagttgaacgaacacttggcgctcccaagagaaaacaacggattgtcgcaagtgaaaaggggcgagattctgagatggggcacaagtttttcccccaactgcaaaacgcgctacagtatggggacgtatccgattggcacgagtgtgccggtaaacccgcaccgtttcatatcgataagttctaagcggataactttagagacaagccgtctccgttgagtaggacccgcctgttcaagggcaatataggatctgagcaccagcgttaataagttccaccaagacgtagtgcgcccaccgtagaaggggaaacacgatggagaaagtagtcatggtgggtgtaagcacaaaggaaagttggcggcgttaaacgataggagagccgttagctgacagtattcccccagtatccgagagaggagataaaggggtaccaaaaaggcaagcagcaagtatgccgtataggaggcaccaagtctataccagcactgggaagaaagatct

SEQ ID NO: 536902 - DNA, 433 bp, Homo sapiens
gagtctctgcaataaaaactaaaagtgttgataaagccgatgccaaagatccccgcttattgatgagattggcgcagtcggggttctctttccctcttcctccatttatggcgaaaacttgaaagtctttttttgtattcgtaagtctgctgttatgcttgagtgtatgaggaatgcttatgtgaagtagaaaagatgcgtagatgcaccaggatgttgtggtagtgttttcagtcgggttgtagagatgtttggaaagtagtcagtttgtccagctgtttcaggcagaataccttatgctgttcccaattcgtcaaaaggaaaagtcatctgacaagaatgtacttttttctgtcctccaaaagttggagtttctgtttgtttgtttgcttgtttgtttgttttgattgtcagaataaagtattttaattca

SEQ ID NO: 536903 - DNA, 151 bp, Homo sapiens
  misc_feature (46)..(46): n is a, c, g, or t
agagtggagaataaggaggagtactatatgtctgggcacacagcanctcctgtctagctctggagagctgaagagatggcgtggaagaggaggagggagaagagctgggcgacagtaaagctttctaacttcccctttctttttccaaccg

SEQ ID NO: 536904 - DNA, 207 bp, Homo sapiens
ttaaactaaaaaaacctttttttggggagaaattttaggcctttaaaaacctggattttttttttttaaaaaagttaaatattccggaatttggaaaaaggtttgtttaaagtagggcaaaaccggtttaaagggtttccttttaaaaaattaaggattttgggccctaaaaatttggttttttaaaaaaaaagctctggattttga

SEQ ID NO: 536905 - DNA, 1209 bp, Homo sapiens
tgctagccggggccatgtcggcgggttgcggctggcggctgagtgcgtcgtgtggaggaggggaggcggcgaggaggcgcagttcccgctgcaccgcgatcgacgctgcggagcgagcccacccgtacaggttgttcctgtcgtattccctgcttgtttacgaggtcacaatactagggatccactttgatacaaggaaaggctcggtacgacgtagaggctatggcgccccatcgaagggactacatctagagtcggccgaccctcgtacactgtcggatctatagtcccaatcatgaatcattaaaccacatcagcaaaaatacaccacaacacactacacaccatcaataacacaagccacgaagacccctccaaacaagaggaacacagtccctgcccgcgcaccaaacacacgccgcccgcgagccagccaggcccgcgagacaacccccaaataacaccaacaaccagcagagcggaagagagacacccccagcacagtgacgagacagaaacacagaaaacgagaagacagcaggacgcacgcgagcccaacgacaaacaccttgcagccccctactaccgagccagataccacacaccaccacacaacaatacacaatacaaccacaacacccatcactaatacacagtacaacttaaccaaatctcctcacccaacacctacaacacctacacctaaacccacctacacacacaaacacactacaacaccaccaaacacagactctccatacaccacactaccaacccacacaccttaacacctcccccacacactcccaacgcaaacctcacgcaatcatccacaccagcccaccacactcccaccctcccacatcacactctcacacaagcacctacaccaacaaacaaccactaacccacctcacccaaccaacaaagtaacacctaacactaacaggcacccgacaggagcgcctcgccgattcagcactcgctcccgttacacacagttacggacacccctcgacgacagtgttcagcactagtccgcgtcgcttaccgcctcttcttctctccgcactcgcgcaccgcttcctcaccctctcgtactgacgcgccaccggacgcccatactcctcccagctagtactggcgcccgatccccctccaccctccgcacgcccgccgccgagggcgtcctacaacgcacccacaacg

SEQ ID NO: 536906 - DNA, 494 bp, Homo sapiens
ttggtccgtggtatgtgtggaggatactcatcagctcgagacatcttcgtgctaaaaggagaataggtcgcatgatctatccagccatctatcaagccacccaagccaactcatacttctgatttttcctcaccccaatatattcaactatgacagagacctgctagcgcgggctgctctgcaatatgatatatctatcgtctggcttcggccttagaccagcacttgatgacttaaacaagtacaagcagaggcccctttgtcatgcttctgccctcagtcttgccttccctattctattcaccagagggctatgagactgagctttctaaaacgcaacgctaatatgaccgcgtctccagtctggaagccttcactgaagccggacacaaaagggcacagtagttataaattcccagttcagatcaaagtcgagaataggcatgtccagagagatagagagtagataaggggttgcaagggctgaggtagag

SEQ ID NO: 536907 - DNA, 338 bp, Homo sapiens
agtgggtccatcatccagaaagagctctccttgtagtctgtagccatgtaggtctaagtgctgcaaagagagggatggagtcatccttcatacattctgaagaccgacgcactcgcatccatcgaggcacgattgtccctccacgctggaactacagggatactgctaatgagttacaggcaggtacagggctatggggaccatgattgcttctggaacgcttctgaactgtcataccacacactccccttggtcaggcagatagagctggacacgatggactccagagtctgactacaggttgaactagtatcgcatccccaagagcgcttggcagg

SEQ ID NO: 536908 - DNA, 521 bp, Homo sapiens
gagtttgagatcagcctgggcaacatggcaaaaccctgtctctacaaaaaactacaaaaattaggcccggcatggtggctcaagcctgtaatcctagtactttgggaggccaaggtgggtggattatgtgaggtcaggagtttaagaccagcctggtcaacatggtgaatccctgtctctactaaaaatataaatattagccaggtgtggtgatgtgcacctgtagtcccagctactcaggaggctgaggcaggagaattacttgaacccaaggaggcagtggttgcagtgagcctaagattgcaccactgcactccaacctgggtgacagagcaagactttgtctcaaaaaaaccaaaactacaaaaattagcagggagtggtggcatgtacctgtactcccagctactcgggaggctgaagtgggatgatcacttgagcccagaaagtcaaggctgcagttgagtcatgatcctgtcactgcattttaacctgggtgagagtgagactgtgtctcaaaa

SEQ ID NO: 536909 - DNA, 134 bp, Homo sapiens
aattcgagctcggtacccccccaattaaccctcactaaagccccaattgaccctctcatatggaattccgatttgtgactcttggaggagtcagtggatatctgatccccttagtgagggttaattcgcggccg

SEQ ID NO: 536910 - DNA, 110 bp, Homo sapiens
tttgacgccagtgcaaccagtgtgagagacagctttccactgggaatactggtccttgccgaatttacgtcacagaaatgtcctgaggttaaagtgagactcatgtaaca

SEQ ID NO: 536911 - DNA, 892 bp, Homo sapiens
acggcgaactgacgctactatgggccgagtggctagggaacgacgcccgaagaatgggagctgactgatatggtggtgtgggtgacgggagcctcgattggaatggtgaggagctggtgtgtaccagtggtctaaaccataggagtgtgtctctgtgtgctgtcagccacaggaagagtgcagtgagctggagaatgggtgaaatggaagatgcctagagaatggcatagtttaggaagaggaagaagatatacgtatgtgttttgcccctgtgacctgaccgacaactggttcccattgcaatgcggctaccaaagagcatgttgctccaggaggtggggtagaactcgagcattctggtcaacaatggtggaatgtcccagcgtgctctgtgcatggataccaggcttggatgtctaggaagaagagctaatagagctgaagtagcttagggacggtgtcctttgacaacaatgtgtgctgcctcacatgatcgagaggaagcgagggcaacagattgttgactgtgaatagcatcctgggtatcatatctgtatctctttccatgggatactgtgctagcaagagatgatctgacgggttgttaaagtggcttcgaaagattgcacatagcaggtatactagttctaagatttgtccagactgtgcagtcagttgtgtggagatgcctagtgatgaaatgctaagataggcataatgcacagtcgatagatgacaccagtcgtgttgggttagtgtactgttggctgactgagattgggtccaaacacttctgggagcaaggggatgacggggggtataacattggaagggaatattggggaaataaaaaaagggaaatatgaggaaagaaaaataaagaagaaaaaaa

SEQ ID NO: 536912 - DNA, 953 bp, Homo sapiens
ggcagatactgagcttcagcgtctcggttccaatgccgtggcgccctccaggaagttcttcgtggggggaaatgggaagatgaacgggcggaagtatagtgtgggggagctcatcggccactctggagacgcgggccataggtgccgggcgcacagcgaaggtggttggggctacaccaccatgactgcactgttatcggattgtcggccggtgaggaaactaaaatccccaaggattgcaatgtgtggtgcaagcagctaacggctaccaaagatgcaactagatggggctttgacttagggggagatcgagccctggtccatgatcgaggatttcactgcggagcacgtggtggggtggtcctggggctactcgggagagaaaacgcgattgtcgtcttggggccgacgtcacgattgagcctgtacttgggcagaagaagtggcgccagtgcgtctgtgcagagggatcgtcgggagtaatcgcctgcattggggagaagcgagatgaaagggaagctggcgtcactgagaaggtcgttgacgagaccgtagccatcgtgtcgatcgcagataagcgtgaaggactggagccaggtcgctcgctgggctatgagccctgtgtgggccattggggactggaaggactggagaaccccctacagggccagcaagtgccgcgagaacgctccgaagatgggtaggaagtgcaacgtctcggatgcgggggtcacagaccgaatattagtggcgcgctgtgactggggaaccggccgagtcggcagccagcggaaggggaggctcctggggggggtcccaagggaacgggagtctcaagcaacaaggccccttccacccccgcgcacgagaatgcaacaaggctcccacaagagggggcccagggcgcagactggatcagagggcgcgcccaaagaagcaggccgggagccacg

SEQ ID NO: 536913 - DNA, 316 bp, Homo sapiens
gcgacggtagcagcagcatggccgcgatctataggggtatagaggggggaggcacacgattccgaggttcctttaattctcagaggatggggaagatcctcgcaggagcagattgggcttagcacaaaccccttgcttgatctcggacaaacaaagtgtttgtgagagagatctaattagatatgtgaaccaaggcccacccgggaagcacagggttgatacccttggttccctctgcaacttgggctctctctctgcgctgtggacccaacgacgacgcggaggagtctcatcatcgagcttctggggcccctat

SEQ ID NO: 536914 - DNA, 877 bp, Homo sapiens
  misc_feature (155)..(155): n is a, c, g, or t
  misc_feature (193)..(193): n is a, c, g, or t
  misc_feature (228)..(228): n is a, c, g, or t
  misc_feature (256)..(256): n is a, c, g, or t
  misc_feature (280)..(281): n is a, c, g, or t
  misc_feature (361)..(361): n is a, c, g, or t
  misc_feature (364)..(364): n is a, c, g, or t
  misc_feature (367)..(367): n is a, c, g, or t
  misc_feature (371)..(372): n is a, c, g, or t
  misc_feature (399)..(399): n is a, c, g, or t
  misc_feature (433)..(433): n is a, c, g, or t
  misc_feature (439)..(439): n is a, c, g, or t
  misc_feature (456)..(456): n is a, c, g, or t
  misc_feature (534)..(535): n is a, c, g, or t
  misc_feature (539)..(539): n is a, c, g, or t
  misc_feature (543)..(543): n is a, c, g, or t
  misc_feature (553)..(553): n is a, c, g, or t
  misc_feature (565)..(565): n is a, c, g, or t
  misc_feature (578)..(579): n is a, c, g, or t
  misc_feature (581)..(581): n is a, c, g, or t
  misc_feature (636)..(636): n is a, c, g, or t
  misc_feature (642)..(642): n is a, c, g, or t
  misc_feature (681)..(681): n is a, c, g, or t
  misc_feature (683)..(683): n is a, c, g, or t
  misc_feature (685)..(685): n is a, c, g, or t
  misc_feature (770)..(770): n is a, c, g, or t
  misc_feature (816)..(816): n is a, c, g, or t
  misc_feature (866)..(866): n is a, c, g, or t
caggcgctccgggctcgcccgctaggtcggggccgcggcgtcccccaccctaagtcccacctccggccgggcatgggtacccgggtcgggcctgcctcggtcctgggcccactcactggtccagaagcagctgtaggtgcccaccaagacccatntacgacgctgctggccaggagtccagccctatacaggnaggagctgctcttctggggtatcgcgtatccacanaaggatgaggcagacttggtgacaagantggtctgagcagcgcttccagagnnagaactgagcccagtgagagcgcaccctggggtcagcctggattcctgggtgtgtccccggcagccacacacagccatgnacnacncaanngcactcctcttcctcatcctggccaanggggcccaggcctttcgtatctgcgccttcaatncccagnggctgacactggccaangtggccagggagcaggtgatggacaccttagttcggatactggctcgctgtgacatcatggtgctgcaggaggtggtnntttntttnggcagtgttntttttttctctnttttttttttttnntngatttgatggctctgggccctacagcaccctgagcagcccccagctggggcgcanacctancatggagacgtatgtgtacttctatcggtcacacaaaananangtcctgagttcctacgtgtacaacgatgaggatgacgtctttgcccgggagccatttgtggcccagttctctttgcccagcaatntccttcccagcctggtgttggtcccgctgcacaccactcctaaggncgtagagaaggagctgaacgccctctacgatgtgtttctggaggtctccngcactggcaga

SEQ ID NO: 536915 - DNA, 1210 bp, Homo sapiens
gggaagcctttgagggtatcacacagacaccacccaccttcctccagcctgatgcgcaccatgcccatccttgcagcccagcacaccatgcaggtgtaagggacgattggagatttcttcccagagagtctgtcccagaaggactgtggcttgtgtgatgtccaatctcgacctgctccggcatcaagtgcattcaatccacaattatgcacgacgaccatcagaacacgatctttggatggatgacggctcagattacacaccatggagacttaggcatgagtgcggtgcccatgatgactggagggtggatagaacaggatgactgcatgagagcagactggaaggaagatgggagatagactacagagagggagtggactgtaaggatgatatgagaggagcatggccaagaaacaaagatgagcagatcaacatgaggaaaaaaaggcagggcacaatatgacacatactaatacatcaaataaaattagatagatccatataagaaatataaagatagatacagactaccctgcagaaacatcgatcgaccagcgaccatgcaaaacgcagatgcgatcagaaatccctgacacacagagcacaagaaatgggaccaatgcgccaacctcacagagaccgcgcacacaaccgccgccacgatcaacacacccacagagacatcggcgaacacgcaaagcaaaaacaagcacgccgacaaccccaaaatagaagccacggaccttggcacaacgacaagagacgaccaatgcgaaacaaaccacacaaaacaccgagaaacacacaaggcggcacaacacacgacaccaccaaaaacaaaccaaaacaaaccgacacaaaaccccggaacgcaagcagaagagcgcgacaacatggagagacatcacaagcaagacacaacacacaccacgagccaagcaacaaacagagggcagaaggaacacctgggaaacacacgccagcagggcagggccgaacgcacccagacaaaaacgacgagaaagcaaaccaacggaccccaccgcccagccacccaacaacagcaaagcacaaaaacacaacgtaacaaccccacacaaacagatagaagaacacacgtggcgaacaaaacaagaaaaaaaccaaagagcacaacaaaagagagagaaaacaaggacaacaacatgggaggacccacaacgcagga

SEQ ID NO: 536916 - DNA, 110 bp, Homo sapiens
gcaccattgactaccagcacgagcccatcaagccctggaagtctgtgtgcgagcgggccggagggtgggagcccaaactaagaaggaccgcaactcggggccggaggaac

SEQ ID NO: 536917 - DNA, 857 bp, Homo sapiens
  misc_feature (196)..(196): n is a, c, g, or t
  misc_feature (201)..(201): n is a, c, g, or t
  misc_feature (315)..(315): n is a, c, g, or t
ggagactgaattgtcagtgagcggagtctgaggtcgctgtggactgacccatcggggccttgcccgagtagtggtactagtcggattccttatgatgactacccggtgtgttgtgctctgccgtgactagtgagaatcctccacgtcatggattcctcctcatgagagggtacacgctacccggactactaacaantgagnttgactccagtttcttgccaccgtaatgcatcactacgtgatagaaggtctcctggagtctcagattgggatttaaaattcctgaggaggaaaggcctctccagcatagtgcantgttcatcgtccaacggttggattccgtgacatctgtatgcgcatatgagctaggactagtggcataggggcaccttgttctagctgtgaatggatggtggattgccaagatattgagcgatcagcagggctagttgcatgatcctgaatgagcagctcgtgagaatcagcatgcggtgtgcgcttctttccctactattatcatctgccaaaaagagaggactgtgcactagaacgttgcggcccacagcccttcatgtggactctgtcatgacatgctatgtagtacttcaggggagccacttctgttttcagtccgctcccatggaatagtgagtagggaggagtggggagacaggctaaccaatgcattacccgatacatgattgcgcttttgagtaccctagtgtctaggtggagcttcattccctgagaggaggatgactgatatctagggataaacttagcctgttagggaaccctagttaggaaaagaacaactggcatttactggatttcatgcactggtcccttacatttgt

SEQ ID NO: 536918 - DNA, 133 bp, Homo sapiens
cactaccggcggaatgattcggggcgggggtacttgtgtttgagtagtttgaatggagtcgcgctaagctctcgtacatctgatcacaggcctcaggctctgcaacctgggtattctctccccccacagtatg

SEQ ID NO: 536919 - DNA, 675 bp, Homo sapiens
gggtacctgtgatgatcttatcccgaacctgaacttctgttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaataacccaaaaaaaatttaaaattaaaaaagtttttgatatggcactcaaatttcggcttatttggcccattcccctttaaggggactgttttaaaattcaattggcccttttttaaaacctcctctattggtaaaacctcggggtcccccaaattaatccccttggaaaaaattccccttttcccaattcgcctaaaaccctaaaggccccctaggtttgccttcttcaaaagtttggcaacctattgggcaacggaaagttgaagggttaacaattggtctaaactggggctaatctttcggtaaaacccctcattttttaaacaaaagccctaaaaccgtcaaattcctttataaatctaatcaatataccgggtaaccttctcatttttatcccattctgccactaaagccccttatttaactaatcgtgccttcaaactctcagggcattccgtttttaacgcgatggcccaaatggtcaacttcccccaaaggagttttcttgctctcagggttctctttt

SEQ ID NO: 536920 - DNA, 106 bp, Homo sapiens
aggttgaatgacaagacccaattactgcttatgaagacataaagccagcattgatcacttaatcccgtttctcatgtccagccagacaaaggacttcagttaaggt

SEQ ID NO: 536921 - DNA, 359 bp, Homo sapiens
tcggaccacggcaggttgtactggtcacagagactaggaagggactgatgtgtaaaagaatgcctggacgtcaggcacctcagactgtttgcctattttacgacaagaattatttagattttgcaggatggaaaaattcaaagtgccattttctggctatttggaactactgtcgagtttgtattggggtcaagcggcattgcagaagcaaaataaggcatttaggttttaggtcaggtgtgagttggagaggttttaagtttttgagaacacaggctaagggagcaagaaggaggaatggaaggtggaaggttgcccatagtgcaagcaggcaaaccctgagtacaacctgccggtgg

SEQ ID NO: 536922 - DNA, 402 bp, Homo sapiens
gtgctcttggtctccctcagaggagccagcagccccaaggccttggtctccagaaggccaggctcaccctgcatgtcctgcagagaggacacagttggggagggtgcaccaagggccaggtaggctccctgtcatagtagcacacgtcgtctacactctccaggaggctgatggcaccaggggaaatgagacctgagaggtgtagtcggtctgtagaaagaccttcttttcctcagggtcttggatatttcttcaccctccctctgcttgtgtctccatctggcccacaaggaggctgtctcaggctaaatgtggcttatcgaagctgtggactggtctgataaaaatctcgggcccgggagtcaggaaagaaaaaatacattaaaaagcacaaaaaaaaga

SEQ ID NO: 536923 - DNA, 259 bp, Homo sapiens
ttttttccccccccccggggcttcttttgtccccccagggtttggccccccccccccccccggggggggggtttaccccgcccggtccgggttttctgggggacccccaccggtgggttttttcttcgcttttccccccaaaaatcccgggtttggggataccccatttttttaaagggtttttttttttttttttttggggcccttgggttaaaaaaatttaggggccggggcccttatttattccccccccccttta

SEQ ID NO: 536924 - DNA, 1242 bp, Homo sapiens
agcgggtcctggcagcgcctccggaacgcataggtggaccggtccccagcccgtccatgggcgttgtggtcggcaccgacagagttccgtcatcccgtgtccctgccgactctcgaatgctagcgtcggcaccgctcgtctctgtacgcgctgaccgacgggaagcatcagtggaccggcccgggtgcgcccgcacagaccgtccgctcctcgcgtccctcggtgtcctccgcgggccggcgcgatgcggcatgggctcgaggaccggcgagggataagggggcatggggagctaggttgtgccgccgacgcaggaacaggacgtcactgggcgagggaccgagagtaactgaactaaccgctgagggaatacgtcgccagggacatacgaacagctgaaggacgcgtgtgtggcccagttactagcgacagaatagtcgatcgactagttcgtttaaaggcatactgggcgcccattagaacgacgcatagcaccaagaatgacgtggccagggcggaattccagtaaacagaagaagtccaaagcattgcgtgatacttctaggatgggcatttgtcctccaacgaggaaaaggctgtaaactgcacagttcccttgtgatgtaccactagtagctactcttcaagtgccatgtgtaaattagcgtgaattggggatacgtgaaaggacaacatacactagacccacggtctaaggttgggaatactttattgcataataaaaaagggagggtgggcattagaaaaaacattggttggatggtattggtgagcactggacattagtaaagaccaatttcggacggactggtgacttgaattacagcgtagtttggaaacgggacgaattagacattggaacgaaacaacacctaggtttaccagggggattgaatggtggagaaaggggagtgaagtccccattgaaaagaggcaagtgcactatccacagttctggataggagggtacccaggtagagcgaccgatattagggtaacacaaatgggttagagggagctaagtggcataccaggggtagccccggggggatagggaggtttcttaggaagaggaaaatcccattagcgggcgttagaggaggcaacttccttttgcaacgcaaacgttgggacttgttttatcgcacgggggacaattttggttgagttacacaagaaaaacggttggtattgacaagcagccttggggaaaacaccgtg

SEQ ID NO: 536925 - DNA, 224 bp, Homo sapiens
atctgagacagaccccgaatgacctgaccggagagcactcgtgcatctatgctgaacacgctcacatgattaggatgaagctgaccagtggaaggctggcttgcggccttctggatagattgccgacggcggttcctagccttgctctcctaccagttcagtacctttctctccttccctggctctgaacatcattcagaacaggaacatggggaagccagccc

SEQ ID NO: 536926 - DNA, 425 bp, Homo sapiens
ccaatccacggggtttttggcagggggaggacaactggcccacttctcttggagttgggcacgagaccggaattcaaattcctgttggatgtgaaaccggggttggagcaggagattgcacctccccccccctgttggagggagaggatgcccccctgactcagtccaaaaaaaaaccggtgcccccccgtcagggggggtcccattgtggaaagggtccaggagggcagggtcttctcctcccgggagcgggtcccccagaccccccgttgaggattcagctaccccggccggccccccaggaggcaggggggcagccgccccatttgccccccagtttcgggcctttccagcctcagccccctgtttcggtcccttccccatggttccttgcctgatgccaataaagcttgttggctccgcta

SEQ ID NO: 536927 - DNA, 284 bp, Homo sapiens
attaattggagtcagtatctctggtttgcagttttctattaaacagcatgaaaaatgttttcaaaacttagctagaataataactgagatttctgttgtcagatgttcagactgacacattacatgatgtttgagaaaaatataaacaaatatttctcaagtagtttgttcttcacaacctttttaagtatgcctacagtgctaagtcccattatagctacttggttaaagtcatttcttttacgtattcatctagacttcctcattgcaacacggtctctcac

SEQ ID NO: 536928 - DNA, 770 bp, Homo sapiens
agcggtcccgcgcctttgttgcgaaagcgagggggcgaggtgctgcggtgctagagcgcggctgcgaccggacgctgcgggcggggaggaggatggagactgtggcgtccgtcgtgcatactggttggtggctgctgcgtgagaaggtgtgcggtgtacggcaccatgcgctctggcggaaggctgggcggtggtggacgagtcatggctgggagactcgcctcgttctctgggctccctgaagtctcaggggagccgtgacccatgggatcaggttgatgcaggcctgtgtgcttgcagcctagcgcaaagagcatgctccattgcccaggcaggcggcaggggatgccatgtggcctggggtgcgcttctggtcgccgggtacggctcgtgaccacgtgtggagtaccgaattgcgtgcagcggccaatcggtattcctgttaactttgtgactggtgcatgccaaccataagctgtcaatgcggagaagcacatgggggcgtcccttcgtgacgtacctgatcatcccttgaactcagtgatgaccggcagcgaaggcatgacgggacgcgacgggggcgaaccgaagcagtccgggcggcctaccgtgcaaacagacaccccatcgagagggacagcgtaacttgtctcggggttaccatcgtatgactattagttttatccgaactattacttctcttgaaatgggctgaaaatgcaggtgagcgcttcacaggatttgcgtgcctcttagggagaaagcaaatg

SEQ ID NO: 536929 - DNA, 182 bp, Homo sapiens
gagacagggtttccctgcattgcattgcccaggctcatctcaaactcctgggctcaagtgatccttgatctgcctcggcctcccaaagtgctgagattataggcatgagccaccacacccagcctacaaactttatttcttgaattttaagccacccttctgtagtctctcgcagccgtata

SEQ ID NO: 536930 - DNA, 339 bp, Homo sapiens
  misc_feature (8)..(8): n is a, c, g, or t
ggggcccnaaaccccccccaggcctttttgtgggaaggccccagaaccccttgtagggggtttcaattttggcatggttcccccgaatgtggccaagggggtttccccctgtgtccttaagaggggggggccttgaggaaaaaccgtgcctcatttacccccaggggcctcttcctccccatggaatggggtgtttttcttgccccaatttgggccgaaaaaggccaaacccccctccccccccccaaaggtcagtaaccagcttggttcctcccagggtttttcaagggcttgggggaaaaataatttttttaaaccaggaagttttgttgtttttta

SEQ ID NO: 536931 - DNA, 344 bp, Homo sapiens
aacctgcgcctgtttttcagagaaacaaagttaatgatcctgtctgtgtaaccccctggagcgatctatcagtgtgaacacagctgtgcactttgacgggctccacctcgtacgcgtcgagtccatcttggcgatgacgatgtcccatggtccttgtacgtctctcccagttgatcccagataggagccaactgtctgcagtgaccacaccatggggcatagaactccacaaagacgtattttttctcatcaaaagccacgtcttcacagttcttcccaacaagcaccttgacaggctgcttgtcccaatcctccggcagctcctggctcatcaggtggggctt

SEQ ID NO: 536932 - DNA, 589 bp, Homo sapiens
ccaggacatcatccactgcactctagctggcgctgccaaggctgtgggcaaggtcatcctgtgagctgaacgggaagctcactgtgcatggccttccgtgtcccgcactgccgaatcgtgtcagtggtggatcgtgacctgccgtgctagtggaacctgccaaatatgaatgacatcaagaaggtggtgaagcaggcgtcggagggccccctcaagggcatcctgggctacactgagcaccaggtggtctcctcctgacttcagacagcgactaccgcaccttccttccacctttgacgcatggggctggcaatgtgcccgtctaagcagaccgacctttgtcaaagctcatatgtccatgggtatgacaaacgaactgttggtctacagcaacagggtggtggaccatcataggcccacatcggcctccaaggagtaagacccctggaccaccagccccagcaagagcacaagaggaagacgagagaccctcactgctggggagttcctgccacactcagtcccccaccacacgtgaatctcccctcactcacagttgcatgtagaccccaatcagacggggagggcc

SEQ ID NO: 536933 - DNA, 320 bp, Homo sapiens
agacaactagggtagttttgcaggtggtaagccattctgatagttgtaggtaaagaagggcagatttattagagaaatgtgaaaatatgttgcagtgggcagctcagcagagaaggggctacctgcaaagaggcaagggctggaggaaagttttatagagtcctgctgaagggtgctacgtgtggaatgaggtcattgtgcccgcaggttgttcgtgattagctgtctctaacaattgttcatacaataattgttcattattgttctcaacttggggctctccccaacctggggacccttccttattgttgctacccact

SEQ ID NO: 536934 - DNA, 109 bp, Homo sapiens
cacgaggtttacccatgtcttgttttttctggagacagtatggccactgattacagggcaccttcaaaggagcttgcaacttcaaacttggtctccatgaacaacatgg

SEQ ID NO: 536935 - DNA, 547 bp, Homo sapiens
ctgcttcagcctcccgagtggcgggcgcctgtaatcccagctactcgggaggctgaggcgggaaaatcacttgaacccaagaggcggaggttgcagtgagccgagatggtaccactgccctccagcctgggcaacaagagtggaactccatctcaaaaaaaaaacaaaaaacaaaaaacattcccttggtcttcccacctggtactggtttggtttttggtttttaattatttctgggacagaatctccctctgttgcccaggctggagtgcagtggtgtgatctccgctcactgcaagctctgcctcctgggttcgggtgattctcctgcctcggcttcccaagtagctgggattacaggcacatgctaccacatccagctaattttaggtattttatagtagagacggggtttccccatgttggccatgctggtcttgaactcctggactacaagtgataccggccgcactgcaggctacccaaagtgctgggataacaagtgttaaggtaactgcaacccagcccaagaactactcccaaccta

SEQ ID NO: 536936 - DNA, 356 bp, Homo sapiens
tctctccacactggatcacgggctctcgcctgatcactatccccctccatcccaggactgccaatagctgaatttcatcccttatcaatcctgggaaatgaggacagagactgagaagcatccaaggctggctgggtaactgacaggcaatatgtgatgcggacggtcagaggccaaacactacccagacaccgagcatcactcagttccttgctgggagctgggagtctaaatcaaagttcatacatctgatttgttgatgggcatccaacagaggcacttcggcaatgctggcgccctgcagtgacagcaccactgtcttcacagaatcacggcacgtcctgttagggggcacc

SEQ ID NO: 536937 - DNA, 400 bp, Homo sapiens
  misc_feature (23)..(24): n is a, c, g, or t
  misc_feature (78)..(78): n is a, c, g, or t
  misc_feature (82)..(82): n is a, c, g, or t
  misc_feature (215)..(215): n is a, c, g, or t
  misc_feature (309)..(310): n is a, c, g, or t
  misc_feature (318)..(318): n is a, c, g, or t
  misc_feature (351)..(351): n is a, c, g, or t
tccagttctggtcccactccgtnnctataatacacataggtcactgtctagtgagggcgctcaggaggagggcagggngtgngaggcttctgtcctgcacaggctggggacagggcactatgtctgaaggggtagggatgtggatgcaggaggagtgtgtattggacccatatccagcaaggacacagggacccagtggctcttgggcaggggcngccaggctgtatttgtagttccaagagatggactggtggctatgggtaatggtggttgaggacaaggctgggaggcagaagagtgggctgaagnnctccaagngcaggcgagcagtgggagaattaggttgttggncaagggtggaaagaggtatgggtgcatctctgctgacgggcaggtttta

SEQ ID NO: 536938 - DNA, 411 bp, Homo sapiens
cgcatcatggggtctggagatgagatatctggttacacagtgaaactgtctctactaaaaatacaaaaatttagccaggcatggtggcaggtgcctgtagtcccagctgctcgggaggctgaggcaggagaatggcgtgaatccgggaggcagagcttgcagtgagccgagatcgcaccactgcagtgcagcctgggagacagagcgagactccatctctaaaaaaaaaaaaatattaaccatttcattcttcttagcccttcaagcccccgaacggggttttctgacatatcatctggtatacatccttactcttcggttaaatcccagagggtacagagaaggtgtacgtaacaggtaaaggagagtaagtgcactgtgagtgggtgctgatgaattataacaacaggt

SEQ ID NO: 536939 - DNA, 118 bp, Homo sapiens
acatatttgtacgccgttatcccccaggacactgactgccttctccagctccgtgtcgcagtctgacatctccctgcttcgcctgctggcggggcctgatgcctcctcctgtccctct

SEQ ID NO: 536940 - DNA, 859 bp, Homo sapiens
  misc_feature (191)..(191): n is a, c, g, or t
  misc_feature (212)..(212): n is a, c, g, or t
ggaaaaacaaagagaagaagaaagagaaggagagaaaggagagagacagacaaaatctatgcataggtaagagcctcggatgttaaatcggaccgaggtggatgctcagatgtttagcaggtttacgatgcaagcatcgtttacccggactcatggcaccagatccatactattctgtaaactgaggcggngatgccaaaaattggaagcanttactctaagatatcaaaagattgaagcaagccatgaaacctctgcgcggagagagccgagcccgagcggcggggagcagcacgtgtcgcactccgccctcttttggcgacacctaggcctggccctcccgagacctgtagcgcggcggagcaagcgcggaaggctgggaggagctgcgcggagactgcgcgtcgaccatggagcccgacgggacttacagagccgagctatcgatggagtattcgacttctgcacagtgaatgtacacaacatgctgtaccccaaggaagacaaggagaaccgcattctgctctacgcgtgaccgaaactgtgattaccagccaggaggccgaacacaagctgcatactatgtcaacaagatcacgcacacgaagtggcacgaaactgcacccagatatatcggcgacgtgtaccaggaaccccacgttgccgggaccagaggaccaaccgttgcccaaaagtgcggccacaaaggagggatgtgtacttccaagtcaacaacagatgcgcggggacgaggacgccatgacgccattacctacgtgtgcaccggccccacactggcgagacactgtggacgagtgacctcctctatacccgagtgtataaccacagcatcctggtg

SEQ ID NO: 536941 - DNA, 692 bp, Homo sapiens
  misc_feature (615)..(615): n is a, c, g, or t
ccacgcgtcgagctaggcatggtgtcacacacccataatccaagctactcgggagtctgaggcggaaggatcgcttgagtccacagaggtggtgagctaagatcgcgtcactgcattccagcctgggtgacagagcaagactctgtctcaaaaaaaaaaaaaaaaaaaaaaaggtgtgaacccggatccctcacttttttaaaattttattttttagaaagaagtgttaggtgaccaaaagtaaactgtaaaaagagtaccactttcacctttttggcaagaagctgcattaatacatgatatgaaggggttggaatggcccaatttagcacttctgtgcatagtccctttcacatttttttaaggttttatattttccaaagaattcttggtccactctgatatgtgtagtcctacatagtggctatatccatgggtcttaagaaagtaccctctatacccagtgggcttacccaagttatcacttctttataatcacctttatttcacccctacaaataaaagggattcgtttccgacaacattaaacttctaacgtgtcttacacttcactttgggccggtgtgtgggttcccactataatcccagcattgnggaggtaggccagaggatggccagaagagtcagacccgcgcgaatgagagaccccccattttttaaggattactccg

SEQ ID NO: 536942 - DNA, 162 bp, Homo sapiens
aacgatcacaaagatacatctcttaagggggtggaccccaagttcctgaggatcatgcgctttgcccatgaagcacaatcaaaaccgggcctagagacatgatcaggcctaacaatgccaaggccatggagtgcacgtgcgcgagagctatcaaggtccctc

SEQ ID NO: 536943 - DNA, 407 bp, Homo sapiens
gagagagagagagagagagagagagagagagagagagagagagagagattgtgagtcagtgagactacgcctctcttctttccttcttcgctcctctctctcgttgccgttttctctacctttttctctgtttcctttctggctctctcctgcttcctttcttctttcttcttcctttttatgcttcctcctcctttgtttgtacaccgtcctcctcttttctcttctctccttttccttgtcccctccttctttcttcgtttttcttcctttcttcttctcccttctctcttcctctttctcctgttctttctcttgtgttcctttctctcccttgcctctctctttccttcttcttgtcttctctctgctcttctctttccttttccttcctttttcctctttcc

SEQ ID NO: 536944 - DNA, 296 bp, Homo sapiens
agaagggagggagggagaatgaggacggacggcctagccaggccaagaatgcaatttccccggttggtgggagcctgggagacccctgtgccttggacgggacaagggtcgggggacacgaaggattgagcaccgcgaaccacttggcacagttctttcctaacagtttgacagtattttctccaaggtacaattccgatccggattgtatcccattaagcagggtgtcccttgtgtcagtgtttgggaaagagtatattttaggggggaatttcaccctaccccaaacctggcgg

SEQ ID NO: 536945 - DNA, 106 bp, Homo sapiens
tgcgttgagaggtcgtcgtcctccgggcagcgtcagccgcgcgccactgctccacgaagcgccgggccttgtggaagttctgctcacccaaccgcatcacccgggt

SEQ ID NO: 536946 - DNA, 392 bp, Homo sapiens
tagtcagtataaactttaagataatttattctatttctgtaaagagtattattggtattcatagagatgcattgaatctgtagaccgcttagggaagtctggacattttaacaatattgattctcccaatccatgaacatggaatatctttccattttgttgtattttcagtttcttgcatcagtgttttatagtttttattgtagagatctttcacttctttggttaagtttattcctaggtatctttttatatttgtagctattataaatgggattactttcttgatttctttttcagattatgtgctgttggcatatagaaatgttgattttgtatcctgtaactttactgaatttgcttatctgttctaatagttttttagtggcaat

SEQ ID NO: 536947 - DNA, 246 bp, Homo sapiens
caggcatgcgccactatgcccagataatttttttgtattttttagtagagacagggtttcaccatgtggccaggctggtctggaactcctaacctcaggttatccacccaccttggcctcccaaagtgctgggattataggcatgaaccaccgttgcctcgccaaagatgtaatttaaatagttagagggacttgcatgggcagctccgtgcatagcattttcaccccagagcttctaatctgttt

SEQ ID NO: 536948 - DNA, 387 bp, Homo sapiens
  misc_feature (144)..(144): n is a, c, g, or t
  misc_feature (150)..(150): n is a, c, g, or t
ttttttttgggtccccccccacaaaaagtctttttgtgggggggggggaggacttccccccccgccccccccaaattttggggatgggggggacacaaagcccccccttgtgaattttttgggcccccctccccccctttttanaccccnttgggggttccccccaaaaacacccggggggggggtttttttgggctttgggggccccccccctttcccgggggggggggggggggcccccccagaaaaaaaaaattttttttttttcccaaaaaactttttttttccccgccccctttaaggggggggttttttttccccccccccccccgggggggttgggggggattttttaaaaaaaaaaaaaaggggttttgggccccccca

SEQ ID NO: 536949 - DNA, 1191 bp, Homo sapiens
ggagtcctggaagcggagctccgaagctgggactggttccttcgcagccatttttctgtccaaccaaacaggcgatgggagacgggaagccaaccaagggctgcataggcaggttgaaactcacgaaaggattaaggacaccttgtatagcatagcgtggttcttcagccacccaattgaacaaacacggtttcttgacagctattttccattggaccaagggggatgggtgaccaagatttctacaaacatgatagcttcttcaaactagcgaaatcttcttggcagacactcatattggggcgcgacagtcattatgttaataacaaggccttccatggatgaattactggaagggaacaggcatggacagtggcatcatggacagaacaccaaagtgtggtctcacaaaccgaaaacgttttccagaagaaaccaaaggaatactaataatctttacccaatatacggcaaaaaaaggtggggcatacgggcaataccattggcacacaaatgtgcgccattggcccattcaaaaacgcgggggcacaccagcatttggcccacgagaaggacttggacccaacagacagtggtggtttccacaacgaaatgtgctagctacacagctagaaggttttcaatacgacggtttattagatagaccacttcatgggacgaggccaaaggttggcaacaagggttgcccacttccaaagcagcacacgcggtggaaagaaacagagattcaaaacgtgggaacgacaacggaatcatttacgtcgttaatagggcatacatggtgacaataaccatatataacggagagcatagtggaacagagagtataagttggaaggggaacaccctatacatgggaaagagtagattaacgtctatagtcatggcaagagaatttccaagcaagcagggggattagatggcaacaacagaggacaggacacacaaaggtggggaacaaagtcggcggatggagacagtcaaaaggtttcatacacgcacacacaccaagggagggggacgcactaacaggtgttgtaacacgaagaccacttaaccgaagacggcgacagggacacattatataagataaacgcagagatttagcaccacagagaggtgacgttagacataaacgacacaccacaggacaggagtctcaaaacacac

SEQ ID NO: 536950 - DNA, 128 bp, Homo sapiens
ggggggtggggggcaatggatggtgccctatctgggtagaggtagtgttagtgtggtgtgtgctggggataggcagtgcgcctcctgctcgcccccagcccacccagccaaaaatacagctgggctga

SEQ ID NO: 536951 - DNA, 219 bp, Homo sapiens
gagcggctacttggtaactgtatataagaatagtagacttgctcagtgatgtggttcaggaacacgataaacctattctagaagcacttgaaagatattaaagtagaagtactacagatatctggccagcctatagagttttgtctatagaatttcactattgaacccaatagaatattttacaaatagaagtgccgacaaaagacatacaggatagag

SEQ ID NO: 536952 - DNA, 335 bp, Homo sapiens
gcaagtacttagtccagtggtatgctctctaatctattaggcacttgtattcaagagtccttttcatagtcttgtccataaatctccttgcaagaacaagcaatttaggacagtagctgatattacaatactttgaggaagaatcaaagcaactttctgccagtcttcctgaaatacaaaaatgacatcacggatgctacgttggattatagaacgcaaaagttcctaatcctggaggagcaatgactctgatcgtcaaggatgtggagctttcctcgccagtggctgagatacgagcagagcaagcatagagcccattatgcttaggagtaatc

SEQ ID NO: 536953 - DNA, 267 bp, Homo sapiens
atgtgtcctcacatcgatttcacgacaggaatgtgatacggatctcaacaaccagggaacccagtccggcacccgccatctgcagcagcatgactgactaatctttcacctgagcccacactgtacaggagtgacttcacatcattggctatcccctactgattcgtcatataatgcagtaatcactccctcctttcaatggtgcattataatataccccataggacagccagtctcctatagggctctccttggcattatttgtaa

SEQ ID NO: 536954 - DNA, 771 bp, Homo sapiens
gggccctggttaaacccggccccccgcgggtatggatcttcgctggactagacggtaccagctgctggagtgctgcaggcaggcactggcataggttgtcaaggagccccatcagccaaatgaattatttacaagttttcaagaaaggagactgcaggcagctgttggaccagacagaggatagaagcctccaggagaaataggcagtttttcaagggtttcctggtattaatgagttcatccatgaacatgtattttgatacaatttaaccaacaaaaagtataaatcacaacaaaaagaacaaacacaaaaaatataaaacacacaaaaaaaagaacaacaacaacacaaacacaaaaacaaaaaaaacaaaaaaacaaggaagacgcagggaaaataaacataaataaataacaataagtaatgagtaagtcaaggaacaaacaactaataaaaatcgaaaaaaaaaaaagaaaaatatgtaggaagaagaagagccgagatacgatcaaaacacaagaagtatgagaagagaaaaacatatctatatagaagaatgaagactgtacagaggtaccagagaagagctcaacgaaatgaacatcaacaagagagaagaagatgaaagaaaaagacggaaggaacgagaagaagggtaatccatattgctgaataggacagaacaaatacaaagagcagatgtatgatggtgaggtatgaactagcaaataatctgaaggtcgagaacagaacacccagaccaaagacgc

SEQ ID NO: 536955 - DNA, 553 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaacaaaagacaaaaaaaaaaaaaaatataggggataattcccctcaaaaaaaaaaaaaaaaaaaaaaaaaaaaacgtgtgtgtggcggcgcgcgccgcgcggcccccgggaaaagccttttaaaacccagcgcggggggggcgcgggggcgcccagagaggggaagggaaaagggggcaaacgggggtcccagaggagaaaccgggggcaagagagaaagaggcggggggagtttctccaccaccaatataaaaagcgcccgcgggggcaacgggagaggcttttggtgaaaaacacccccgagagagggagcttcgagagggggcccaaaggcggggaatattatacacaaaggggggaccccaagggagaactcggagaatattaaaaatataacccccgccgggggggttg

SEQ ID NO: 536956 - DNA, 189 bp, Homo sapiens
aacagcagctggcagacaacttctaggctcccttgccatttaaggtctcgaggaatggggagacattggtagggggccaggtagggtgggaaggacggattttttcctctttgtctctatctctctttctctctagtctttttctctaatctctacatagttaatagcaatgattttagtaaacaaaaa

SEQ ID NO: 536957 - DNA, 479 bp, Homo sapiens
cctcgtaccccggcttattacgaggctggttgcggcggctgtgcgccgggctcccagttcccgagtgcccgcggtcccgcgagcggagtgggaccagccctagcagaacccattgcgccgcgccgggacgcccgcggagagagccactcccgccacgtcccatttcgcccctcgcgtcggagtccccgtggcagatctaaccatgagctacccttgctatccccgcccccaggtggctacccaccagctgcaccaggtggtggtccctgggaggtgctgctaccctcctccgccagcatgcccccatcgggctggataacgtggacactatgcggggcagttcaacgcaagactatctctcgggaatggggccaacatgtctgggacatttggaggagcaacatgccaagctgtacactggggccctggagtggtaaccacagtgacactggtagggaagccccaacaggctgctacct

SEQ ID NO: 536958 - DNA, 135 bp, Homo sapiens
tactccatggcttgctggggccaacattggaagttatttaatgggcagactgcgactgaccttttaaagccagtgggatttgccgtgtgtcacatgagcctggaggatagaaaacatgacatcctgctttcatta

SEQ ID NO: 536959 - DNA, 452 bp, Homo sapiens
ccaaatggcccacagtactcaggaccctcacgagccgtgcaggtgtgcggacctgggagccagcagggcctgccaggcagcctaggtgcagagcggctgcaccatctaggcgtgtggcgtgtggcgtgtggagtgcacgctgtgatgtttgcaccatgacaaagtcgcctaatgacgcatttctcagaacacgcctggtcgttacacatgactgcactttgtgtggctttgggcagcctcagctgaaacatggtgatagggacacttacgcgtcaggcgcggggactgcagggagagtgggaacattagctgcggcctccagtgcatgccagggacaacagcaggggctggcaaaaggctgatggtgggcgggtggggggtttgaacctgaaacttttgctacctgatctcgcttgaccccgagattggcttttataaacagtaaaccgtga

SEQ ID NO: 536960 - DNA, 383 bp, Homo sapiens
ctccacgaggctatgccggtcttcccgcatcttctcctccagggttggttgttggttacaagatcgtgtcacccggtcattcaggacagtaatttccagctcaaggtctcccttctctttgaaaacttggttgtagcggctcctccaggattccagagtggataaagcgtcagcgacatacatatccttgtcagcgagttggacgtgtagctgctcagcttactcctcgctcttctcggatcgctccttcggggcacggagtggccttctacaagctctctgttgcctcggtcctccttctgcttccactccttcagctgctccatgaatgcctccacttctgccttaagctgggtggtatgatgaagggtccttcatcatac

SEQ ID NO: 536961 - DNA, 130 bp, Homo sapiens
ggcagacaccaaaattgccaagtcaggacattgcacagaattctattcctcatccttttttttggagacggagtctcactgtgtcacccaggctggagtgcagtggcgcgatctcggctcactgcaacct

SEQ ID NO: 536962 - DNA, 117 bp, Homo sapiens
taacgggggcgagtatatgcagcagtccgggaagagtcatcgaggatcgactcagagctcgaatcgctatcatcgcagctaagtcacggcacgtcatctaaagattgctcgagatag

SEQ ID NO: 536963 - DNA, 765 bp, Homo sapiens
gaagagtttttttaaaacccgtggggaaaagattaccctccccccccgggggtgtgcccggggggaggttttttatgtgggatttctcccaaaaacccggggggggggttattaatccccccccccgggggggagggattggaatttttttcttcgcgccacgttttttttttttcaggaaaaccccaacttggggtctccctgggttaaaaaaccattcccccccccaattggccccgtccccaagtttggggaaaagggttttcccggaataaggaaaaaggccccccaaatccgggttccagcctttttaaggtttgaataaaaattatttttggttgggccacaacaaaggatgggccccctttggagagaaggtttcggaccccgctttgaaaagcatttggacacgtgccagaaaagatcaacccacccccataaaaggtccatgtgtcatatctggggcaaggaactgagcatccaatcttcctttgtcagacaagtggcacctgtcacttagttggtgaggcaagtatagtcttcattctcacagtcagtgtctatcaagctctcagtgtgtcccgagacggcaacactggcactggttggagggtcctggtcatctggcaagtatccccttttaaacttctagaggacgagtccgctatctatattgagggtgacacctatttcccgttcaagtcagtagcatatagggattggtaagcaaccccctctccgtttctctctgcagcaacgctaacc

SEQ ID NO: 536964 - DNA, 398 bp, Homo sapiens
  misc_feature (337)..(337): n is a, c, g, or t
cacgagggcccgccgggcgactgctcgatcggcggcgcctcgtagccaccggaggccggctcggaagcgctgtcggcggcattcggttccgagcccgaacgtgcatccgatggtggggttgaccctgcgttctcacccggattggtcatcctgcaaacctagcgtacgtgctggtacccggggtgattcgagtgcggggcggcgccgcgtgcgcacccgccgggggttagggttgtggcatcgaacccgcaggttgcgtgcccgtctgcacaggtcgtgcagcgctgacgcgaacgaaggagaacgagtagctatgaccggtcccctccagcccggnaaggaccccgtcggcagaccgggtgtgcgtggcccgtcggcattgccgaccccacccaaag

SEQ ID NO: 536965 - DNA, 169 bp, Homo sapiens
ctcgcttcttgagcatcttgggctggaagttggccacagagcggcaagcctccctcgcccctgcacattcttgaaggcggcaagaccgacggcttgcagttcccaggaaggcgtttgatgcttcaagaagcgagaggagcagggccgcttattatcgtacagggtcttg

SEQ ID NO: 536966 - DNA, 904 bp, Homo sapiens
cggacgcgtggggggagggactgtcagcctggaggtttggagactcagttctggcaatctagtgtgggtcaagccaacttcaggggagaggctgagaccagggtaggagtctacaggagcagacgagagatgtggggtgccgtgcacagagctccatgtatcagcttgggaagttcgaaggaaggggaggcaggaggctgcttagtctgctgccatgactgggccccatgaatggtggctctcaagcttctgtgctacacaggggtgtgtggttgggcgagtgtccttgtggattggtacctaattggccttggttgggaagcatatgccaatgaggtgcccgctcggtgcccgtggggctgccagatctgtcattgacctcattgtgtcgccgcttccgccccgaaggaggctgatcggctgccctgccagttgacgcaattggtggaagacgtgggtgggctctgatcccaggcttcccggcaggctctggctttggcgcagaggcgggttctgagtgacttacgggcccctcattcggttgcctgggttcctgtgtgtgtggcacgggtaggggtggaccctgtggggaacgaggggtccacgggcctgctcttgcaggaccttgtggttccgttgcgtaggagtgcttcaggtccggaaagtcgttgttcttaagccacgacaggccgcgtaagctggagcgtggcttttcacggcggtgtaggtgggtgagggcctagcttgggtaccgcgtgcggggctggttccccagacccttggtaacgcgagggctcgcgggaggcaccgaggggcggggttccccccccggtggctccgttggcgggccccgctctccctgcgtcccctgcctggtctgcgtcctccgcattggtcctggccg

SEQ ID NO: 536967 - DNA, 774 bp, Homo sapiens
gaagcgatctagtctggagtgtgagtgtgattcctaggggtgtatgtttgatcccgtttcgtgcaagaataggaggtggcacgtgctgctagggctgcaataatgaagggcaagatgaagtgaaaggtaaacgaatcgtgtgagggtgggactgtctactgagtagcctcctcagattcattgaactaggtctgtcccaactgtatgggatggcggatagtaagtttgtaattactgtggccctcagaatgatattcggccctcagcggggaggacatacggctatgcaaggctgttgctatagcttgcaagcaggaggatagtgccgatgttgcaggtttctgagtagagaaatgatccgataatataggcctcgcccgatgtgtaggaacgaggcagataaagaatattgaaggcgccatcggccgtgaaggtagcggatgatgcagccataatttacgtctcgagtgatgtgggcgatgtgagtgaaaaggcggtgtgaggcgctctggtgagtaggtgcatggaattaggaaatagtcctgtggtgatttggaacgatcaggcaggcgccaaggagctgatgcccgaagtttcagtcatagcaggagatgctggatggcggtggggaggtcgcatgaatgagtgcctaattacttctcatagggggtaagttttgcggccgcaatcccgggcttgcagcacctgggagaaggcgaccgtgtgaaggggctgttggcccccaaacttctgtggccccgggaatgggaatga

SEQ ID NO: 536968 - DNA, 800 bp, Homo sapiens
gatcctacctttacccttacccctgaagctggagccaggacaggatgactgggcccaagggccctggggggtgagcaaaccggtccacgcagagcccgaaatgtacgtgacaagggattcatgggggcttcccctctgggtggcgtcgacacaagggaggacacgtgacaaggggatcctgggaggtcgcggttacgtcccaaagggaagagggaactaccgcgacgctgagggagacttcgcgactagcttcgtggaagttgattcgatcgaggcaaggtcttactgacttctacctgtagccctccgctctgagagtgcaagacgtggtaacaggtgagaagtcaggcccttgacctctccagggctatagacggaccgtgactagggccccagggtcttgactactcttccacccccgtttacctcaggagaagggccagccacagctcacatggcctatcttgggccctactgggcacagagcaacaatgatcgtcattgcagatctcagtcaaaactgggtccactagctttcccacaccagcttcaagtcctaggggccatgggcagggctcccagcctgcaccgcctcaccactgcacagtggggaatgattctctcaggcatatgccccgaggccgtcgtcgtcctcagggtctggacttggtcagtggcacttcaccagtggagctgccttcccagaggagaaggagccgtgcgccagggcagggcccgtgccatagacttctccgaacccgccagagggatgtaaacacctcgaggcagcacactacggg

SEQ ID NO: 536969 - DNA, 957 bp, Homo sapiens
gctgcagtttggctgggggttcacttcaggtcctactcatctggttcactactgcacctggagatgacactcgaggaggctggagaacagcaaagatgggtgcctgctccttcctctgggatccctgacctcgagggacactgacctgatgccagtaggaatgctcacatatagggtgtctgacaagccctgctggagagtctcacccagttgggtggcaagagatgcaggaggacctgtttaaccaagcactttggctgtcccttggtggagggtgtatgccgtgctcgggggaaacccacttgtcttgggctgccggattccgcagaactagcaggaggaaagactaagtctgatggtctgtggagacaacggcaaccctcccactaaaggctcaggcccagggagatcagagttctgtccctgagcccctggctggagtaggacgttcctgcaggaggccccgccagtgaggagggataggtcagagtcaggcctgaagaggcactctggcacagctgacacagcgtggtgctgggctgtgggaatacctcttaggacaagcatccagctacctggtcggtggaagtgcgctggagctatggagatggttgtgccttccccgcctggagtagtgattaaggagtagagtccaggtgggcaaaccgtcaaaagggagtcagcaaggtaagaatagagggaggtgcagtggggggtgggccatcctcaccccaaggaacccgggtaacggaaaccaagcgagtggaagaactcggcactggcgtgggaccaaggccaaggggggcacagcggggggatacgagatcagtcgggcaaggccacgggaaacgcaaacccgctgaaagagggcccccgggaaagggcacacggtcccgagggacgtataaaggaagcggactagacacccagccttgaacacatatctgatgagagggg

SEQ ID NO: 536970 - DNA, 351 bp, Homo sapiens
agcgcctggggtgtacgaggcagtcctcagaaccaggacctataagtgtgctagcgagctatggcgacgaaggccgagtgcgtgctgaagggcgagcgtccagagcagggaatcttcaatttggagcagaatgaaagtcttggaccagagaaggtgtggggatgcattaaaggactgactggaggcccgcctggattacatgctcatgagggccgagataatacagccagatgtaccagtgcaggtcctgaatgtaaacctctatgcagcaaggtgggccacaggatgtattggcatgttggagacttgggctatgagactgctgacgatggtgtggccgatgtgtctttg

SEQ ID NO: 536971 - DNA, 130 bp, Homo sapiens
ttagctcggtaccccaccttggatagccttggcctggattcactatcagtaatcgatatcggcgtgggcatcgaggaacattcggggcgccgcgtggaccaagaacagatcgattggttcacctcgatta

SEQ ID NO: 536972 - DNA, 110 bp, Homo sapiens
atacacaggaacaggacccgtggctccagtacaggacaggtgaacagcagctcaaagagcccatcagggagcatcatggggaagcggatcttcatccaccaagccctcca

SEQ ID NO: 536973 - DNA, 102 bp, Homo sapiens
tactggattgccccaaccaaggctgcacgggatgctatcaaagtatactgtgatttctctacgggcgaaacctgtatccgggcccaacccgcatcacccgtt

SEQ ID NO: 536974 - DNA, 648 bp, Homo sapiens
  misc_feature (192)..(192): n is a, c, g, or t
atctggccggaactattactgattcctacaagattacctttccgggcctttaactcatgcgaacacattgcatcagtatgccggtatgaatccttccacgaagaaagccacctttcaagtgaaaccatcgcgcatctcagaataaggccagcatccccaagccggagcagtaaactgtgtagctttacttgnacatagtcagcagttccatagaatgggcttatgtcgaagatgtttctcaacacaatatctccaatcatcgcgttggtgactacatcaatgaacctcactccaagagtcttgaacacatattgcaaggatcgagagtctctcgagtaacgctcaatcacctcgctatcagcattcactcgggaagcatctttaccaatggcattggcccgttgggtgatgtttagtgtggacagcatcagagtggaatctcccgagtgacgacatgcatcttcaacatgtccagagctggcatcaaacataccccttccatctttgcctgcagcgtccctttctactttgtgggccccgtcacatcattttgtcagcaccactgggtgctcctgagaagctcgagtcgcgtgtactaccaattatttcctctcatctcaatagatcccgggccgaaatcctgcagcc

SEQ ID NO: 536975 - DNA, 888 bp, Homo sapiens
tgatgaattagaactctcgtatgctaagaatggacaagatcttggcgttgccttcaaaatcagatcaacggaagttcttgctggatcggccactgttgcccgacatgttctctgccacagagctgtgcagtatgattttacattgtggtcagaatggaacagccatatctaccaagtacctgaagatgtatacttccactccaggaacgtccccttatacgcgatctgagttagagagaccaaagggggcctgaatgagaacgaaagattcgtgaagttgtggatggatgattggcttgccacggagctggactagctacggctggtgttacgtaaacgagtgcatgcagaaatctccagggaagagtagtcacatctcgttgggcacaatatactattatgcgatcaagactgactcggtggcgaggtcttgaatgaccgctaatggcagatactggcaagaactgaacacagcgtgtttgcacgagagccccccagtgtcttgggaaatttattggagattggctgcccgaaagaagcgaactttgtattgctggatcagacaatctgtgtcgtgctgctggcccatgcaggaggaataagatgtgcctgtttgcaggcgttccagcgtagaatacgctgtgtgtagttatgcgccaaagagactgacacgactataagcaagagaatacatgaagaaaagcatgaagatagcagggagaagacgagcttacacagaagcattgcggtcctcacagagatgtagaaggaaacttgtagcctcccaataggttagctgagatgcttgcgcatgaagatatacctattgttgaaccttcagaaggcaagaagccccataacactcttggagcagtataacggaagaaa

SEQ ID NO: 536976 - DNA, 259 bp, Homo sapiens
gagaagtcacgaggtcgtgtatttgcaagcccctgggggtgttgaccgagtggctggaaaccttgatagtgtattaagcttcaaagttaatcttcttcaaatgataaatctttaattaaaatatctaaaaaatataaagccaactctttgtagtctggctttatttttgcgcaaaatatatacaaattgaaatatcttttttagcacttaaatatttaaaaagtggtaacttaattaataaaacaaaaagaaaatgagg

SEQ ID NO: 536977 - DNA, 330 bp, Homo sapiens
aacgctgtcactaaattctgactgtacattgcctagcgagctaaagcacaacatcgtccgcgagcggtgtctcactcctttaatcctagcacttcaagacgccaatgcgggcggactgcttgaggtcatgacttcaaaatccctctgggcaacatggtgaaaccccatctgtactaaaaacacaaaaattagccaggcatggctgggcgcggtagctcacgcctataatcccagcactctgggaggatgaggcaggtggatcacgaggtcaggagatggagaccatcctggctaacacggtgaaaccctgtttctactacaaatacaaaa

SEQ ID NO: 536978 - DNA, 431 bp, Homo sapiens
ggccattctcctgcctcagccttccgagtagctgggactataggtgcccgccaccacgccaggctaattttttgtatttttagtagagatggggtttcaccgtgttagccaggatggtctcgatcttctgacctcgtgatccgcccgcctcggcctcccaaagtgctaggattacaggcgtgagccaccgcgcccggcagcaaattttaagccaagaaattgaatgttgccagaaccccaggaaccacccagcctcttcccatatgaccacttccccacactctccaccttccttacttctatggtattgatggatggttgggtgacatggactccagtatgtgccatgaaggatacgaagatgaagctgtcatgaactctgctctcgcagaagctacatgtcaaagttggtctatttttaaacttgatat

SEQ ID NO: 536979 - DNA, 519 bp, Homo sapiens
cgcctgaatggctgttagtctgaatctagagttatacccgtcgcattctgaatccaagaactcgcatgttctgaaacattccaattaaaagatatcctccagttcccttcaaagctggatggtgaatgtacaataaagataaaaatcaacaggatactggtattgatcatgataaagagttcaaagggggcactgtctttgcaagatgatgtatcataaagtctcattgggaacccatgatagtgaggtggcgtgttgcaaaggtcgtggcttgacagctcagggctgttggtctgggtctcgttcatcctattatcttaccaggctatactttcacacttgcaatcaaccgggattaaagtcgcatatcttactcagtcaggttccttaaagctggcccgaaaaccttcttctctacggatgttatgagattcttctgaaggttctatgactttagagaccccttattattattgaccgattctggaagtgtgttccaattattctatcctttatcgg

SEQ ID NO: 536980 - DNA, 185 bp, Homo sapiens
acgctgtgtagtctgagctcgctgtattgggactgggcatgcgtgtagacgtatcagcacaggcgcgctgtgttgatctactcatacgggtcttgctaaccgaccgaagcttggtatttcagcgtactgatgcgtttcacagagataggttcgatcccatggtctcgtctacgcagagtgcgcaa

SEQ ID NO: 536981 - DNA, 478 bp, Homo sapiens
  misc_feature (403)..(404): n is a, c, g, or t
  misc_feature (427)..(427): n is a, c, g, or t
gcggccgcctactactactaaattcgcggccgcgtcgacaggtgctgtccctctgggagaggcaggctcagggcagaccctgtgggagttgggccctcaggcctcatccaagctgctgaccatgcgtcacggctccctatttctgtgtgaggagaattgttcctgtctggtgactgtcatcaggagggtgactgtggatttccacaagccaggatggacggcaacttccccagcatgagaaagagccacccaggattggcttggggctgttgacagtggcctgtccctcgctatgtcatctgcctcaccacaaaccaccagcagaaggttcagaggccagggaaagagaggggagccactgggccaggcctgatggtgcacacctgtcatcccagcactttannaggctgaggcaggaggacggctnggacccaggagttggagactagcctgggcaatacaatgagaacctgtctct

SEQ ID NO: 536982 - DNA, 348 bp, Homo sapiens
aaagttaactttgtcatgactgctgtatcagcacatgatccatatttgctgtcacgcttactctacaacgtttattcaattctgtatgaacatccggaagcaaaatcatagtgcacaaatacatttcaggtgtggtcaaaaataagtctctacttggtaaatactaagcattaattttttatagccagtatacacaattctgcggtaccttatagtacctaacggatactaaaggtgtagacactgtataaaacagaaagcactaggatacaaatgaagcttaattactaaaatgtaattcttgacactctttctatcattagcgttcttcacccccacccccaccgc

SEQ ID NO: 536983 - DNA, 270 bp, Homo sapiens
  misc_feature (10)..(10): n is a, c, g, or t
  misc_feature (65)..(65): n is a, c, g, or t
  misc_feature (149)..(149): n is a, c, g, or t
  misc_feature (170)..(170): n is a, c, g, or t
  misc_feature (181)..(181): n is a, c, g, or t
  misc_feature (187)..(187): n is a, c, g, or t
atttcccgantccttgcgcttcccaggtgaggtgacaccccaccctgcttccgctcagcctctgngggctgcacccactgtccaacctgccccggtgagatgaaccaggtacctcagttggaaatgcagaaatcacccaccgtctgcancgatctcgctgggacctgcanactggtgctgntcctantcggccatcttgaacctctctcctgatccctgagttttcagagagactgatttgagtaataataaaactctggtctcctgctc

SEQ ID NO: 536984 - DNA, 1137 bp, Homo sapiens
aaaggaaaagactcatagtcaacgattgtcgtcatcggagcacgtagatgcgggcaagtactaccagtacgtggccatcatgatcgtataaatggcggttggtatctgacgaaagagaatcgattgaaaaatttgaggaaggaggctgctgagatgggagaagggcatcctgtcaaggtatgcctgggatctaggcatagaagctgaagagactgaagcggtgaagcgtgggtcatcaccacttggatatcatccattggtggaaacttctgagagccagcaaggtactactggtgaacgtactcaattgagtgccccaggagcaccggagacctgtatatcaaaaaccatgacttacagaggataatttcagggctgaactgtgactgtccatgagttgttgactgcgtaggtgttggtgaagtgttgaaggctgagtatcgtccacgaatgggcagaccacgagagcatgcccgttctggcttacacactgggtgtgaaacaggctaattgtcggtgtaaacgaaagtggattccactgaggccaccatagaggcagaagagatatgaggaaatagtcgcaggaagtcagcaacggaccatcaagacaaaatcggcatacaaacccggacaacagcacgcagtacgtgccaactactccgggtcggcaatgcgtgaccaacatgcgtggacccccacgcgccgtaacacgccttggcgcccacggggactggaacgcgacacgtcacggatggcaaagacagatggaaaccaagcagcgtgagggccagagaacgaaccatacaccgaaatcgaccaacgaacagcccaagggactgcccctcaaggagtctacacaaaccgggggcaaagcacggaacagctgccgcatgacacaggagtccaaaaccggcagaaggccacactggagcacacacagaacaacgcaggcacaacggagaagagccaccaccagacgaacacaccgcggaccaacggcgaagtcaacacacaacacgagagcggacaacaaagacacaaaaacaaaaccagcgacgcagcacaaccacacaacccacacaaaaaaacgacacaaggagaaacaaccagaatgccgcagcgcagcactacaccaga

SEQ ID NO: 536985 - DNA, 110 bp, Homo sapiens
ttactgtttcctgagctgtaaacgacggcgagtcataactgtcgcctgagtgtaaaaggacggcgagtcttacctgttccctagactgtaaaagaacgcccacgcttacc

SEQ ID NO: 536986 - DNA, 233 bp, Homo sapiens
  misc_feature (4)..(4): n is a, c, g, or t
  misc_feature (7)..(7): n is a, c, g, or t
  misc_feature (46)..(46): n is a, c, g, or t
  misc_feature (218)..(218): n is a, c, g, or t
  misc_feature (225)..(225): n is a, c, g, or t
aaanagnttagtaaagagtgatgaaggagagtataggtgtgtagcnacaaacaaatcaggaattggctgagagttttgcagcacttcaccttaacttaaaaatgtaatgttttagtgcctcagtcaattattaagcaattgatctgagtgctttcaatattttccgaaattaatgtggatctaataaacttccaaacaggtccaccatttttgattcntaacctnggagaccc

SEQ ID NO: 536987 - DNA, 369 bp, Homo sapiens
atcaatggctgtaccttcgcgtatgcgtgatcttgaaatgggtagatctagttgcacccatattcaatcaaaatattttcttggaatgaagaaatgtggctcatgtatctacaaaaagtaaaatttgcagcttctcaggatactctgcatcttcttcacaacctttaccccaattgcctggaacttagcagtcatttgcttgagaatctaatgtttttcactcatgatccatttcaacttggtgaagacagatcacatatattttgtttgttattgaatccccagtgccaggcacatagtgctcaaaaattatttgctaaactaataaagattcactaaaaaagaatacacacagattcactaaaaaag

SEQ ID NO: 536988 - DNA, 390 bp, Homo sapiens
  misc_feature (360)..(360): n is a, c, g, or t
acgtttgttaaaggtaaaagttcatgtgaatttcctttttaaggaaatcatgggctttataactgtctaagcgcctgtaagtttcaaccggtttagtggtttctgctttcaccctgtgcatagcaatgaagttgttttattccaagttaaatatacaaagtataaaaatagatgaataaccagaatactttgtaactattgagtggtacatataattatgtgcatatattatcacatttaatcatcaaaacaatcctataatgtaaagtctactattcccattttctagatgaaagaacagaatagacctacaaagtaacatgttcaaagtcagagctgtgactgaaaccaggtatctgnctcgttgcagtcctttagcagtatgccttc

SEQ ID NO: 536989 - DNA, 201 bp, Homo sapiens
  misc_feature (67)..(67): n is a, c, g, or t
tgagattgcgccactgcattccagcctcggtgacagagcgagactcccatcccaacacaaacaaacnaacaaagaaacaaaaaaacagttggccctcccagactccctcctggcagtaaatcgtgtaggcctctgcttgagctgggtcttggatatttggttcatttagaagttcctgtcgccgcagcctcgtgccggtcc

SEQ ID NO: 536990 - DNA, 629 bp, Homo sapiens
atcaacaaacacaaattgagggcggatcggatggatcggatgggtgctgtggtgaaccaatgtttcagttccacaaagggtctgtcgagcgtggagacatgtgaatggtacttgggagagatgagtgcgagaggagggccgcagggtgatgtaacccaaatgaaagggggtagaagttagcaaaacccaggaaacggttcaacgtggacgtattttgaggcaatccaccggtgctttcaccaggatccatctggacatttccctcagcgatgatatatcccagaaaggcgattgtagagcgggggaacttacacttctcgggctttcacgaaagttggttctcgaggaggtgctgaaggacctgtctgacatgaagaacgtgttcttgggcagaccgggaaaaaaatcaggatgtcgtcaaggtagattgaacacaaaacggttgagcatgtcccggagcacatcgattacctggaaagacggtatcccgaacaggtggtaggtctagctggaaaacatggtgacctctgcgcagtcaaaagctgaggagagagtgtatgggtaagatcttaacataatgtaattagacccggtaggcaatgctgctaagttgggcgccaacggaccga

SEQ ID NO: 536991 - DNA, 595 bp, Homo sapiens
ggcctaagcgcctttactttattaacgagggcgctaaagatggacaacatctttgacgccctgcatggaacacaaacataggtttatggttcggctgggcactgtccagggaccagggacttgtgtaaacgctcttcactcgctttcctaaacaactgtcagaaacgacgaagcctctctctgattactcaagaggaattcgtaaggtgagactttcaaaaacaatgattgccatgcacattgctatctgctactgatagagcaggcaatgggtacttacgcatcctcatgagggcggcttggcacagcagtaccatttgacgtatgaccgttcatgcccggcttcgtggtaatgacggcaccgcgacaacgagttgccataagtattcagaccctcactgacggctcgacgttggtttgtcacatgccttgacacagatcgtaagagagcccttgacacgtgcctttaaaaaagacatagtttagtcttatgagcggggcttttattatggccaagctgaaggcgctctttacttgcttgataacttatagttagcggctgcctttcaccacatgtcatgattggcacatctct

SEQ ID NO: 536992 - DNA, 145 bp, Homo sapiens
acgagatatgggtagctctgacgggtgcattggaaggatggtctggtaagatgttgttgcggtcagtacatgatagtcccctgtgctgggggaagacggaggccgttgtgcgggcttctccaggtgggctcctggtgacgctcct

SEQ ID NO: 536993 - DNA, 361 bp, Homo sapiens
aagtgttctcaagactgatggttttgtaaggggcatttccctctttgctttgcacttctccttcctgtcaccatgtgaagaaggatatgttgcttacccttccaccatgactgtaagtttcctgaggctccccagccctgtggaaatgtgagtcaatcaaatctctttcttttatacaattacctagtctcaggtatgtctttattagcagtgtgagaacagactaatacacccagaaagaaatccacatacctacagcaaactcatttttgacacagatgccaagaacacatacttggggaaaaggcaatctcttcgataaatactgctgggcaacctggatatccctatggcgcagtaa

SEQ ID NO: 536994 - DNA, 405 bp, Homo sapiens
  misc_feature (66)..(66): n is a, c, g, or t
  misc_feature (328)..(328): n is a, c, g, or t
ggcggacctgcgtctcaggattaatcaaataatgtatttttcccagcacaagctgtgtaacactgncaggacatagtacctgcttaataaacgttacgctagtacatgtgtacatggtcgttttccaaatgcagactcattcaaacatgctccccttagtttcctctgtagactttaaaggaccagcaaagaatatgatacttgaggatggagatcggttgtctttatttgtgtcgtgacaagagtgctgagtttaagggagtctgtgctgtgcctgctttctccaactaatgctaataatgagcccaggaagagcaacatcagcatngacagaggatttgtttaaaacacccattcatggaccctttccaaacctgcagaatcacattacatagagtgagacag

SEQ ID NO: 536995 - DNA, 262 bp, Homo sapiens
gtgtgtgctgggcaggcgtctcggcatgcacaggggggtcttagatggcatgctgatggctctggcccagacagagggtgctgtgcgccacgatctttacagctaaggctggagacatctcatggatcacgggcctgccagtctcatgatacagcctggctgctggtggacgagatttaagacagtggtcgctggagagacggcagaagtcccgatgctgacataatctgtgtgtgcgctcgccgatgatgagcctcccaag

SEQ ID NO: 536996 - DNA, 1770 bp, Homo sapiens
  misc_feature (148)..(148): n is a, c, g, or t
  misc_feature (1477)..(1477): n is a, c, g, or t
  misc_feature (1770)..(1770): n is a, c, g, or t
gtgaggggggtcaggttcagcgcgtcgggacatcctaggatgttccgaggacgttcgaggcgctggctgcgtcatagtgacgccgggcatgccacttgggcgtgattcacgtctaggaagcccaacacgtgtgtgacgagaaccgagnatggtggttgaactgggagttgtgcctgaccggcgaagtacagacggacttgcgttgcagcatctgggctggaatctccatgcagtgtacgctagcacctctgagggtcagagcttgcctagggaatccgtaattatatcaaaccgaagggtattcgatgcttacaaggacgctggggaagcctacatgtgtgacttgcggatagctcgcgaaccggcgctctcgtgtgcttggttcgccatgaactaccgccagttcgcccctagaggcgttattgaggtcaacgcaaccactagcttccatgttgtgaggtgaccactgcgccacccttgcacggctacagctcgtgggtaccagtgggtgtttagcctgccgagcgagcacatgggatgggcgagggacacccatggggttctgggcgtacatgagtgcgttacgatgcgcggcggacacggcagctacttgtggcggcgacgcgagccccccattatgtcatctgtggcggccttgagagccgcttgttgcccagccacgcggacgtgaatgttcacttaacgctagtaaaggcttccggccacggggcgctcgaggttagcggaagtggaggcacttgtcaccggccttgccctttagttgggggaaaagctcgctggtcggttacccttcccacttttggggccagacttgggccattcggcgcttggttcttataccagccttttggctttgcttagtgttttcgcctgatcttttgctgcgcgaagttctccccccaactgatgcccatggggagcactgggatcgctggcttttttaacttccgagttggcgcctttcagttcattcctcctttggagggggccttccccctttgggtgggtttggggctccccatttcacacgagccccagctggcctttgggttcttttggggcgcccttcacacgcggtgaccgaggccccgggtgggatgtcccggccgattccaagttggtttcccgacaggcgattctcacggcgttgccaaacggacggtgagcgccaggcggcaattaacgcaagccgaacctccccctccttgggcattgttttccccctctcccgacatgggcgcggttggggcccttggacgcggacccacggtgggtcccactctcttccgacgaccaccaggggttttcaagaagttcacaccagtgtccggtgtaacttccaacgcggcctctcctttgccagagccactcagctcttttggcggcaaggccgggtcacagtgtcgctgacagtcccgttgacctcctgtcggagaaaccaccaaacctgctgttncaagataaaggcctgaagagagaactgacgaccaaaacacgccacaattataagaacaagatccccaatacgaaacagaggggtgtcaacaacgaggtgaagactaacgggatgactgccacaacatctccttggtaagatagcgaccacaacgaactgaatgacagtagatgcacaactgatacaacatcagaacattagagattagactgacagcaacgactcagcatatgtataaatgatatggcagtgttgttctttttttctgtgctctcgttactagatgtcagccn

SEQ ID NO: 536997 - DNA, 203 bp, Homo sapiens
  misc_feature (13)..(13): n is a, c, g, or t
  misc_feature (35)..(35): n is a, c, g, or t
  misc_feature (101)..(101): n is a, c, g, or t
  misc_feature (137)..(137): n is a, c, g, or t
  misc_feature (168)..(168): n is a, c, g, or t
gctaaccaaaatnttcccgactggttcccccaatnttcattagaagctggtaatagggagacccacgtaacaagtgacaggtaaaggttacaacaagggcncatcatgaacatgtaaattcgaagcaggggctgttnccggaatactttagggaaacatcaggattanggcataaggcctcatcatgatggcatgttgggggt

SEQ ID NO: 536998 - DNA, 386 bp, Homo sapiens
  misc_feature (13)..(13): n is a, c, g, or t
  misc_feature (163)..(163): n is a, c, g, or t
tttgaaccctaanaacagcttaaacagcaacaagtgcccaaaatttgaggtccttacctatgtgccactttaccctgaaatcgatccctcacatccctatgaggtattattatcccctgccttttcagatgaagaaactgaggtttacaaagcctagttaaanggcagagcccacgagatttaaacccaggtttgacacccagtgccccactcctcttcacccactacccatttgggagtaacctgcccttcccaggacaaggaaggatagtcctctgcttttcccagaattagcaaaggttctgattgacttgataaggtagtctcaattgatacggatgataggactttgaggagggaaaggtaataaagcttacacttggtca

SEQ ID NO: 536999 - DNA, 1356 bp, Homo sapiens
gtggccgggaggactgtgcgacagacggagtctggcgtggccgcaggagtgcggagtcatggagtaaatgactactaccagacgttgggcctggaccgcggcgcgtcggacgaggagatcaagctgggcctaccgcacgccagtgcgctgcggctaccaaccacggcacaagaacccatggaagcccgggcgcccgacggccacacagtttccacggcaccactcgcttggagggacctcacagaaactggtgctcacaggcggaagcccggccgacaaagcgcagaacgaattcctcacgacacctgactaacgcggggcaaagcgcaatgggcccctcacaaagggaggaagagttgcgcccccacatggtctgtggccagggaacacgcggcggccgaggatcgaggttgcacagaaaactaggggtgcaaccaccttctcgattgtataccgatgctcgtataacacacaccatttctccccatctgtgggaaacgaaaccccgcctcgtacaacttggccccatcgtggttagatctggacctacgaacagcgtatacaaatatcaccagggtagtggggaacacgagccaaacttatccccacttttatgtagtgaacccagacccaaattaatatcactagctgcgtgagtcagccaacggagcgacgaacacaactagagccagacaactgcggaaccacagtggcgccaacaattcgggcacaccaaagttcgtgcaagcagtcgaacaacatcccacacaagatatcaacacagtccagttggacagccaatcgccacaccgcacatataaccttcgagaacgccaaactctagagagcagtcataggcagggcagatacaacaacacgcaaaccacaagcgcgcgagtgcaacacacagcattcataatggggagcccaaccggacaacccccgccggggacaatctccaagtaggcccgaccaactaaaccagcacacgtcgccacagcgaggtcaaccgagtcaggaaacagcaagcagacaaagaggtccaaggagccggagcagtcagcgcacccacaccgacacagctactagactacgccacccaaatcgagagaaaagccgtatcttctgagtgaacgtaatatacgtccgacccgcagtgctcgggagcgcagcgcaatcgccacttctccactacgagacaagcaacggagaacgactgtgcgagacgcgccacgaaagcgacacaacgctcatctgtgaacacccagactagcagcccaccccaagacagtcaacgacggcggcagtaacatgagcaccccgggaaacggggacaaacagcagaagctacaagtg

SEQ ID NO: 537000 - DNA, 745 bp, Homo sapiens
  misc_feature (9)..(9): n is a, c, g, or t
  misc_feature (107)..(107): n is a, c, g, or t
  misc_feature (141)..(141): n is a, c, g, or t
  misc_feature (147)..(147): n is a, c, g, or t
  misc_feature (164)..(168): n is a, c, g, or t
  misc_feature (174)..(174): n is a, c, g, or t
  misc_feature (181)..(181): n is a, c, g, or t
  misc_feature (188)..(188): n is a, c, g, or t
  misc_feature (196)..(196): n is a, c, g, or t
  misc_feature (221)..(221): n is a, c, g, or t
  misc_feature (226)..(227): n is a, c, g, or t
  misc_feature (229)..(229): n is a, c, g, or t
  misc_feature (232)..(232): n is a, c, g, or t
  misc_feature (257)..(257): n is a, c, g, or t
  misc_feature (278)..(278): n is a, c, g, or t
  misc_feature (342)..(342): n is a, c, g, or t
  misc_feature (346)..(346): n is a, c, g, or t
  misc_feature (353)..(353): n is a, c, g, or t
  misc_feature (356)..(356): n is a, c, g, or t
  misc_feature (388)..(388): n is a, c, g, or t
  misc_feature (391)..(391): n is a, c, g, or t
  misc_feature (402)..(402): n is a, c, g, or t
  misc_feature (429)..(429): n is a, c, g, or t
  misc_feature (447)..(447): n is a, c, g, or t
  misc_feature (456)..(456): n is a, c, g, or t
  misc_feature (458)..(458): n is a, c, g, or t
  misc_feature (465)..(465): n is a, c, g, or t
  misc_feature (583)..(583): n is a, c, g, or t
  misc_feature (702)..(702): n is a, c, g, or t
aaaatatanattcacggaatataaaattcataaataacatggaggaaaactgtaaacagtgctacgaaatttagcaacaaatacattccttctagacagggttcganatctcttgttggtttctactccatcacttctggntttcangacaacagaatggatannnnnaaaggnggatgcngggagantctaagangcctctacccccaaagcaaaaactnttctnnangtnctccccttcctctcgcctccaaagngccaatttggaagttgttgtnacatccacctcccctactttccattttgttttgcttttgccatcagatttttataatgtttgtntctnataaaantantctagtgacatgttaaccttaggtagccagangcnaaacatttggntgccatcttggggtagtccagattgtnaattgttacatgcaaganagaggtctngngcatggnagggtagtgtctcctgggggccacagtttgccctagacagggctattccaaaaagtcatttgtttctttaattgattcaaagaaccatgttgccaccatgaggcaggtctggaacgtnggggagggtaaaagacaggagtctcccagtattacctaccctggacagagcagagcactggcccgagagctgagagcctgagcatggagcttccttgattgggaggcagaagaaaaaanaaagaggaagcgagaacttggattgtatctccatggccctgga

SEQ ID NO: 537001 - DNA, 146 bp, Homo sapiens
gcagctgaaactcgtgagagaattccagcatggtatatgagagatactttcgtatcttaatggtagccaaacgaaaaattgaggtccttatggagatgatgcacagatttatttttaaaaaataagacaacctccgggtgcggccg

SEQ ID NO: 537002 - DNA, 308 bp, Homo sapiens
gaccagtctaatcaggatccactgcaacgtacaacaggcattataccatctgctggcgcattgatgatgtgtgagcacgcttattacctacagctataataattgtcaggcctgctttatctacaaagcctatttggaagtgtaatcaagctgggagaatgtaactgagaatatacatggcttgcaagaaagtaaaccacgatccttatgctgatcataggctatggctgccaccgagataatgtcctgtcttctaagatgtgcatcacgcctggtacatactgaaaaccctattagaactggcttgc

SEQ ID NO: 537003 - DNA, 150 bp, Homo sapiens
cagcagatctctgctcttctctttcagaccctatctgtgcagtgtgacaaagtagagcacgcccatgctcaacagtattattccctaacgaccttctcatatcactccctccactctctaaccaagcacccaaagaggattagaactagc

SEQ ID NO: 537004 - DNA, 109 bp, Homo sapiens
ctgtagatcgctcggaagggtgtcttgagattatcatcctgctcagggtggaagcggccccggagacgctcggaggtgtcttgatattatcatctgctgagggtggagc

SEQ ID NO: 537005 - DNA, 233 bp, Homo sapiens
tacaagagagagggtcctctcttgctcttacagcaactggaccctgtcgttctccatctactcagtcagatagtttcaagtgttcctgataactcctctccttctgttaccatcatctgctcattctttctttgcatttcctgcaacattttagctagaagcctgtgcagactcagctttcacacgttccacttcaatctccttttctttttctgtgagggtcagtatagata

SEQ ID NO: 537006 - DNA, 300 bp, Homo sapiens
aaccaatttttatggctccaaaaataatgtaaaaatttctagggaaaaaattacagataatccactactcagagatcacaactcttaaccttagagttgctccttttagctttatttttcttcagcaaatgtctgtgtatttatttacattctcttttatagactcgggtcattatatatataaacatataaatagtttcggatcctattttagcactaattatatcttccgagacactcaaatttcttccctttgttaaactagtgatacatccttatttataaaattagaaaatgcac

SEQ ID NO: 537007 - DNA, 294 bp, Homo sapiens
gcggtcctccagtccggatctccttctacgatctcttacagatagaagaacgtctcgggtcttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaatc

SEQ ID NO: 537008 - DNA, 170 bp, Homo sapiens
tttgagacaaacctgggctaacacagtgagatcccattcaaaaaatcttataaaaattggctgggccatggcggtcgccacctgtagtcccagctacttgggaggctgagatgagagggtccttgagccagaggttgaggctggcagtagctatgatctgccactgtttc

SEQ ID NO: 537009 - DNA, 424 bp, Homo sapiens
  misc_feature (346)..(346): n is a, c, g, or t
gtgtgctgaggtgatctagaggatcccgagctctctctgtgggggagagggtagagccggagcaggacatacggtggaggatcatgatgctcgtggtggaggatcatgatgctgtcgaggagggagaaaatccacggggtcaaaggaagaggagtcatcggctgggtctgtgggtggggtgacgggagatgagtcgggtttggagctgttgagtaggatgaggatggtagatcaggagtgggggaaaggggggtggtaagggagaatgccgatggcttggcccatggagagagcgtcgggtagggaggtcgaattctgaagatcgtggtcatagatgtaccacaantcagactcttcctctcacttcagcaaagaagttatttttaaaagcacttgggaagttcctcctccaccccacagagag

SEQ ID NO: 537010 - DNA, 611 bp, Homo sapiens
tagagcacactgtaatcgtgactgatgagaagtatcgttgataacctgctacaaaaaaaaacacacaataaatataatgccacatgccaaagaacacaataatcctatatttcagggccagatacaaaactcctgccaaatctttgtaatttattgtgcaaatcagaaggttatgttgcttctgcttgattaaaaactagaaggggcagacacacaagaccctcttccactacaggcaatataaggacaccagtggcatgttgtaccttacaacaagaaatttcttaaaaaacctgtgtttctcaaagatggtactaatagttgtacacaatacagccaagttttaaaagcaattaagacatattaaactgtgcagcaggtacttttcacatttatgtgcaagggaagatctcatgatgactacaataaatggcacctatttcttccctggcatagggaggtactaagaaactaaatgatcgtatggcacatgcttgaatcataataagatgggctaaggaatctataaagtatggaggtaggaagaccccatatgtcccggatcaaaacattcctcatatagaggtagtctagtgaagctgttacatgta

SEQ ID NO: 537011 - DNA, 290 bp, Homo sapiens
gttgactgtcctggccacgatattttgatggctactatgctgaacggtgcagcagtgatggatgcagctcttctgttgatagctggtaatgaatcttgccctcagcctcagacatcgggacacctggctgctatagagatcatgaacttaggcatattttggatcctccaaattaaattggatttggtaaaggaaggtcagcttaaggaccattacgagcagatccttgcattttgtccagggtacagtagcagagggagctcctattattccaatttcagctcagctga

SEQ ID NO: 537012 - DNA, 484 bp, Homo sapiens
  misc_feature (170)..(170): n is a, c, g, or t
ctggttggcgttgcaaagggggtttatcggcctccaacggatcccccccaaaattttggttgtgagctgggggcccaaaccccgttttatgttaaaaatgaccggtccattgtccatgggtttccttagggggataaactgcccaccctgtggggggggatccttttaanaatttgttctctgtcccgaatgtgagaatcctggaacagatttgcatggccatcccaaaaagccacccatagggaattcttgtaaagcctgtggctatcggggcaggcttggcccccctcataaactttgccccttctttttccaaaacccccctgagaatagggcccggggggccgggaagaaagaaaaagaaaaaaaaacccgaaagggccaagcccaggaaaatgggcccggttccccccgtgggacccccccccccccccccccccccccccccccccgaggccttttataaagatggggggggttccca

SEQ ID NO: 537013 - DNA, 283 bp, Homo sapiens
  misc_feature (135)..(135): n is a, c, g, or t
  misc_feature (261)..(261): n is a, c, g, or t
  misc_feature (270)..(270): n is a, c, g, or t
attttagaatttctaagggaatttaatgaattctaacagataaccactgactatgagaattactttatatagataatcttgactgtaaaacattttgaccagtgtttacaacatgtcataagaatccccataatncactagagatttgaagaattggcttgtatagttataccaccacagtagaacattctacttgagagattcagtatcccctaatgtgtgtattgataagtactaaaacccaaattgtgcaggtttctnacatgtctngcttgttgctgtg

SEQ ID NO: 537014 - DNA, 273 bp, Homo sapiens
cccgtccttcatcatacctccatagcaacattacagataggaactgttgaaaaaatgtcatcaatgtgtcgaaaccatggtgaaggctaaagaccagcaagctgcagaaccacatagaatgcgagtattcttttaaaggaacttgatctggaaaagtcaagagaagagagcagaaagcaggctcttgctgctaaaagagaaaaaagaaaagacaagagaaacaagaaaaaagaggaacagaaaaggaaacaggtaggtatgatgaaggacgga

SEQ ID NO: 537015 - DNA, 154 bp, Homo sapiens
cctcacactgggttcgagttcaagacagcctggtatacatgtggtgaaacccgtctctactaaaaatacaaaaaaagtagccagttgtggtggcgggttcctgtagccccagcaactcaggaggctgaggcaggagaatcgcttaaacccggga

SEQ ID NO: 537016 - DNA, 886 bp, Homo sapiens
  misc_feature (255)..(255): n is a, c, g, or t
  misc_feature (518)..(518): n is a, c, g, or t
  misc_feature (594)..(594): n is a, c, g, or t
gtgcagaaccccgtctctgcacgccaggcgccggcctgtacccatcctagtggtccatgacgtttcatgcagtctgggaagagaaagatgtgcgccgtggttggagcacgcccaaaggctttgaagtggaaatacgagtgcataggcaggctaccgggaggtgggcaagtagcgttgtgccggaagagagatggcgcgccacactggctcgaagcctagactctgtatctgatcacatatgtgactggttcaaanacacgcacaccgatcacacaagactgtacgaagcacttgtggagaaaccatacacgaagtcttgtcgttgatagcccgtgtggacgacgtaagcgtcttgaacgaatagctcagcacgcttgagtggtcatgaaccaatgtcacgacctgatgtgctgacgttttccatgaatggtggcattcgcgttcgatgcactctacggcacgtcgggactgggcaacggatagagcacacattacaacacaagatacatacttgcaanacgcagtgcggaccaattgagctgcggtaggacggtgctgtcacttgaacgaatgtccaccttgatactcgggatncttatgcaaacaagcttaggaatacaaaattgcgcatgcatgcgactttggcagcagggagattcaattgaacgagcaatgcagccaagactcagcttcaatggagccaaatctgccatagctgtttctttctttatctgtgcacttacgtgtgttcaattatctgtatccataaagcattttagcctgcagctatttcaaagttgtgtaggactcaattaggagtcatccctttggcttaataacataagaggctgttgtggctattacacacacactgccgagacaggcg

SEQ ID NO: 537017 - DNA, 146 bp, Homo sapiens
ccccgagacaacatcgagtcttctacttcagcacctgttacccacgtgcacatccccgttgtggaggacgggaagatggaccggcagatgttcctggccacatggaaggatattcccaactgagaatgacggctacgtggcgcctg

SEQ ID NO: 537018 - DNA, 328 bp, Homo sapiens
  misc_feature (186)..(186): n is a, c, g, or t
  misc_feature (259)..(259): n is a, c, g, or t
aaacgacccgaagacggcgtggccaagggtggtgagaaccggagaaccccaggacgcctcactgcaggctcccctcctcggcttccttcctctctgcaatgaccttcaacagccggccaccatgatgtcgcccttactacacctgagcgctccagcttcaacgaaattacgtggaaggcttccacntagggtccaccatggagttctcccaccaccttcaccatgtttccatggtggtacagcaccagtgacgccctcngaggttgctctggcgatccccccacagcccctggtcagtctgccctcgtcactggtcttcgggtcgttt

SEQ ID NO: 537019 - DNA, 409 bp, Homo sapiens
  misc_feature (193)..(193): n is a, c, g, or t
tctagaggatcccgtgaatgatcagagagttggtattctccagatgcatcgaacaaatcgcggggatttggcgaagcacacgtatgaaaaaagctcagacggcgcgtcttattgatgtttgaggggtattactcatgggtagagactggggaggcgtccgcgccgcgtctgccagtggtatcgagatcacgtnccgataccagggcgtcccggttgccgtgagcgtgtccagctcaaagccagcgccgctattatacagaaggcagagtttgacaaggctgcgatttgagcacgccaattctcgcgggtacattcgattacgctctaacctttccctaactccaagaaggctttgggtttcaagactccggaagatagccagagcctgggcgtttacttgggtttgagt

SEQ ID NO: 537020 - DNA, 1370 bp, Homo sapiens
  misc_feature (1122)..(1122): n is a, c, g, or t
gcacacaccatgtaccctggtcattgccgacaggatgcagagatgtaagatcactgccctggtcacccagcacaatgaagatcaaggaatcattgctcctcctgagtcgcaagtacgtccagtgtggatcgagcaggctccaatccgtgggctctcgcatgtcctagcgttacacagcctagaatgtaggatcgatgcgaagctagaggagtatgcacgagtccaggccgcctccaatcgtctcacgcgctaaagtgcattactatggcgagacgtagtgactatagttgtgactgttaacatccgtatatcgttgacgaaaaccctaaacgttgcagcgaggaagaactaaggattgagcattggcaataggctgttatttagtatgtaaagcattcgtcttaagtactcagggttgccctatttttatatttgttgggcatagagcattctcagggatgtgaagacaattgggacccggtcggacgtgggtggacaaacgatacgaccgtgattggagaatcgataggttttcacccacgaaatatgtgtccacaattggtgggtcgagaggggcacttcggtagtacgcgcatattgggttgcgtatttgtgtcaaatcatgtccgatgctcaagattatgaggatgcgcgtgtttggtatccacaagcgaaaatatccccctgttgcccattcccgtaaaagtacgccaccaccaatattcctcatcataggggcaaatagtggcgcccagagtcgcttcatcctcagagatcccaaccacagagggcggacaggtggtatagcatattggtctttccgcgtttgtaacacatagatggtaatgcgcgacaaattgtttgggttcattgcgttatcggcctttgaattgcatgtgtcagaagtcaggggtggccaaacttgggggaaaatatgattgaccgcgctttcgggtgccccccccccgttacccccccatctttgtgtgtcccccccgaaatttggagaaatgcttatgcaacggggcttgtgggtcctctcctggaagattggtgtgttggaacgggccacgccaggggggtttacccgtgttaccaactggactgttgtacaaaccccgngcttgaaatttaacaaggtgtgcagcacgccgttagaagggcaaacacaaacaacacacacagccaccggaggggcaacacatagtatggggtgcgcggaaaaaacaaggggtacatgaaatggccgcagagtcggccatacgacggtattcagaacaccacgtgttttggtaaacgaacggtggtacacgttgggggcggccccccaaagagacgcgactaatacacgaaaagcacggttacctgta

SEQ ID NO: 537021 - DNA, 140 bp, Homo sapiens
  misc_feature (6)..(6): n is a, c, g, or t
ccgganaatgtagatactgtgctgtgggcaaatttaaagttgaactaagatatatatcttgcgaccatccagctatcaccaggctcggtaggtttgtcgcctctacctataactcttcccacagttatctacatttccgg

SEQ ID NO: 537022 - DNA, 301 bp, Homo sapiens
ggggtgggccccccctttgggccccccgggttttcccctttttccccccgcccggtttttgggggggattttgggggggaaacccttttcccccgggggccccttttgccttttttcggatttttttcccccccccctagggggtttggccccccgggccccaaatttgggtccccccggcccccccgggggttaaccccctgggaaaaaaattttttggggccccggggggcctttttttttttttttttcccaaaagggtttgctttttttttttccccaggggaatgggggggaatta

SEQ ID NO: 537023 - DNA, 124 bp, Homo sapiens
atatttcaatcgaacaaaaaggaaactttttttgaacttattgaggctctacttaagtacatcgaaacccttaatgcttctggggctgtgttgatttccttgcctggctgggggtttgattcgc

SEQ ID NO: 537024 - DNA, 118 bp, Homo sapiens
gagcacaaatgtcagtcaaagagagctcagcagcattgctgggagccaaggcatgtggagtttatataaatctagggcaggtcgatcttggcccaaccctatggttaataggcctctt

SEQ ID NO: 537025 - DNA, 453 bp, Homo sapiens
  misc_feature (267)..(267): n is a, c, g, or t
tagcaacctctgggacttgtcccttgctcaccggataccccgcgcccaggattatggctgagccctggcccaccaacctgcctgggaagtgcaaagtggatggacgggtttaaaggggaggggcgaaggtgctgtaaacaggtttggccagtggtgggggagggggccaaaaaggcggctcaggttgcccagctttgtggcctcaggactttttgcctcacccgtttcagcccagggcccctggagaatgatcccctttgagtcctntgccccttccaaggacactaatgagcctgggagggtggcagggaggaggggacagcttcccccttggaagtcctggggtttttcctcttccttttttggggtttttgttttgtaatttaaaaaaagctattcatccctgtaattattattattttttccaataaatgggccctgggcccaggagga

SEQ ID NO: 537026 - DNA, 581 bp, Homo sapiens
tgagcggactgggtgactagagcaagaccatcctgtctcaaaaaaaaaaaaaaaaaaaaaaaaaaaagggaaaggaataaataaagattaacggctctttgccccgcagcctgtgcatcatctcgacactggcgctcaccaagtacacaagacgccctctgcatactcaacttacctaagacgaggttttacgcacaggaagtgtcggtagtagcaacaagggcgcgtcgatcaccgtgaacccccggtgtggacacattggttaaacccggcctccaacagacccatgagcagcgcttatagtaacatacaggcgtaaacgcagcggcgaccagccggcgcgcttccagaagacagacaagataggaacgaaccgccgtggagaacacagccgacgagcgcgtcgctccgaaacaacacgctcgacggcggcgggagagggcgacagcaaagggggagagagcagcaaagcagcgccagaaccacaccagtccggagcaggagcgacacaaaggaagggcaaaggacagaccatacgggcgcaagaaggagggaagcgtagcgcgacaccagagcaaaaa

SEQ ID NO: 537027 - DNA, 262 bp, Homo sapiens
gccccggttgttgggaggtttctattctaggaggagggcaaggggatcagaaagttaaaagtaaaccatgtatataaagggcacgctaaaagatatttattaaaatctttttttttaaattacatttttagggtagggttctggggtgctggttatgttccatttcttgatctgggtgctgggtgtattacctgtaagaatgcaagctttcagcacttctctggaggtatgctgtacgtcaataaaaagttcaaaaattaaa

SEQ ID NO: 537028 - DNA, 1128 bp, Homo sapiens
cagagttgtcatagttatctagcaggtctggagggcaagctgtgcagaggcatctaggcgttgggtccagagaccaacgaatctgtgcatgagcattcctatccagaagctagcaggataacatactgagcaagcgttcgatccataccacagattgccatctcatggtgccagacgagaactatcaaagtgacatcgtgcatggtgccagggacgctcagcatcgtgaagacatagagctttgatgatcttgtcccggaggtttgaagagctgaaaaagaaaacataggtctacttaaatcaggcaacttacacagtatagggagtgagactgagcaattttactccttgtaacgaaagaatctaccatgaaattctagtaggtcaatctgttaagccgtcactcagacagcaacactaccctctggagctctcttcctgcatcctccagaatatctgagtgctttaccaggtacatcagatatgatccgtgagactaaacaactaggacgactgaggccaagagccaacttggactcctgaggaggctgctgctaggtaccgaacacctgtccagagtgactcccaggtacacctcctgggcccgagcacaaggatccctccacaggagtgtgagaggactggggagaaagcacatgagggaagaccaccaaagatggatggacagagggagagagcacgaagtgaaagcatcacagactcgcgagagggccagcacttcgaaccacacaccgtctgtacaggaggcaaggggcgagtgggaatccagacacacacggcggaaccaccacctaggagggcacgggacaggcaacacgatcacaggaacccaagacaggaccggaagcagaacacccagtggacagaacagacacctaccgcagagaggaaccaccggggagccgccctcacacgaagcacggaccagaaggacccgaagaagacggggagaccaggaaccaacagggaatcagagagagggagcaacacacgaggagcggcaagacgaaccggagagaggtgaacataccgccgaaggaacaaaaaagagagcgcgacagaacccacaaggacaacagacgctaagaggcacaccacgggcatgag

SEQ ID NO: 537029 - DNA, 279 bp, Homo sapiens
gccccggttgttgggaggtttctattctaggaggagggcaaggggatcagaaagttaaaagtaaaccatgtatataaagggcacgctaaaagatatttattaaaatctttttttttaaattacatttttagggtagggttctggggtgctggttatgttccatttcttgatctgggtgctgggtgtattacctcacagtgcaaaacagctcatgaaggagactcttaagggcaccacccaaagcctccctctggcagcctggcccacctccactcccag

SEQ ID NO: 537030 - DNA, 224 bp, Homo sapiens
  misc_feature (148)..(148): n is a, c, g, or t
  misc_feature (169)..(169): n is a, c, g, or t
gattatgatgaggaagccccctctgctttaatccacacaaggaacgtaccctgaagtaacctgatgttaaccaatctgctgtgtctactatgctgtttccttgttcctgctagtgctgctttacaaatgcagaccattctatcatacntggcagggcttctgttttatnttgtaggctggatgctacccagttcatgaatcgctaataaaagccaattagatct

SEQ ID NO: 537031 - DNA, 658 bp, Homo sapiens
  misc_feature (1)..(1): n is a, c, g, or t
naggcagggccatctgggacccaggcagtatccagtatggttcgaactggccctctaaaatggtcctgtgtccacttaggggcctgtggtaagcctggcactcaagtgtgcattccctttgtgtagcaatgccatcacgcaggctccacggatctccctgtgccagtatcagggcccacaagggtctgagccatctctcgtggctaggattacagcaggtggtgacaccgtggactgatggggattgctcacttattctgtctccacgttgggaagctcatctggctcccagccaatcatgcttgggttatccacgtcgctaccctgtccctcagtgcctcatgtgttatctgtcacttctatagtgaattctacacctctagtcggtcatcttgaaagactcgggcccttatatcttcgacaatggctacaagtagaaaatgtgaggcctaggaaaaagctagcttctataaaagaaatgtgaggctcaggggaggatagcgggctatagtgtcgctaataaaactaatctcaatggtttccaataagaggaacaggtaggcctggcgcgcttgctcagacctataatgccagcactgtggcaggccaaggcaggcggatcacgtgaggtcaggagttctagcccagtcgggccaac

SEQ ID NO: 537032 - DNA, 145 bp, Homo sapiens
ctgtctgctccctcagaggtgcctcttgatgtgcagggccaggtggggagacctggaaaaacacctgggtgggcaaatgagaagcacagaacaagttaggggcccatcccttgtttttttctggaccagcgccctgacctgcctg

SEQ ID NO: 537033 - DNA, 510 bp, Homo sapiens
cggccgctactactactaaattcgcggccgtacgacctagaggcgagtaagtgaggaatttagctatggagtgagtaggtaagaaatttagcaatgaggtaaggaggtaagggatctggtcatgaggtaaggaggtaagggatctctccatgaagtaaggaggtaagaaatttagctatgagataaagagataaggaatctgtccatgagataaataaataagggatctggccatgagatcaggggtaagggatctggtggtgaggtaagcaagtagatttcccattcaaggcaggcgaatggcaaatgtagaccctgaggtgataatgtgcttactgtatttgaagaacagcaaagaagcaaagtgagtcacatggaagtgggggaggtgcattagaaagttagtagagggctggtgctatggctcatgcctgtaattccaatgctttgggaggccagattgggagggttgctgggcccatgagggttgtgctgcagtgagctatgatt

SEQ ID NO: 537034 - DNA, 406 bp, Homo sapiens
  misc_feature (39)..(39): n is a, c, g, or t
  misc_feature (406)..(406): n is a, c, g, or t
ctgaaaatgtccccctgcatatcggctctgttggaaaancccctgatttttaagcagacctgtttcatttcaacatgggttacccccaggaggtggtcttcataaaaatgtttcttggaggcccaggcgccgtggcccacgcctgtaatcccagcactttgggaggccaaggtgggcagaccaccttaggcccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcn

SEQ ID NO: 537035 - DNA, 148 bp, Homo sapiens
gattcgggccgagatgtctcgctccgtggccttagctgtgctcggggtaactacctctttctgggcctggagggctattcccgcgactccaaaggttcaagggttactcaacggaatccagcaaggaatggaaggcaaatttcccgaa

SEQ ID NO: 537036 - DNA, 538 bp, Homo sapiens
tttagtagagggtggtttccacatcttggcaaggctggtctgaaactcctgactcgttatccaaccgcctgggctcccaaagtgttggaatacaggcgtgagccactgtcccagccaaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttcgtcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgagggtttcccaccacagcttgtgcatcttccctgcagatcgcagacctgtttccaggctgatgtttctggtgtgtaattgctagcgtttctg

SEQ ID NO: 537037 - DNA, 115 bp, Homo sapiens
tgagaaactcggaaaaatcacacagggactcacgtgcttttccaataatcagtgagaaatgccatcttccaggtagtcccggaacgtgtggatcaggttgatggtgttggtctcg

SEQ ID NO: 537038 - DNA, 192 bp, Homo sapiens
  misc_feature (147)..(147): n is a, c, g, or t
atagagcaacgaatatagacctggtactattctgaattcccaccttaaaagattaattctttacagaggaactgtttacaaagaccacttataactttctgagtgtccttccaaaagaaacaatttatttttctttccccttaccanttaatggccaaaaaaaagtttagaagaaacgttattatacaacaa

SEQ ID NO: 537039 - DNA, 586 bp, Homo sapiens
  misc_feature (580)..(580): n is a, c, g, or t
gatgtactttctttaatatatggaatagtgtagtcaaaacatccttgcgccagtcccagcatctgtgcagcaattcctattctaccttcattgagactccctatggcatacttaatagccatgtccaatttgtccccaagatattggcttctggaaccttgacattttcgaatgttaacgggcaggtggaagaagctctgagccccaatttgttttcaggtttccctatatgaaggcccggagtatcacgatctactaagaaggaggtaattcccttatatccaatggtagggtctacatttgccatcaccagaaagagccctgcgtgctcagcactgctgatccacatctttgatccattgaggacataataatctccctctttatcagctctggtcttcaaagcaaatgagtcactacctgctccagcctctgaaaggcagaaacttcctactttttctgtagtgagctgaggcaaataggtggccttttgttcttctgttccatgttttctaatcagtgtgttaattaatgtgttctggatctcacaaaagacagccacagatgcatcaactttggntaattc

SEQ ID NO: 537040 - DNA, 211 bp, Homo sapiens
tgagccggtaccaacaacttcgtcattctgatttcccatctcaaaaaaaacaactgccaggtatggatcttcgggcaacaacttcgtccatcgtgatctgtcttgaggtctggatcttcggcgtgtgcagcaacaacttcgtccactcagatttgcggcgtttgggtcctcggcgtgtgcacatacgaagagaacagcagatctccatctc

SEQ ID NO: 537041 - DNA, 380 bp, Homo sapiens
  misc_feature (332)..(332): n is a, c, g, or t
  misc_feature (368)..(368): n is a, c, g, or t
  misc_feature (380)..(380): n is a, c, g, or t
tgtggtggctcatgcctgttatctcagtactttgagaggccgaggtagacagattacctgaggtcaggaattcaagaccagcctggccaacatggcaaaactccatctctacaaaaaatacaaaaatagccaggtgtggtggcaggcgcctgtaatcccagatactctggaggctgaggcaggggaagtgcttgaacccgggaggcagaggttgcggtgagccgagatcacaccactgcactccagcctgggtaacagagaaagactccatcgcaaaaaacacaaataaccggaagccttgacagactgatataattatgtaattaggccgntcgccgtggctcacgcctataatcccagcactttgngaggccggcgcn

SEQ ID NO: 537042 - DNA, 356 bp, Homo sapiens
cggttgctagtaacacatacaattacagagttcaccttttaggcccacacgggagactgaggctcgagactgaggaaggcttctgccgtccggggttggagctcctgaggaccaacacctgctcaacggttcggcccctgggctccctgagatgctcaggccggaaagaagcgggatgatggttcccgagcgtcctcctacaagtttccaaggccccaccggcggttcgggcccctggagacccgcggggctctcattggcgcatccgggcggacattcttttcagtggctccagctcctgggagtcgatgaggccacactccttgaccaaatagtggaagtgcttgttgcaggtg

SEQ ID NO: 537043 - DNA, 310 bp, Homo sapiens
tgacggccccatccgggggtcagtggggggatgagccagagggcaattgataccagaccttccgacagtactgtggggccgagtgcacctggcacgtgcgaaacccactgtccgcttgatccatcatgtaggagcgcctgcttgccaaccaatgcccgttaagcgttgctagcagctttttcagggccccggccctgccatgccgcacgctgacccttccttcccccccatggcttccggccccacccggagtggcattgtcgtggcagccaactttgccattaaaactctttgccaaagtttaaaaaaa

SEQ ID NO: 537044 - DNA, 124 bp, Homo sapiens
  misc_feature (1)..(1): n is a, c, g, or t
nacaaaatgagaaggagttcagaaaaagaatgatcatgacagataaagtgtagtaatgcaacacagttttatgtctaggatttaaatatgtatgtgaaacaatacactacattcctggaaatat

SEQ ID NO: 537045 - DNA, 198 bp, Homo sapiens
attatcgtacagatataataaagccaaacaaagaaatggctacctctttaaaaaagttttaagactcagcaaaacagaacaatactggaaataatcttccctatctctcaaacactaaaagtcacatttatttatttattttttgagacggagtctcgctctgtctcccaagctggagtgcagtggcgcgatctcggt

SEQ ID NO: 537046 - DNA, 252 bp, Homo sapiens
  misc_feature (74)..(74): n is a, c, g, or t
  misc_feature (94)..(94): n is a, c, g, or t
  misc_feature (101)..(101): n is a, c, g, or t
  misc_feature (123)..(123): n is a, c, g, or t
  misc_feature (137)..(137): n is a, c, g, or t
  misc_feature (200)..(200): n is a, c, g, or t
  misc_feature (203)..(203): n is a, c, g, or t
tgcagggcagtatccgccagttcgccgctgccttgtgctcaccgacttcggcatcgcagtcttcgagatcccgnaccaggagtctcggggcagnagccagnacatcctctcctcctgcgcttngcttttgcttccgnatggcgacctcaccgagttggcttcctcatcccgaacttgtgctggtgctcaaggacggacantgngaacacgttttcatatctcgacgccgccaacttgacgtcacgcgcctgc

SEQ ID NO: 537047 - DNA, 803 bp, Homo sapiens
gccgggcgcggtggcgcgtgcctgtagtcccaaagtgctgggattccaggcgtgagccatgcgcccggcagccctgtgtctttcaaagaacctcggcccagtgatggctgatctcactcccactgtctcgtagaattacactccttcctggggatccctctttctgcagcctggtcgcttgggagagtacagggaagtacctgcagttgaccccgtgccccacatgaccttggtccagggcatggatgattccagagcccgtaactgtgtgggatcctcacttgaccagcccagccccagtccgtcaagccagggctgggcctgggctataactttcgctgggctctcccaagaccatcagcagtgcatccaggccccctggggcccgtgggcttgcatgccgggtttcttccagtcaagtccctgtggtctctgagcctcccggcaaggggctgctcttgttctgccgcccctcctttgggtgtatcacgtgtcggctcacagcccccattccatgggggagccttccggcatctatcggtctttctcattgtcccctatctgttcttgtcacccagggaaggcgggtgcttgtacgtgtgttaatccaggtgtcactttcacacttaagagacttcctgggcaccaatcatgtattcacgcgtggctctttggttttcaatcagaattgtgtgcaagcttgttaaaatgaagcagacagataatgcaaaggactagaaagacaaatgtgaacttcggatacacactgacacactcaaaaaaaatagcgataaaaaaaggcg

SEQ ID NO: 537048 - DNA, 371 bp, Homo sapiens
cgtcgaacttttatatccagttttgttatgatcattatatacgagcccgaatgtttcaaaaataaattcttagtgaattaaatagtgaatgagagaaagacaaatctgaggaaaaagaggagtcaggataagaaagattagagccagttccatacaaagatacagaagtagtaaccagttcacaaaagcaggacttaaggagctgaaaaagcagagaaagagaaggaagccgcaggagaagggagaaagcaacaccatggaagtgttatgcaggccactgagggaagagagtaagagaggtccacggttgaggaccacatgagccagattatcagagaaggaagcaaggtcaaagggtcaagtgtcgacgc

SEQ ID NO: 537049 - DNA, 1072 bp, Homo sapiens
  misc_feature (539)..(539): n is a, c, g, or t
agcgttgggggaggacggaagccactgcatctgttggctcagggccccagcctgtgcgaaacagaggcgcctgggctgttgtgtctcctgtctgtggccgatctctagtttagaaggtagtcccatcttggatgggccgtgggccgagatcccttctcgtgttgtgctctccaggagacgtatgttgtctcccttcgtgaacagccgagccgacgctggcctgatacacggctctgaggactcgttgccttggctacataagcgtgtgtagcgaagtgaggccctggggggccaaggatcgactcctttcaacgttgagctttatgggagccccgaggattgaggctactgagatagattatcagacgtcacaaaaggacttctgcgtcatactttcacgctggctcccaattgagttgaaaaagtatctcgcattattgcactcctgcgacagttgtctccgcaaaagtgtggtcgtgtactatgccttgggaatggagggcatggctatgttgatgcaaaagacaagtgcccatggnctgtatggcctctatggcaagagtaacatagtttggatcatcctattggtacagccgtatactcctggggtcattggcccgtgtgggacaacctgaaggaccaaggtatgacttttggggccagtgccgccatggcaccatcgtcagggggtcttcattcgcgttcgtcaggtctctctgtgcaccctggggtaggacctcctgtcgtttgtacaacttacccaagaagagttgcgaagaggtgcttggtcactggcgcatagccatttgctgccttgatccatgcattgtagtggtggggtccggggttcagccaaataggtcccttccaagagtcccctggggaccacgcagttccctcatggaaggggtcctttacccccacgaaacgagtccaggactagggagaagccatcgttacccgcctctccttctggggattggaggggaagcaaggaaagctggcaggtgaaaactggaaaggaaagcccaagcaggcaaggccgaacaaggtgcatgaacggctcggggag

SEQ ID NO: 537050 - DNA, 331 bp, Homo sapiens
tgagccggtccccagggtagactaacctcctgccacagcctccctagtagttgggactacaagcaggctcatcaacacccacctaatttttgtatttctagtcagaaggttttgtaaagcctcctgggagaatagctgaaggcagctgctttataaccctgaggcagagggcaaggagtaggtacaacagagtataggggaatttatcttaaacaggcttgtttacttttattgaccaggaactgacctttgatcatcagtgcgagtgatgttccctgaacttttttggttttatttttccttccttcctacctgggttaggtctacctgg

SEQ ID NO: 537051 - DNA, 109 bp, Homo sapiens
gctatggttctggtacatacatgataggattgaggatatttcccattattatagattatcatgttatgattataatatatatgatgatgatgatgatgatgatgatgat

SEQ ID NO: 537052 - DNA, 912 bp, Homo sapiens
taaccttcccttataagcttgcctgtgttgggttgacagtgagggtaataatgacttgtggttgattgtaaatattgggctgtaattgtcagtccagtgtttaatctgacgcaggcttatgcggaggaaatgtcttcctgttcctttatacttaccattagtcctcctatagggtgatagattgggcccactggggtgtgaggagtccagttatatgttggggatttctaaggtagtgggtgttgagcttgaacgctttcttaatggggggctgctttaggcctactatgggtgtaacattttttactctctctacaaggtttttccctatttgttccaaagagctgtacctcttgggactaaccgttaattttccagggggatttagagggtcctgtgggccctttaacagttgacctaagatcctatcttgggacaacccagtctatcaccaggctcggtaggtttgtcgcctctacctataattcttcccctatttggctcacatagacgggtgtgccctttagctgttctaggtagcccgtctggttccggggggtcctaaagcttttggtcttctcctttgcaagtttatttctaaggttattccatttatgtgcgcgaaaggggtaatagggggttaagccgcttggcgtaatatttaataggcgctggggattaaattctcacacctgttgcccccttgcggggacatataatctcttattgctggcccgggttcacaattctaatcggaccaataccttatatgtggggcagcaagcgtctgtggtacggttgttttgttcagacagagggatgtgtgttcccccgccggctgtttttcccgcagggtattaatctggcgggttatacccccgtgttctccggattatatttcgggacacgctg

SEQ ID NO: 537053 - DNA, 646 bp, Homo sapiens
gtttctccttttttcttatatttttatattcaccaattttttttttttcttaaacatatttacctctcacatttcccctaccatcccatataatacacaccaaaaaaacacccaaaaaaaacccaccacaccacacatcacctacatccacaaacacccacaataatcaccctatacacctaaaatacacctacctccaaaacactcatcccaccaccccacacccaaatcaaccatcaacctacatacctccctaccaccaaccaccccccccataccccacctaccaccagaaccaccccattaccctccccccaacctcctaacaccaaccccacaatcacaaaaaccaccatcccccaacctacttaccacccaccacccaatccaatcactactccaacacctacaacacaaaaacaatcaccacacaacaccccaaaacaccctaatcaacccaacactcctctcaatcaccataaccaactaccaccaccaaacacatcacaaatcaccacttaaccacaccaccacactcccctcccacatcacacccccaccccaacaactccaatacacacactccacaacactcataccccaacatcaacacatccccttaccccaacaacacctcacaaccccc

SEQ ID NO: 537054 - DNA, 1386 bp, Homo sapiens
  misc_feature (1096)..(1096): n is a, c, g, or t
tactccctatgttggtgtggtattctgtgttgtcctccacttgtgtgtgggtgccctcttgcccggtgggtcacttgtgtagcggtgtgcgcggtggtgttttgtgcactcttttggttgactctccttgctctgttacactcgtgtttttggcaccaaactgggggtgctccccgcgcgcttgtgttccttgaggtccgtcctagcttttttgggggcgcggcctcttctttgcctcgcattggtcaccctaggtttgtgggtaatacctccgctgatttggttggttcctgttggtcttttatggggtgttttttgctgttgtaccctatgtgttcttctggggttctttggggctgtttgatttttcgcgttttgggggactttctcggtgtccctgtctctgttggacccttgtctctttgtcgtgtctatgcacagggtggccctcctatttgtgcctaccttcattccccgtggggtgcctcaacttcgggcccaatgcgccaagggaattccatttggtgtgtcccccgtttttgtgaatgggggctttgaagggccgacttgtgtcccctcattgggatgccacttcccaaaggccttttcttgttccgtcccatggaattgcccccagtgtgtcttgtgggtcttgggggacccacatgtgtgtcccaggcccttttcttctcctcgtaccccttttgagtatcccccgttggcccttgggggccccatgcgtcacaacccagtttgggcccccagggattttctccgctccacacccttggcccattccctttggcgcaacgcagctttgggaactcccaaggttttcccaccggagaattgggaagatatgttcttttcgtagaaaaattgtgcctcttttggaaccctttgggaaggctctcctgagaaagagcctctgttagatctccacaggcttctgggccgtatgtcccatagtgctggagcctcgtttccttcctgtgggcttcctccacactccctcggctgtccacacagtgtgaaacacaacggcactctcttggaacaacatatcctggtgtttttaagaaagaggggaacttgnccatgcacagatttcctgtgaaccaggtcccacaggcccttttgggcatgaaccacacctgggccccgggtgcaagccggagacccccccgaagcccctctctcccacgtaattcccacatccccgcacatgcttttaagggacagcgcctcttttccctttttgaggaatttctgttctcggggcttgtccttcctttcccgctggttttgaaagtaattttccttttttacattaattgcaccataaagctaaaaacttgcaatacttgaaacaaaaagaaaaataaa

SEQ ID NO: 537055 - DNA, 851 bp, Homo sapiens
  misc_feature (714)..(715): n is a, c, g, or t
  misc_feature (755)..(755): n is a, c, g, or t
  misc_feature (836)..(836): n is a, c, g, or t
  misc_feature (849)..(849): n is a, c, g, or t
agaaggtgaccgttaggaggaggttggagttgaagatgaggaagctgaggctctacgggcaaccgggtaacttaaggatattaaggatgacgttgtggacaccaaaaagcagaagaccaaggagaatgactaggcagcaaaaggaaaaataaccttacgcaccgtgacctattcaccctccacttcccgtctcagaatttaaacgtggtcaccttcgagtagagaagcaggccccgcccgcccacagcgggcaatgccacccacagatatgacatgcgctctccaccacccctccaaaactacaacatgaattggcaacatgggaggaaaaaagaaccagaacttcccaggccctactttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattataatctcaaaggagaaaaaaaaaaccttgtaaaaaaagcaaaaatgacaacagaaaaacaatcttattccgagcattccagtaacttttttgtgtatgtacttagcgtgtactataagtagtttggtttgtatgagagtggttaaaaagcgccaaaagataaaaggttttctttttttnntctcctttttgtgtcatatgaaggttgctgtttatttttntttggccctgtttagatgatattgtgtgaacacaatgtgtgtccacacaaataacacaggaatttttattttttgctgagnttgtttctaaaanaa

SEQ ID NO: 537056 - DNA, 177 bp, Homo sapiens
tcactacagtgctgcatttagctcactgaaactcgactactggttcaagtgatccgcctcagcccccaaatagctgggactacaggtgcgcgtcaccatgcctggctaatttgtcaacttttaaatgagatcatctgcaaggttcaagtgagggatgagcatgtgggatcctcatag

SEQ ID NO: 537057 - DNA, 249 bp, Homo sapiens
tcatagcatttgcgccgtgatagatatgatgccaatataatagggctgcaccacgcccatccgcatgccacatactgggccacgttcattgagggagatcttacggccaccggtatgttgcagaactccgtcccctcctcattgctgtgaggtacaaatattgtaacccgatgtgtctctcgagatattcttcagggagacaggctgacctcaggcttgctggcccatggcatgcaacatctgtgatga

SEQ ID NO: 537058 - DNA, 1811 bp, Homo sapiens
ggtttccttgcccgtacttttaacttaccttattttccccaaaacggtggctggcgttgagactcccgggagcatgtccaggttccccggccttagggtcttcccaggcacttgttctgcttgtcccttgccttcccccacctgtgaggcccagcttcggcatcgtacggggtggttctgggccgggtggcgcatcagggtcccccagtgcctgtgaccaggcccgcccgccccatcttacagcaccactgccgggcgtgtgggcagatattctgtggaaagtgttcttccaagtactccaccatccccaagtttggcatcgagaaggaggtgcgcgtgtgtgagccctgctacgagcagctgaacaggtgagtccccgccccccatttgggctgcaggtggggcaggctctccaggctgggttttctgtccctcttggccatggtgcctgaggcctgcagaccccagaggaccctcacagcacagcagctggaaggtcaagggaaacccagggtggccgcatgccctcggaccctgccccacactagggcaggtgggtgtgagagacagggcgccgcggctccagggaccgaggctgccccgacaaacctgttgcttgggtttgggtttgggtttgtttgcatttcaactttcggaataaaacttacagaaaagttgcaagagtagcacagagaagctgcggggccgcggccagtgcctcagcggtgggaacctgcggggccgcggccggtgcctcggcggtcggtgttttgtcgcagagtttactctgcctcccctctcctgcgcgtgcgtgtgttcacacaggttttattttgaatttgcatgagtgcagatgtcatgccccttggcactcagatcttcgcctgtgatctctgagagggacagtgctctcatggccacagcagtcactcgggactgcgctgccacccagtgctggcttctgctctgtggtccacgttccatttctgccgtggtcccagcagcgtcgctgtgggtctggcctgggttgcgtgtgtttcgtatgtgggccgtgctccctgcttggttcccttttcctggaacgtgtcactgcctccctgtctcgctccgtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggaaagttccttttccttcttgtaactgagaagaacttgccttgagccacgtcaagtcccgtccgtcgcagccactgcccacaagcgtgagtctgctgtgagccagcggctccatggcagggcatcccagcgccattcctgccttcacacacacttgctgccgtttccctgtgctgggggctgtgcaggtctgcctcggtgtggacttttctcttaggaaagagccccaggtcggccgagcacggtggctcatgcctgtaatcccagcactttgggaggctgaggcgggcagatcacgaggccaagagatcaagacaatcctggccaacatggtgaaatcccgtctctactttttaagtattttatacttaaaatttttgtattttatacaaaaattagcgggcttggtggcagatgcctgtagtcccagctactcgggaggctgaggcaggaaaatcacttgaacctgagaggcggagattgcagtgagccaagatggcgccactgcattccagcctgggcgacagagcaagactctatctcaaat

SEQ ID NO: 537059 - DNA, 278 bp, Homo sapiens
tataatgtgataagagtgcaagcagaggaggaatcgaagtcaggagggctcgacatagctgaggggcctggggtgtgatgtatgacatgcatgcagggtgtgggagctcaggctgactgggttaggatccagcctagataaagtactcagctttattgagctacggattcctcttctgtaaaagaacgtccagctcataggtagcttaaaatgaaatgtgataatgagtgccaagtgctctgcactgagctagatacgtatttggaagccacgtcgga

SEQ ID NO: 537060 - DNA, 171 bp, Homo sapiens
gagaaaagccgtctcaatttgcgatccacgcggtcaggttaacactcttattattcatcattccttatgttatatactactgccccaactgcaaattgctaattgtttcacatccagtgctatactcttcacctacgtgatctatgtgaaccatcagtggttttgcccaat

SEQ ID NO: 537061 - DNA, 390 bp, Homo sapiens
  misc_feature (36)..(36): n is a, c, g, or t
  misc_feature (41)..(41): n is a, c, g, or t
  misc_feature (61)..(61): n is a, c, g, or t
  misc_feature (97)..(97): n is a, c, g, or t
  misc_feature (235)..(235): n is a, c, g, or t
  misc_feature (287)..(287): n is a, c, g, or t
  misc_feature (311)..(311): n is a, c, g, or t
  misc_feature (317)..(317): n is a, c, g, or t
  misc_feature (333)..(333): n is a, c, g, or t
  misc_feature (377)..(377): n is a, c, g, or t
caaggccgggagggattccccttaaaaggccagggnccatntggtggttccctaatcattntgaggtgtcctgggatgtaatggatgggaaatcctnctaagaagtcaacttttgtaataattagaaaagctcctagttctgaggacagagacctgttggagtccccatagtgggaatttttgccctggcatccagttcagatccctggagcttcttgactgaggggagattggntcccttggggaagagtgaagccttcaatgctgccacaagtgtaatctcagcnctttgggaggccgaggtgggcagntcatgnggtcaggagatggagnccatcatgcctaacagtgaaaccccatctctacaaaaataaagnaaatttaaaaatc

SEQ ID NO: 537062 - DNA, 204 bp, Homo sapiens
  misc_feature (111)..(111): n is a, c, g, or t
ctgcggcctgatggctccccacctggactctgacggtgctctcacggtgcacgctgggctcctgacgccttgacggtgccggccccctggggcttcacggactacccgggnatgctgacctggacggacacccggtgacggacgggccgactggtcactgttgaccgggtaccctgacgctcgacacttcgtaactcactgtgt

SEQ ID NO: 537063 - DNA, 151 bp, Homo sapiens
caggcggacactgattgacgttgccttaacttccacggatatctgggccctgtgagtcatgatgctgagaaccaaacagtagtgaaatacgatcaactgtgaacataatgtggcaggtcaggtggatatccagatctattatgttagcctc

SEQ ID NO: 537064 - DNA, 196 bp, Homo sapiens
caccggaagggagcgtgggcccctggaatccctgtttgctacactaaccagtaaacagattggctgttccaaggagcagctggcactctggaaatttataacttgtaagcaactactttcaggggaaattttccaaggtataggtctcggctacagagctttgttcctggcagaggacaccacctttttagtctgg

SEQ ID NO: 537065 - DNA, 202 bp, Homo sapiens
gcggggataagcgggcaggttcaggtgcgccccggtacgcactgttcacctttatctgaccaaaccgctctacacgttagctccatctctgctgcttctctgtaggctcaccattaacatatgtaccggtgccatctggggactgcttttaccaacaagactaaaggattacttggaggattataaattccaggaataaatg

SEQ ID NO: 537066 - DNA, 203 bp, Homo sapiens
cgcggtgatctagaggatcccgtgcgtacggacgctgtgccgcgagctgtcgtggagtcggtacacgtcaacgaggaatatggcgttcacgagagccgccgcgaccgcgccgtggcccaggccctggaagctgacggcgtgaccttccacagctacctggaccaactgtttttccagccgggtagtgtgcgcgtccgtagcgg

SEQ ID NO: 537067 - DNA, 601 bp, Homo sapiens
  misc_feature (188)..(188): n is a, c, g, or t
cgcgtcttctcaacattcagatcaatatgcatttctaactgaacagcagattagaaagagaatgaggcatcctttcactcagactttcccagttactcaagattgtattcaggaacgaagtcaaacccgggctcacttcttaattagaataaactagaatcaggtccattgcataactgctaattgtnttgcaccagggagccacaaaggaagctaaaactagcctttctaagttatcctaagtttttactatctaaccagcacttctgatttttttttcccttaaaactctaaagtacaggtgtcgtatgtctgccgcatctgaaaggctgccccggaaatcagagcctatctagcgggaatgtctgggcagtcacccccatcctgtgcgcagatagcaaagggctgctggcaggtgtcagacacacggtaccgcaacagcagtcccgaggtctgagattctcaatgtcagcaggtggctggagagtatcaccagagccactcaggaaccagccatgcggaatggctgggtttcttattgaacatgaaatgcttcctctttgggctggactgttttgctaaatgttagtgggtttgggca

SEQ ID NO: 537068 - DNA, 852 bp, Homo sapiens
gattgcacggaccggagcgaccctcaagctcactcttgagccttccctgttgtgttggagtgcagccgctccatcatgtccttcaggagcttgatgcgatgaattggtagatatttcaaaggtaggcgatatactcctgttctagacggagaagcatggtgattactcatagtatcatccttgtatgccaggtccggagatgatcggtcctgctgagactctgggcccaagtcccaccatatgcagaggtggggaatgttctggcgaacatcctctacgttctagtggtagaggctcgagatgctccactgacacaactaggtgttagagcactatcttgctctatagatgcaagcccatttcacaactatcaaaggtagctaggtcctacccttattgcatagcacttcttgtatagcattggggtctagccgtgatcgttttagcactaaggtaaaggcattatgggtacaagtcaagtaggtgtagcttcgtaggcgtcccagcaccaatgttttcggacgtccacgcctggagtgcatcagcggatagaatagtaggtaagatagtcggtatagcccctggtgggcatgagtggttatatggactacttagtggtggtggattgtcttacgaagctataggttctagtgcaatcaatgttgtgatcatgtaatggaagtcttctaaggaattaagcatggttaaaatgaacggattgtgttgataaaactgatttttaattgatcaattcatgaagaatgttctatagcactcgggtttcattcagccattgcaggagccttcaaggtaatctgggacggggcgagacggagacaaatacctgaaata

SEQ ID NO: 537069 - DNA, 345 bp, Homo sapiens
ctcagcatactgagtggggtaagctgtaaagaggccagaccctaaaggaccttagataccatatgctgaagattgggaggacgtttgggagaagcgggaatgacaagtaagcttgggagccatggtgtgccgagctcaccagtggagcacagtttgcacgccatgcagcatgccagcttcggaagattttctcactatggacatcagacaacctccactgaatcctaaccagaacctatgaggctactgaaaagttgtgcgatcctgcataacttctgtcacgcctgaaaacctcaggacactgaacctctcatctggaaaaaaataaaactttttacctataaa

SEQ ID NO: 537070 - DNA, 181 bp, Homo sapiens
tgtacactctgatgctaccagtcgatcctactgagttcaagtacggttagcctctggcctgggttccatgcctttgaattcaactaactgtggatcaaaaatatttggaagaaaaattccagtaagttccgttgtgcccccagcaactatttatatagcatttacattgtattaggtcttg

SEQ ID NO: 537071 - DNA, 463 bp, Homo sapiens
tcggccgaggccagtgtgcgctgatgccctggcaaggtcttcgtatgatgcccacctggcctgcctggccgccacgctggcatggggtgtagggccgggcaggtggggctgaggggatccagcctcgctgaggtgcagaggctggctctgtctgtttgccgtgacctagctgtctacggccttccccaggaatcctccaacggctgcttcccaagcatcagctggggatgggcccctttcagaatcacccccgaggatggcctcggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcag

SEQ ID NO: 537072 - DNA, 253 bp, Homo sapiens
ctctgataaccatgaggcttctcattctcacctgtcttgtggctgttgctcttgccaggcctaaacttcctcttagatacccagaacgccttcagaatccatcagagagcagtgagcctataccattagaatcaagaggggaatacatgaatggtatgaacaggcagagaaacattctgagagaaaaacagactgatgaaatcaagaactgtgttgtggcagagcctgagaagatggaatccagcatcagttc

SEQ ID NO: 537073 - DNA, 837 bp, Homo sapiens
ttccttggggagctatagttgtaattttggccggcgcatttttcccgcaagagggagcccgcaattgggcccctccttatacagggtggtgtggccaacctaaataacgggccgccttggtacttcttattccgctgaggtcgatccacaattgttgtgttgtgccacgagcggccccgcttcctaaatgcgggggttcccccccccgtcgtactgcgagaatagtcatgcgcgcccacaagaggacaaatttgtatggttaggtgcatcaaaagcccagtaccccttgaccaagagagtttcatggcccccgggttcgatatagttcctgtggacacatttctgtgcagattattgtaaacgggaggaaacgcgcggtccccgccaaccgtgggtcataaaaaggttgttggcccgccacagattgtttctagtcataacaggcttgcaaaaaatccccatcttgttaaaaaaaaatacgtgggacgtcttttgtgcacacgcgtttcctatggagaaaaactgtgaaggcaggtttttttgagggtgtcgcgttactcaccatttctgccctcctattactcacatttgagcaaaaatagatcttgttagtattcttcagcaggttttctgcggtcactctttctaattaatcttatctaggttatacaacctcccgctgccgccccaacaagatttacattgtatttctgacccctccggtttgaaccagaaagcaagacttctgcccccacattgagtacacaccaatacaactacttctgaagatctttgcggacccaaaaaaaagttctttaaaacccaacaaacataaca

SEQ ID NO: 537074 - DNA, 275 bp, Homo sapiens
tatgacgagcttacacaatagcttctatagtaaagatacctctttacggactccactatatgagtaccctaaagcgcatgtagaagcccccatcgctgggtcactagtacttgcggcggtaactcttaaaactaggcggcgatggtgataaatacgcgctcacactcaatattcaaaccccctgacaaaacacataatgctaccccttacttgttactataccctatcaggcctaattattacaagcgcgtcaggggaccgagctctgaatatcg

SEQ ID NO: 537075 - DNA, 116 bp, Homo sapiens
ctgtatatccatactatgcaaagaactcttacaactcaacaacaaaaagacaatctaatttttaaaaaatcatagaggacttgaacagctaattctccatagaagatatgcaaagg

SEQ ID NO: 537076 - DNA, 130 bp, Homo sapiens
caaaaatttttgggggcccccccccggggggggggggggggcccccccccggccccttttttggttttcccccccccccccccctgggggggggggggtttggtttttccccccccttccccccctttta

SEQ ID NO: 537077 - DNA, 1008 bp, Homo sapiens
ggaatgttcactgcgttcccgagcaggtgaaggtttttcatcgtagcggacgattgtgtgccaacacacacaccacgcccgtgggtgtaacatgagacacagaaagtgtttttgtccataaaaacatctgccggtgtatttgtcggtttttgaggctccccccgtcaccggtgctggtcccttcgctcgatgatttgtccccccccctctttggggggcgacccgacgccgcgactagaaatgtctgttgctgatcttaacgaagggttctcagagacacccctctctggtggggcccaacaccgtgtgggagagagccctctcttcttgtgtgcccacacaaaaagattttctgtggtgtggtggccccgccgccggtcggggcgtgaccacaccccactggtattgtgcccgacccaccttgtggggattgcttttggaggcgcgtgcgcctgcaatactccacaacggttcgccggatgtgtttgtgcgtgacaaccttcctcgtggccgccacaactggtgggtcatccccccctttcttgtctattcgtcatacatattctagcaacattttgttctccgcgcgcgcgctcgttgtcttctttggcctcgtccccgctgtggttcaccaccctcgcattactgtgcgagggagcttgtagcgcgcgaagacattctcgtctgtaaacacgcgggagagcgccccagtttcagagtggagagcgcgcgagagcttctccgctggcagcgcgaggaggtttccacccccccccccttcttcgcaccccggtgcccacgaacgacgcggcagaatctttcttccaaaaaaaaaaaaaaaaaaaaaacaaaaatggactgtggttggtcccaccaaggtatcaatccccgcctacttgagaaatgaacgcagggaagcatcacttgagccccggagttaaaaggcttccatgaccgatgatcaatcccctgcactcccgcttgggtgagaatgggacttttttttta

SEQ ID NO: 537078 - DNA, 90 bp, Homo sapiens
gtggacacagccacatattactgtgcacacaagagggttacaactatggtcgggggtacggtgacccggtttgactactggggccaagga

SEQ ID NO: 537079 - DNA, 519 bp, Homo sapiens
agaagacagaacacgtgtggcccatctttgatgtaactcattagacgagctgatcgttcctgtgtgccaccttccctagttcgaggttgtatttcttacttgttcctggacttcttattcccccatcaagcaaacatgattattagattgaagtatacattttactggttactttatttaccattgtttgctgtatccaagtttcccctcctttttggcagtatttaatgactttttgttgtttttttttcgagaaagagtcttgccctgtcgccaggctggagtgcagtggtgcgatctcggcttactgcaacctctgcctcagccccctgagttgccaggattgtaggcgcctgccaccatgcccagctaagtttttgtatttttaatagagacgcggtttcaccatgttggccaggctggtcttgaactcctgacctcaagtgatccgcctgcctttgcatcccaaaatgctgggattaaagacgtgagccaacacacccagctttgttttctttc

SEQ ID NO: 537080 - DNA, 265 bp, Homo sapiens
ttcccccccccccccctttttttttttcccctttggggtttcccccccccccccttttggcccggggaaatttcaaagggggcccttttttgcgccgggccaaaggttttccccgggcaccctgggccccaaaaaaccaacttttccctttggcgggccccccccccccccccctttggttttttttgtttttttttttccccggggggttttttttttttccccgggccccccccccccttaaactttggtttggcctttttta

SEQ ID NO: 537081 - DNA, 310 bp, Homo sapiens
gcaaaattttgggggggatttttattttaataaaaggccctttttaaaagaagctgattttgaaactgcttaagggcattgcgggtgctcccaaaacttttcatcggaggggatttatttttttcggggacatccctattttttatttatcacaaagattttccccctttttttccaggagcccaaacaaaggagggggaaaaaaataaccaaaaattatgtttttgcttttgttttcaaaccaagggggcggggattccaaaaaaaactttgttaaattttccaataaaccaaagtttgataccggtta

SEQ ID NO: 537082 - DNA, 1390 bp, Homo sapiens
gcttgccttcggacgcctggattttgactgtgctctcgcgagatttgggtctcgttcctaagcctggagctcgagaaagttctcccaggagaaagccatgatacacgttcgagcgccaagatcgtgaacgcccacactggcgagaagccggacgagttcgacgtccggcatctcccaggctctatctggagctggacgactgacaactcggacctcaacggctcagctcagggacgctgaatataacggacagctacaggaacattgaccgttggtggctggatcggaaagctactcataatctttagttcccggtatcctcacactgacaatctttccagagacaataccaagtccggctagtacgcagcaattggagacacaaagttcgagtcgggccagcatgtcgtcgtttcatcaggctcagaaggagcaattcatgccataacgcccaacatcgcacaaccagccagataacaaaaagataaggcaaaaagcgtcccagtgagacacggtacattcctgacaagacatgttgccgacggaatgcacacatcctctgacgagagctatggacatgacccaacaggcgcacattgaagaggcacaagacgacatccggcagatcaagacatagcatggacaagaccaggatcgatacacagagcgttccatatatgcgacaacaaccgccagcaagcaagaaaacaacagtgatgggaaacgaaccaaggtatatgcaaaccataatatagctagggatggatcctaagtcgacgaaccggcatcaacaggtggcacaggaatggtaacacgatatggaattccccgagaggttgatcacattcggtttgacaccagaacaacctactggaccgtacacacgttagaaccagagaatgcttagttaccacaccgtcggcaaaactacaatctaaagagctccaccggagcggagcacgataaggtttcaggagacgaacggacacgaaccagacgctgctaaaccagaggagaccatgtggcgtctgtcgaacgagtaagaatgacagccaagagttatcgacaccaccggacggccaaccagaagcggccacacaacaaatagtataacccaaacctactgtccctcacaccaaccatatccatcgtaaataaccaaccaacatacaaacataccacgaaaaaaccaaacatacaacacagttaatacatacttgtgacacctagcatagacaccaccagataatcgaaacaaccaagtattccaactacacacaaacaaaacaaaaaacacacacccaacaaactaaacaaaacatacaaaacatactacaaaaacactcctaaccaccctctacaacaaagaaagaacaaacaatacaactct

SEQ ID NO: 537083 - DNA, 110 bp, Homo sapiens
  misc_feature (8)..(8): n is a, c, g, or t
gatctggngacgacaaatgatgattttcttgaaatgatcccccctgctgtcactccaaaattaacactcaggataaatgtgcaaccccagagaacagagtcacagaattc

SEQ ID NO: 537084 - DNA, 208 bp, Homo sapiens
  misc_feature (16)..(16): n is a, c, g, or t
  misc_feature (49)..(49): n is a, c, g, or t
  misc_feature (55)..(55): n is a, c, g, or t
  misc_feature (71)..(71): n is a, c, g, or t
  misc_feature (76)..(76): n is a, c, g, or t
  misc_feature (78)..(78): n is a, c, g, or t
  misc_feature (92)..(92): n is a, c, g, or t
  misc_feature (94)..(94): n is a, c, g, or t
  misc_feature (107)..(107): n is a, c, g, or t
  misc_feature (116)..(118): n is a, c, g, or t
  misc_feature (122)..(122): n is a, c, g, or t
  misc_feature (136)..(136): n is a, c, g, or t
  misc_feature (147)..(147): n is a, c, g, or t
  misc_feature (149)..(149): n is a, c, g, or t
  misc_feature (178)..(178): n is a, c, g, or t
  misc_feature (191)..(191): n is a, c, g, or t
  misc_feature (194)..(194): n is a, c, g, or t
  misc_feature (206)..(206): n is a, c, g, or t
agaagaacactaaaanagtaatttgatctgtgaacaaattatgattgtntctgtnttattacactggagtnttttncnagtataataatttnanatataactttaanataattttnnntttntgggtataattaanaggttgtaagntnacctgttctagttccatcattctgtgtanagtgaagtattgnaangataatgtaaantt

SEQ ID NO: 537085 - DNA, 315 bp, Homo sapiens
cttccttaagggcagaaaatgaaaggagggctggccacagtggctcatgatggctgtaatcccagcactttgggaggccgaggtagagggatcatttgaggccaggagtttgagaccagtctgggcaacatagagagacccccatctctacaaaaattaaaaaattagccaggcacgattgcacatgcctgtagtccgagctactcaggaggcttaggtacaaggatcacttgagcccaggaaatcaaggtttttaattaacctttaataatgcaattgaatttcagccagggcgacgagcaagaccgtatctca

SEQ ID NO: 537086 - DNA, 443 bp, Homo sapiens
  misc_feature (50)..(50): n is a, c, g, or t
  misc_feature (164)..(164): n is a, c, g, or t
  misc_feature (226)..(226): n is a, c, g, or t
  misc_feature (413)..(413): n is a, c, g, or t
  misc_feature (433)..(433): n is a, c, g, or t
gcattttcacgatattgattcttcctacctacgagcatggaatgttcttncgtttgtttgtatcctcttttatttcattgagcagtggtttgtagttctccttgaggaggtccttcacatcccttgtaagttggattcctaggtattttattctctttgaagcngttgtgaatgggagttcactcatgatttggctctctgtttgtctgttattggtgtataagantgcttgtgatttttgtacattgattttgtatcctgaggagtttgctgaagttgcttatcagcttgagggagatatgggggctgagacggaagggggttttctacatatacaatcatgtcatctgcaaagaggggacaatttgaggaaaattcttggggcccaccccagaccccactgaatcagaagncggagggggtggggccccgncaaactatgt

SEQ ID NO: 537087 - DNA, 207 bp, Homo sapiens
catctcatccgtagggagaattggtgcgatgtcagaattctacaattcatgatatcttcatagtcaggaaataactctgatatgtaagataaactgcaacataagttggaaaaggatgtgatttccagtatttcaagtcattcaaagatcagattgagtcatcaccacgtgttatctgccgaggtaagccttcgtcacccagttcat

SEQ ID NO: 537088 - DNA, 185 bp, Homo sapiens
tgcatgctgccacacaattgtgggtgatcgggcaatgtggatcaccaccgccgcagacccaagaatggctatactgaaattgttggaaaataatcccattcggcttatgatcataaatgtaaggaggttgtggtgaaaagttgatacccctcaagtttagtcatttatggaactctgttaccaga

SEQ ID NO: 537089 - DNA, 297 bp, Homo sapiens
  misc_feature (288)..(288): n is a, c, g, or t
agctgctgcattcccagaacaccagcctcatcaaccagaagagaagatggatgctgacctgtcccagctccagacttaagtggaggaggcagtccaggagtccaggaattctgaggagaagcccaagaagcccatcacggatgccgccatgatggcagaggagctgaagaaggagcaggacaccagcccccaccttgagcgcatgaagaagacatggacaacccattaaggcctacagcacctcttgacgagccgaacagattcccctaaggcgcaaagaagaccttnaaagcttga

SEQ ID NO: 537090 - DNA, 1130 bp, Homo sapiens
taaacctttccttataagcatgcctgtgtaggggttgacagtgagggtaataatgacttgtgggttgattgtaaattttgggctgtaaattgtcagttcagtgtttaaatctgaccgcaggcttatgcggaggaaaatgtttccatgttacttatactaacattagttcttctatagggtgatagattgggcccaattggggttgtgaggatgtccagttataattgttggggatttttaaggtagtggggttgttgacgcttgaacgctttcttaaattggggggctagctttaagggcatacaatatgggggttgttaacattttttaacctcctcttcttacaagggtgttttctccttaggtggtccaaagagagccgtgtgtcccctctttggggactaacaggttaaattttaccagaggggagatttagagagggattcgtggtgggccacatttttaagagctgtgaaacttagagaatctctatcttgggggcacaaccgaggttattcccgcgagggcctcgagaagaggttgtgtgtcgccttaaaccttattaaaaattttttccccactatatttgttgggcgtcacatattagaagcgggatagatagaactacatttaaaagccgtgatcacatatagggtgtaagccacgaacagagagattaccggggggaggtgcctataaaggctttagtgggcttctccccttttgcccaaagtccattttctccataaagtcttagatttacaattttattcgccggaaagggtaataaagggggggaataaagagcccttatggagaaaaataatagggctaggagcagaataaaaattattgtacaacgtgtatatcccacttgagggggggggacgaacatatcttacatattagtggggcccccaggggtttgtccaaccagtgttctaaatcggcgcggaataaatctttaaatacaggggggcaacaagtgtgagtgttgcggcacaaacagagtcttgtcttactgtgcggtacaaaaacgggggggcaaagtgcgagttgtcgccggagcacacgaattgttgggtggcgctaaaggtacccctcttaatacgaacccaccgttgtggcct

SEQ ID NO: 537091 - DNA, 171 bp, Homo sapiens
tactggtgcagcgtggaatgctcggagcattgtaatgggtatggagacatgtcgatataagttatgctagcggtgagtggtacgaagttttttcatagcgatgtgtatgagttggtcgtaccggaatcaggcgtatgctgttcgaattcataagaacagggaggttagaag

SEQ ID NO: 537092 - DNA, 272 bp, Homo sapiens
ttttaaaatccctttttaggaatttccccttaggaaggaagtctgtgagtgggcatgatatgctgcttggtacttcgagcctttgtggctccccagacccagcagatattgtcagcgccagtgaagggacaataataagtccccagtcctcctttccctctttggaaagagccctagattgggggttaggggggctttcctgccctttccaatataaatatatagtcctcccttttttatccaaatagggtggggccccttaagaattcata

SEQ ID NO: 537093 - DNA, 873 bp, Homo sapiens
  misc_feature (811)..(811): n is a, c, g, or t
  misc_feature (813)..(814): n is a, c, g, or t
  misc_feature (818)..(818): n is a, c, g, or t
ccagtaccgagatcatgaataccctcccaaaggaagcggcgcatcgggcttggtttaaatctcaaaatgcatgcaattcccgtttaattaggaacatactaatgtacattaggggccaaggtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 537094 - DNA, 921 bp, Homo sapiens
  misc_feature (859)..(859): n is a, c, g, or t
  misc_feature (861)..(862): n is a, c, g, or t
  misc_feature (866)..(866): n is a, c, g, or t
gatgaaataaaatcatctgtaaagtaggggggggaagagcgtggaaatggagggacaagaggccagtttgaggtggggagttatgcgggacccatgtaagatatcatagcgagggcgagttccgatttaagtgggcaccgtaaagattgtaatctagtgggtacagtgtatcacatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 537095 - DNA, 926 bp, Homo sapiens
  misc_feature (864)..(864): n is a, c, g, or t
  misc_feature (866)..(867): n is a, c, g, or t
  misc_feature (871)..(871): n is a, c, g, or t
ctcccgctcaagcgcacggagtcaggatactggatccatctgttccactctctcaaagcacagggccgcgcaaccgggctttatgttacattccccaaatgacagtcgaattccttattatatttagagcccatcaagtgtcgtaacctgggggtgaccagggttctcaatgctttactccatttaaagaaagaacctctttttcccaagtgggtatcgtaattgcaaggtgcctagaaaacagagcctgtgatactttgtggggtgaaaagtccttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 537096 - DNA, 179 bp, Homo sapiens
gtgggtagtaagagaggaagggaatgtcatcggaagagcaggtggtattacagagccctaggtttaagatgaattcaggcatgcgggatccatagtctcatcttgtagtacaagtcaagagaaaataaattagtgtaggacagagttctactacaagatgagactaaggatccctcatg

SEQ ID NO: 537097 - DNA, 892 bp, Homo sapiens
  misc_feature (830)..(830): n is a, c, g, or t
  misc_feature (832)..(833): n is a, c, g, or t
  misc_feature (837)..(837): n is a, c, g, or t
cccgccatgcgggagtttcacaatctcccctctctaagcgaaccggcccgctgtgccttgtctcacgtctctcaaatgaaatcgcattctttttttcagtagcacccaaattatcgtaccctttgggggcccaggggtccaaaacttcatcctttaaaaaagaaccctgtccccgcctggtaaagcaaaaaccacgctcacttaaaggcagagcgatcgataattttcgttggacagagctttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 537098 - DNA, 255 bp, Homo sapiens
aagcctgcgcggaaggaaagcgccattagaagggaagaaaatgcatgagcaggtgtgtacaaattgtattatgggcggacagacgggcagagttccaatcatcctgcaaatccctgtggaacctctgtgccccaccggtagtgtcccagacatcttcttgtgtccctcttctcctcactgatgaaagacactggcgccatgggcaagcagttgggacttcctacgatatatttccgctggggaggtcccgagtca

SEQ ID NO: 537099 - DNA, 872 bp, Homo sapiens
  misc_feature (1)..(1): n is a, c, g, or t
  misc_feature (130)..(130): n is a, c, g, or t
  misc_feature (810)..(810): n is a, c, g, or t
  misc_feature (812)..(813): n is a, c, g, or t
  misc_feature (817)..(817): n is a, c, g, or t
ncgggcccacatttcacctcttattagcttgagagaagtaatggatgggtcgcagttgcgagtgcatgtaggtaatgcggttgcgccaaacaatccacttgggttttgcgaaccacagctatcacattgngggttgttataaacaagcacccccgtggatcgaaaactcaggcagcgcaccgttggtaaaaggcagagcacagatgtgtgggggggaacagtttaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 537100 - DNA, 735 bp, Homo sapiens
  misc_feature (21)..(21): n is a, c, g, or t
  misc_feature (64)..(64): n is a, c, g, or t
  misc_feature (128)..(128): n is a, c, g, or t
  misc_feature (140)..(140): n is a, c, g, or t
  misc_feature (673)..(673): n is a, c, g, or t
  misc_feature (675)..(676): n is a, c, g, or t
  misc_feature (680)..(680): n is a, c, g, or t
ctgaaaatggggcaggttcanattatccttaaaagcaccttttccgaggtaagaaaacacggantaaaccaagcccttatatttgggggaaaactttactttttaagaaaaaagaattgaccggcccntgtttaatagcncataataactgtagactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctattgttctgagtctcatttggattcctgtagcggngnnaatnagagagcgttgcagctaattcctgtttctttggtgctttccgttatcgcagcatt

SEQ ID NO: 537101 - DNA, 986 bp, Homo sapiens
  misc_feature (43)..(43): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttatgagagggggagtcatctagtaagagacccaaaacaactttgttttcttgttggtgggatcgctaaatggattgttccacggcatgaagttatggcgccagctataggaacctggttgcactgacatcctgggtatcaatatttcctggaattcctaaaatttggaagaaatgaggccaggaatacgttgtgtgaacttatcggtgtgtttttttccgggctttctggtccaggatgtttgtggtgctcacagttgtggagacacgacgttggtgatgggggaagattaaatgaatggggagcaaatggaggagatacacacacgtgatttgccgaccggcttgcagttgcagcgaagtgggacggcgaggcgggtggatggtgaagacagataggcaatgagcgttttgttggtagagttaaacactggattatgaccagtgaaaggcagagtaggctgtccaaactacgcatag

SEQ ID NO: 537102 - DNA, 314 bp, Homo sapiens
gagggtgggagattctactccagtcctgcctcatctcctgcgagaggcagacgagtgagtttcactcagaaaaatttcatgtgaatggggccagcttgagctgccctgtgtccatggtgggtgtgccgatctggctgggaactatgatcactatgatgagttgaaagggtgtgagcgggtatagattggcctgtgagcgttacagtatggagcaagcttctaccttctttgcgggactcaaagcccctagttttccccactccacttgttgtcccatgaaggaagaagaggggttcctcctgaccacagtgcct

SEQ ID NO: 537103 - DNA, 960 bp, Homo sapiens
  misc_feature (43)..(43): n is a, c, g, or t
  misc_feature (799)..(799): n is a, c, g, or t
  misc_feature (821)..(821): n is a, c, g, or t
aatggaggagcgcgggaggtttgtagaagaaaaaaaaaagctnggccgcatctgcttgtctgtgcttttttaattatctcatattgacattcaattcttattttaattaggaaacataatattgtaaactatggtgtacagtgtttcaatatttaattcatttaaaaaagatacctttttacgagtggtaatgaaaatacacgtgactaaaagcagagcactgataattttggggggaaaaaacttaaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacattagagacttggcaggaaggggtggaagaaaggctactaaattttttcgggcctaggactagggagaaaataaggtgccaatacaggggttaaccctgttgacttgggggaccgccgcagaattgaatttaggcggtagggggggaacatagaatgggcaagagggcgaaaatatcgaggggacaatagatctaatgaggttggaacggccgcgtgccgatgcaatagacaatctgtcgcgtgggtgactgacgatgaatcaagatccgggccggaagagacgtgagttcacgtgttcggcggagttaaggctaccgtgtaggtccgtcacagggatgttatgtttgcgtcgggctaaanagttgtagcggtgtggtgatgnggaggggggttggagcggataagccctagggcgaagagagggagcgataggtgatgtgcggattaggagagtgagatgcgatgatagtgcagccgatggccgcgtattgtgcagttacggtgcctgtttgcggaggatt

SEQ ID NO: 537104 - DNA, 934 bp, Homo sapiens
  misc_feature (1)..(1): n is a, c, g, or t
ntgggtgggaaggtaaaaggagaagaaggaggggtgcgtagaatgtcaaggattattgaatggcttgcggtatcgaacaatttggattgtagggacacgctgtagggtgaggagtgaggggaggtggtaggatgtttaatggaggggggtcggatattatggtagagtgagggtcgaaggtgagagtgaggagttcgtaatctaaggcgagcgtcaggatatattatgatgtggtcaatttattagttaatcccctgataaggaatggaggtgatgagtgtcgctgtgatcgccaatgacgcagatgttattatagggggtagaatgtagatctgatttttgttgaattggggaacatggaaatggatgcggatggtgggaattgatggaaggtgtgaataagttagagggagatacgatgattggaggtggtaatgagaatactgggtgttataagagagcgtttgatggtgttggggggaaaaggcttaatttattaaggaaagaaagaaattgaaccaggccattgttttaatatgcacataattaactgtagaactttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactccctaacgcttcatcgaatttacgtaaagattgtgtttttttgtgtgtgcggcgttggg

SEQ ID NO: 537105 - DNA, 654 bp, Homo sapiens
  misc_feature (2)..(2): n is a, c, g, or t
  misc_feature (52)..(52): n is a, c, g, or t
  misc_feature (68)..(68): n is a, c, g, or t
  misc_feature (84)..(84): n is a, c, g, or t
  misc_feature (92)..(92): n is a, c, g, or t
cnaggcaaagattcggcacgagaaaaaaatcccagtgggaacgactgcaaanactttggtgtattcgnatctgatctttttcgnatattttntctctctttaaactgaaattttgtcattttcatcttctgtcttgatttttttcatttagactcatgtttatgtttttatgctttaagtcatgttttcagttactaaatagcatattattctattctgtgtatttatatatgtatttatgtgttttaagttccttccaaatttactttgataatatataaagataggagtagcacctctggctaaacctttttttcatacccacttatttccttagaatagatttctagaattactaaagataagtgcatgagcatttaatatacttgataactattgtcagatgacttgccaggaagtttgttcttagtaatatttaatgtactgggatatgtcgtgtttctcaaccccttttcctgcttcattgatttgcctgttccattacaaaccactttgtgtttaattaatacctttatgttattatatctggtagggcaagaattcacactacaattttataggactttcctctctattctcttctgtttgttcctataggtgatttttagaatcatttataatttcaaaaaaaaa

SEQ ID NO: 537106 - DNA, 909 bp, Homo sapiens
agtaaaatatataaaattaggtgagattcgggcgggaggtcggtttaacacggtagcttatcgataggaagaatgcggctgcgtggttatcgagtaattgatataaatatataaaaaacaagatggattagaggatcaaatgggggacgcgaatatgtgaacgagtagacggcacccgttaatgggtgcggatccttgtgagaataggaaccgtaggcgcaggtgggaagcgaaacgcattaagagtacagagcagagctacgggagaatgtggtggggaaaaaagtataggttgggtagataaataaaatcgatatgagctcagcaccatatttttagaagtcaacatataaaatgtggtagacctttatattgtgaaatttaattaaacatgttctacccatttgggttttgaaatgctaggtaaaatactaagttaaagatgtgaggaatcaatattatccttctggcatttttgtttcagctacataataacttttttagtaggtgtgtaaaaaagctcctgatatttttgccttgatctaaaggaaaatatgttctataaagggtaaatctattaattagagacccacacaactttctttcttgctagtgtaatcgttaaattgatttttccagtccatcatgtaattgttccagcgatggaatcctgctttccactcccattctgcttcatcaatatttcctgtcatttccaagacttttggaaaaaatgatgtccagaatcgacattgttgagcacgtagtttcgtcattattcttgttgactctgtattcaaggttagatatttttgttcagtgcttttgaagacaggccagcttgtgctaaagtctgatctcttgtgcctctaaggcctgtcctgttaatgtgagagagaaggatagaga

SEQ ID NO: 537107 - DNA, 143 bp, Homo sapiens
aaggctcagatggatcctgcacgaagccactagacgagatgacaactccgcaggcacacaactccgcaaactaaacaagaacgagatgatgcaatcttcagtgaaagtaagatggcatactaacatgagcttactccgtgaaa

SEQ ID NO: 537108 - DNA, 699 bp, Homo sapiens
  misc_feature (29)..(29): n is a, c, g, or t
  misc_feature (38)..(38): n is a, c, g, or t
  misc_feature (46)..(46): n is a, c, g, or t
  misc_feature (51)..(51): n is a, c, g, or t
  misc_feature (621)..(621): n is a, c, g, or t
agtacggttttaagggttggtttccgcanaccgcaggngccctcangggcnaaatcattgctgccagtgattgtggtctgacttgtttaaaccctcagacttttttaatgttaggtatttgtagcattaggccaacatgtattaagctgagccaatgaaaagtcccatcttgatgtattttcggggtttaaaaaatgagcccagttgctcaactgtttggttgaaaaccttgctcattttttaatggaagggtaagtgtcaccccctttttttgcctctggctgggccttgctaagggccaaggaaaaaaagacattttttagggggcagccagtccaaatgcccaaaaaaagaccagtttttgccctgattgtatgaaatttgacattttggccctttttttttttttttggccaatcagattttttatgttctaaggacatggctgctgtagaaaagcccagacgtggatgataaattatccccaaaagcagcatgacaaaatgcctcggggagcccttggaagggaaattgcagttttgttgaaataaaggaaaatcccttggtaaaaacccagcctgttaggcttgtgtgggcctccagtatgttccccaggggaangggtgggatttttcggccctttgcatcatccatctttttttataggtgggaaaataaacaactttgtgatcctcctga

SEQ ID NO: 537109 - DNA, 1013 bp, Homo sapiens
ggctcgcgcggtgcgagagggtgtgcggtgttattactcgcaggtggtctgatagagggcaagtgtgattgatgtatccagacacggtgtaggggccgctatgagaggagtggtgtgaagattcgcaagttcaatgtagtgtgagtgcattgaaattgtgccagttggtagagatatgttaagttctgaatgggagtggtggattgaaggtgagtaccatggtacagaagtttaacatcctgataccctttcccttctaccatgtcagttatcatgttgctcgaattatgcttgccagaatgtgtgaaagtgacacacggaaagcatagtttgcattactttatatattaaattgcattcagtggcttcgtagggaaatgttggattcagaacttgcacatactgataagtaagaaacacagtataatttcggtgtacatactccagaccatagatagcaaaacggtgctatcggtcaacttctgaacatgtttcctagtattaaggactttaatatagcaacagacaaaattattgttaacaatggatgttacagctcaaaagatttatttagatttgtaacctattttctcccttattatccactgctaatgtggatgtatggtcaaacaccttttagtattgatagcttacatatggccaaaggaatacagtttatagcaaaacatgggtatgctgtagctaactttatagaaagtgtaatataacaatgtaaaaaattatatatcggggaggattttttggttgcgcggaaagtggcctatcagttactggatctttttattatgtaagcaaatagccaatataaaatttaagtttttgttaactactaccttatgtgttttcaccggtacagacactaattcattacaatagctaaattgattgtttaaaaagaaatataaatgtgacagtggacttatttatgttaaatataccattattcagacaactcagtattcatttaatgccctgctggcgcgcgtcgtggc

SEQ ID NO: 537110 - DNA, 808 bp, Homo sapiens
  misc_feature (29)..(29): n is a, c, g, or t
  misc_feature (38)..(38): n is a, c, g, or t
  misc_feature (46)..(46): n is a, c, g, or t
  misc_feature (51)..(51): n is a, c, g, or t
  misc_feature (181)..(181): n is a, c, g, or t
  misc_feature (184)..(184): n is a, c, g, or t
  misc_feature (668)..(668): n is a, c, g, or t
  misc_feature (747)..(750): n is a, c, g, or t
agtacggttttaagggttggtttccgcanaccgcaggngccctcangggcnaaatcattgctgccagtgattgtggtctgacttgtttaaaccctcagacttttttaatgttaggtatttgtagcattaggccaacatgtattaagctgagcgccccccccacaaggagaaaaattttggnaanaatttaagaaggttccaatgaaaagtcccatcttgatgtattttcggggtttaaaaaatgagcccagttgctcaactgtttggttgaaaaccttgctcattttttaatggaagggtaagtgtcaccccctttttttgcctctggctgggccttgctaagggccaaggaaaaaaagacattttttagggggcagccagtccaaatgcccaaaaaaagaccagtttttgccctgattgtatgaaatttgacattttggccctttttttttttttttggccaatcagattttttatgttctaaggacatggctgctgtagaaaagcccagacgtggatgataaattatccccaaaagcagcatgacaaaatgcctcggggagcccttggaagggaaattgcagttttgttgaaataaaggaaaatcccttggtaaaaacccagcctgttaggcttgtgtgggcctccagtatgttccccaggggaangggtgggatttttcggccctttgcatcatccatctttttttataggtgggaaaataaacaactttgtgatcctcctgannnnctgggcatgaaagtttttcaaaaaaagggctttttgccagctcaggagttttccccca

SEQ ID NO: 537111 - DNA, 357 bp, Homo sapiens
caaatggaaattgaaataatttataaaatattggcgttcctatgttttaaaaagttcctaattttttccctaaatggaggaaactattagttttattgttaaaaaggggagatattaaaattccttttagatgcccagtgattccaattgtcccagtttgaaataagtaccctgtgggtatgagataaattagtgcccttcagaacaagtttcagtatcaaatgttcaaaaggaagttgctattgcattgattttaaaatttgtacataaaccctgatttttttgagcattattttgtatttgttgtactttaaaacctgggggccagttccaaaaataaaaatttggggtttttta

SEQ ID NO: 537112 - DNA, 481 bp, Homo sapiens
  misc_feature (29)..(29): n is a, c, g, or t
  misc_feature (38)..(38): n is a, c, g, or t
  misc_feature (46)..(46): n is a, c, g, or t
  misc_feature (51)..(51): n is a, c, g, or t
agtacggttttaagggttggtttccgcanaccgcaggngccctcangggcnaaatcattgctgccagtgattgtggtctgacttgtttaaaccctcagacttttttaatgttaggtatttgtagcattaggccaacatgtattaagctgagccaatgaaaagtcccatcttgatgtattttcggggtttaaaaaatgagcccagttgctcaactgtttggttgaaaaccttgctcattttttaatggaagggtaagtgtcaccccctttttttgcctctggctgggccttgctaagggccaaggaaaaaaagacattttttagggggcagccagtccaaatgcccaaaaaaagaccagtttttgccctgattgtatgaaatttgacattttggccctttttttttttttttggcccacccatttttcttttttccaaggaacgtgggtcgtcggtaaattaccacacagctgtttaatatt

SEQ ID NO: 537113 - DNA, 677 bp, Homo sapiens
  misc_feature (447)..(447): n is a, c, g, or t
  misc_feature (529)..(529): n is a, c, g, or t
  misc_feature (538)..(538): n is a, c, g, or t
  misc_feature (603)..(603): n is a, c, g, or t
agggtattcaattaggaaaagaggaagtcaaattgtccctgtttgcagatgacatgattgtatttttagaaaaccccattgtctcagcccaaaatcttaagctgataagcaacttcagcaaagtctcaggatacaaaatcaatgtacaaaaatcacaagcattcttatacaccaacaacggacagagagccaaatcatgagtgaattcccattcacaattgcttcaaagagaataaaatacctaggaatccagcttacaagggacgtgaaggacctctttaaggagaactacaaaccactcactgctcaaggaaataaaagaggatacaaacaaatggaagcacattccatgctcatgggtaggaagaatcaatatcgtgaaaatggccatactgcccaaggtaatttacagattcaatgccatccccatcaagctaccaatgactntcttcacagaattggaaaagctactttaacgttcatatggaaccaaaaaagagcccgcattgccaagtcaatcctaagccanaagaaaatnggcttctttctttccttctctttcttccttctcataaacaaaagcagtcatttactttaaatttnggatatattcgttcttaaaatttttcagtttctccgtactatcactgcattactgctagcttagagatctccgt

SEQ ID NO: 537114 - DNA, 243 bp, Homo sapiens
gtgggagctaaatgatgagaactcatgaacacaatgaagggaacagacactagggtctacttgagggtggaagatgtgaagagggagaggagcagtaaaagtacctattggtgatgaagtactctgtacaacaaacccgtgacaagagtttccctatataacaaaccttcacatatacccctgaacctaaaagtttttttaattgtaaataaatggatcattaaaaaaaattttaattataaa

SEQ ID NO: 537115 - DNA, 452 bp, Homo sapiens
  misc_feature (50)..(50): n is a, c, g, or t
  misc_feature (98)..(98): n is a, c, g, or t
  misc_feature (119)..(119): n is a, c, g, or t
  misc_feature (179)..(179): n is a, c, g, or t
  misc_feature (210)..(210): n is a, c, g, or t
  misc_feature (402)..(403): n is a, c, g, or t
  misc_feature (445)..(445): n is a, c, g, or t
  misc_feature (447)..(450): n is a, c, g, or t
cccaattaagatataaagttattatccccccaccccccaatgaatttaantgtgcccccatttcctagtcaaataactcccttttccccctagggaantccttgttcctaattgcctantactgttaccttagttttgccctttttagaattttatatgagtggctagatgccaagtcncacgcctgtaatccctagcactttgggaggncccaggtgggcggatcatttgaggtcgggagttcgagaccagcctggccaaaatggtgaaaacccgtttctactaaaaatatcaaaattagccaggtgtggtggtgggcgtctgtaatcccagctattcgagaggctgaggcaggagaatcacttgaacccaggaggcagaggtttcagtgagcccaagaannccactgcactccagcctgggtgataagagtgagactccatcncnnnnaa

SEQ ID NO: 537116 - DNA, 133 bp, Homo sapiens
  misc_feature (81)..(81): n is a, c, g, or t
tcagggcgcctgcttgggtctctttcaagtgtacttccgttcttttctgttctgaagcttttaaaataaacttccactcgntgggcgcagtgctcatgcctgtaatcccagcactttgggaggctgaggtggg

SEQ ID NO: 537117 - DNA, 1394 bp, Homo sapiens
  misc_feature (803)..(803): n is a, c, g, or t
  misc_feature (1394)..(1394): n is a, c, g, or t
ggagccgcgtgggcaggagaacaggaaaatggcgagacacgggggctgacacccgggggtttgggatcacagaagccggaagaaccggattggacgcataagggaccccacacaagagaattcctctcagaagcattcgatggagcagcaaacgcgcgacaaacacgggtggggggcgccacgcgccgggggccacgaaaacaaccaatttaacggaaaactccaggcgtctccagggcacacaaactttctttctccattaatttttcacaaaggccgtgacacaggaacttcctaagggtgtaaacaaagaaaagtacatcacggggtggcattttgcgaagtgtgggtcttgcagaacgagtgcacattcacagacaaacgcaggagcagccatagtgtctgagtaagtattcccacaccggtactccggtggaagacacggctgactacaggggcgcgagacacgccaatccctattaaaaacgagcgagacaatattggcaggtgcacaacatctttcggcgcatgccacccacactttcctaactgtgggcactggacaccaaggcacaaaacccaacggtgcggcctgcggacagccagctgcttatacaaaacaacacaacggtgtcacgcggtgtggaccacaacccgcttttgtgggaccacaacaacaaggcgaacaggcggtttaccgcccataccaacgtgtggttgttcatcacacaccgtgcttgcgactcttatcgagaacatcaagggtgatatccgtccacacttcaacactcacagcactgtcnccgtgaaaccttggtgcccaacacgagtgtgccaccaaccgcgtgtgcccttcaccgactgctgttgaatcaacaccaccagtgagagacacttatcaaacgtcttgagcacgagtcggacacagacacaggtggctaaaaggagtgacgattgaggaatacacacactccattgtcccaccatggtgtgtgctttgggatctgcaacaacactcatgggtcgagaaagaacactcaaacgcagctataaaaagagaactctagtgtgctcgcgtggagcaaagcaagccgaggatcaatcgctaaggaggcaaacgcggtgcccctgacaacggtgtggtctttcatcattacttccttcctcgcgtctctggtctcaccacatccattattacttcaatcacgcggcagcactcaagagcagcaagatcacgatagacaccacgagtatggacacacatggagagatagcagtgagcaccaggacgacgcaccagtaagcacgtgaagaagcagaggaacagaagcacgaagcaagacagcgcagctgtgaacatcagaggaaccggcacagcaaacccgacgaaggcn

SEQ ID NO: 537118 - DNA, 205 bp, Homo sapiens
ggctatctagaactccggactcacgatccacctgtctcagacttccaaagtgctgggattacagacgtaagccactatgcccagctgaaaacttaatatttaaacaaatttgatgctgtggctacaaaggattgcaactcttttccataaactccaagtttcagggttttccaactttaggaatttctatgtgtaaaatccagcg

SEQ ID NO: 537119 - DNA, 132 bp, Homo sapiens
ggattccggtgattggcatgttttttattcatttcatcaatttcaaagcttgtatcgtctattccaggattcaatttcttcctgattcaaccttgggagattgtgtgttccaggaatttctctatttcctcc

SEQ ID NO: 537120 - DNA, 445 bp, Homo sapiens
  misc_feature (215)..(215): n is a, c, g, or t
cacgaagttttttaagagttaagaatagagcttattttccaactctgctctaccaacatagcgtttccccaccaactctgggggccagagactttcacagctttcacaatcttttgttaaggtgctgcctttgtgggggccttggcagcagccattgctgtcttctttgatgcctgcttagccttttttgcttccttggcagccctgatagcctntctcgctgggctttcctaacctctggtttctgattcctcttggccattatatcagcaagagatgcaccagtgatggctcgttggaatttgactgcacggcgggttcttttcttttgaatttcttccgactgccctttcttgtgtttccttctgtagaggacagtccagtttatctgccgaggattccttttggaaaggaatgctgactcacattttgcattaagaaactg

SEQ ID NO: 537121 - DNA, 187 bp, Homo sapiens
cggtgagggcccgccctcacagttgcactgttcctgccggatgccctgcccctcacagtagtctaccctggctgagggcgaccccttatgaaggggcgaccccctttgtaggctgcacccctcaccgtgggtgtgtcctggtgaatgttcccgcccgccttgctgaagcaccggccccttgcctgaa

SEQ ID NO: 537122 - DNA, 103 bp, Homo sapiens
cggtacctatactggtgatgctagaggtatgttcttggtaacaggcgggctaagatttgccgagtgcctttactttttttaacctttccttaatagcatgcct

SEQ ID NO: 537123 - DNA, 1632 bp, Homo sapiens
atccctgtgcctcaggcctgcacatcaccctgacctgcttacgcccagattttcttcaatcacatctgaataaatccacttgcacagcaacagcttatagcttccatttgcacccatgtgtggcattagggcgctgtaaggcaagtgatgcattgcctttcttgttcagtgtctgagtgctatgcaagattgcacaccagcaggtcccagatgcgattcctgtttagcagcaatgtccacatggcatacacccaacttgctgcttttggcatttccacctggtatgggcggtaagttgcaccccgctcgttttggcaattgcagcccaattcgagtgcaagcacaatcatccgtatattagtggctctgattacaatgggtgcaaatctcaccaacccatcacagcacagatgccaaccagccatttcgcaatttgcccatacccagcaccaaaaagtggcatggctgagcatcacactccttccatcttaatccattcgcaccgcaaagcgccagcgccacattcgccagcccaacaccccacaatctgtggtaatagtttggcgccattgggatagtaggtactggcccatttacgtctatcacattgggacatacttgccccacactcacagcaaccagtctgtacccttgcgagctcaaccagcatccccctcctccgccagttccacagaaaccttatatgctattacaaccgaccccactgtgcaccagcacacgacatggcggatctaccctgggcccttggcaattgcttcacacgaaacgccgtacaacacgtgttacttcggttcaacacatctcggcacactcaccacatacaggacgacactccccccatttctcctccacaaatcgttcgtcaacccccctttcacctttcccactgtgtgagccacctcacctgaaaagggtacaccggggcactagacaacacggcgcccacaacagagtgacacaacgtctcgtcacacatacggctgagacacacgatgacacacaacgctactcaccctcaccaggacacagagaaaacgacaccccccactggccacgagacccccgctaactgatacccaactggtgcgcaccgcaacatacccgctctctccaccagactgacacggcacaacaacacaaaaccgcgacacacacaacacaccacttcagacacccaccacgaacaaaatgccgtacaccaccacacacaccacgcacaccagccaaagacagagacagagcgcaccaacaaccaagcgtcacgcagacacaacacaccgacgcagccgcaaacgcgaaccccagcaaacaccacgaacaacgaaccgcaccgccccccaccagcgacctcgccgcacacacaacaggggaacaaacggcaccgaccaggcagccctcaacagcacacccgcgccacactccggccagacgccgcacagaccgaaacgcgcaagacccagaccgaacaccacactgcagaccctcgagcacacaggaaagatcgcgacactagagcaccgcgcgcgcccagcacaacagcacgaaccacccgagctccaccacgccgaagcagcagcagcccacacaagcccgacgcaccacccgacacag

SEQ ID NO: 537124 - DNA, 218 bp, Homo sapiens
cccgactagcccgacagccgcacccgccgccggcaccacactgcaccatcattcctatctgaccccacctccatccccaacaccaaagccaacaaacaccttccccccatcactcccactcgcctcagcagcaccgggacacccctcacagccacctccctcagcatgatcgctgtcaccttggcccccaccttaggctcctgtcgggctagtcgggg

SEQ ID NO: 537125 - DNA, 120 bp, Homo sapiens
gtaagagactttgactcggagctgttgtctgtccttgtttcctgcctacaggagctcttcaaggcccacttgcgaggggaggtcctgcctgaggagattactgagtgagtcccgtggagg

SEQ ID NO: 537126 - DNA, 446 bp, Homo sapiens
tcacagaaacacaaagaaaaaaaaggaaaaagaggccaacatggtgaaacccatctctgctgaaaatacaaaaattagctggacgtggtggtgggcgcctataatcccagctactgaggaggctgagacaggagaatcgcttgaacctggagggcagaggttgcagtgagccaaaatcacaccattgcactccagcctgggcaacaaagtgagactccatctcaaaatacaaaaaaaaaaattagctgggtgtggtggtgggcgcctgtattcccaactattggggaggctgaggcagaagaatcacttgaacccgggaggcagaggttggagtgagccaagatggcaccattgcactccattctgggtgacaagcgtgaaattccgtctcaaaaaaaaaccaaaaaaaccttgacattcagctgttgggcgttgcgtgcaggggt

SEQ ID NO: 537127 - DNA, 225 bp, Homo sapiens
tctgcatcgctcaatcttttatcttgcatccaccttttccaattgagagagccacactgacctagcaggggaccacctatgcctcacgggctgaccgggggtctactggcagctgtgctattggtcatagagctgcttatgtcctcttccagttcgtcaatcatcatggcacaggctttgaagatggcattggtgggcccagccgaagtgatgtttctcattgga

SEQ ID NO: 537128 - DNA, 686 bp, Homo sapiens
tgccccgtcatgctacccagaatagagtggctttcctccaggagatgggcacacctggctatccggggtgaacgcatccatcagctcatcctcagctgaactagacccaggtgagcacgggctgaaaactgcccctgggctgacttttgatagcgcctgccttgcccaccttaccaattcctttttccaatttacctagtatttaagagtaacccttgagattgtggaggaaatatgaggaggctgtgtaccaaaatagatgtgagaccccttctggggacatccacgtgaaatgccctgaattatggaccatggggctatatgccatatgccctatagagttattatggcctttaagaatgtccgagtatacttaaaactgtattgctggcccgggcgcggtggctcacgccctgttaatccccgccactttgggaggcccaggcgggccagacccatgaggtcaggagattgagacccatcctggcccaaccatggtgaaacccctgtctcttaccttaaaatcaccccaaatgagctgggtgtggtggcgcgtgcccgtagtcccagctactcgagaggctaaggccggaaaatcgcttgaaccccggaggccgagattgccgtgagcccagattgcacccgtgcactccagctgggcgaccgagcgagactccctttcggga

SEQ ID NO: 537129 - DNA, 370 bp, Homo sapiens
  misc_feature (27)..(27): n is a, c, g, or t
  misc_feature (227)..(227): n is a, c, g, or t
  misc_feature (370)..(370): n is a, c, g, or t
tctctcaagtagtgtatcacagtagtngcctcccggtttccttaagggacaacatccttaagtcaaaagagagcagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacnaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagn

SEQ ID NO: 537130 - DNA, 392 bp, Homo sapiens
atggataaggtgagagtagcaggagagattttgctccgattctgttaacttctacctccaacccacaaaacaagatatatgatctgagtatctatcactaattgggagctaaaataactaagggacatgggaatccagtattctcaaccacctttcgacaaagtgtgtattccatctatgtgccgatacgcctaaatttggcctatttatcggtatgtcccttatgttctgataattctgacctgctgtacaaatatcttgacatatgtgcaatatcatgatcatcatactgggtaaaaaaacaaagaatagaagcaaaacacctggtatggccatgatattgtatttggtaaaggttaatctacgaagttaccaacagttaaatgctatat

SEQ ID NO: 537131 - DNA, 484 bp, Homo sapiens
ggcatcctgtgtgaaccgaaaagcgatcattcttatactacatggttcctatttgtataattaccaacactgagagcaggatttaataatgtgcatgacaaatagtctgcattttaattacatcatggatattctgagatctaccaaagacttctttttaaaggaaaagtctactaagtttaaacaaacaaaaaacaccataaatacctcattttaaattacgtatagccttcaaagcaggaggaaatcaaaagaggtaaagaaagaccatagaggaaaaaagggaaaagtaattgtaaaccatgatggaaaactgattaaggcaaataaagcagatttaaaaacctaggtttcctaaatctttctttgttctactaattaaggctggataaaaaggtctcaatgttattaaaatgggcaaatgaagaaggatagtggggaaaacaccaaataagaaatcagcaaacagacacgccagcaggca

SEQ ID NO: 537132 - DNA, 266 bp, Homo sapiens
taactactatttactgggtatagggttctttctggggtgataggaatgttctggagttaaatagaggtgatggttgcacaacattataaatatgcaataaagcactgtatcatatacttttaaatgctaaggttttggagtttccgtcatggtgcagtggaaaggaattcaacaaggaaccaggaggttgtgggttcaatccctggcctcactcagtgggttaaagatctggtgttgcccatgagctgtgtaggtggcagatgcag

SEQ ID NO: 537133 - DNA, 260 bp, Homo sapiens
tggcatgctatctggttcactaatggttaacaaaaaaactataccaaaacttggaggcaggtgtggaagctcatacccgtaatgccaacactttgggaggctacaggcacgttacacacaagcgtgtaatttttgtttgtttgtgtgtgtgtgtagtgtgtgtgtgtatttgtagagacagagttttgtcgtgttgccaggttgggctccaactcctgtgttctagggaattcggccaactcagtcttccaaagtggtgg

SEQ ID NO: 537134 - DNA, 664 bp, Homo sapiens
  misc_feature (15)..(15): n is a, c, g, or t
aagaatacatgtganttgactagtattagattactaaccatttcccatctctatattaaacataaatcacagataccaagattcactttagatatgaggaaaatggttttaatggacacaaaggagtcagccacgttggaaccaacatagtttcataccacgttgaaaccatgtgtttgatatgcaaataacagcaaataattttttcactcttgtcaatgccaatgcattgaaaggcccagaaaatgagaaaaggataacaaacttttgataaaaaggtaagaatttctgtgtggatgttcctcagtttctgggaaaattttgctacaaaagagatttaaataatttaggaggcagtcttttgcatggtatttttggcttacctttgaatctagtggacctgtaatatgtaagaatgaagaatgtgcttagcaaactgaaatgagaagatttctatttcttaaatttctattcctgagattatataaaatttcacgcaaagagtaagcattagctttaaatacttcttccaaatgttcctagaattttgagacaaagattgttaaaaattaatgtatgtctttgttttaggcagaactggaaatattaagtagtgagagtactatagtttcccttttgcctacataaaagcattttaaaatta

SEQ ID NO: 537135 - DNA, 1163 bp, Homo sapiens
  misc_feature (15)..(15): n is a, c, g, or t
aagaatacatgtganttgactagtattagattactaaccatttcccatctctatattaaacataaatcacagataccaagattcactttagatatgaggaaaatggttttaatggacacaaaggagtcagccacgttggaaccaacatagtttcataccacgttgaaaccatgtgtttgatatgcaaataacagcaaataattttttcactcttgtcaatgccaatgcattgaaaggcccagaaaatgagaaaaggataacaaacttttgataaaaaggtaagaatttctgtgtggatgttcctcagtttctgggaaaattttgctacaaaagagatttaaataatttaggaggcagtcttttgcatggtatttttggcttacctttgaatctagtggacctgtaatatgtaagaatgaagaatgtgcttagcaaactgaaatgagaagatttctatttcttaaatttctattcctgagattatataaaatttcacgcaaagagtaagcattagctttaaatacttcttccaaatgttcctagaattttgagacaaagattgttaaaaattaatgtatgtctttgttttaggcagaactggaaatattaagtagtgagagtactatagtttcccttttgcctacataaaagcattttaaaattagttttatgatttctttgtaagctttatttaaattcaaagtctttttcataacacttaagagaaagagccctttgtacttcttagtatctcttatatagtcccaaatatagtctgtggtttattttaggaaaaacatcaactctgaatacctggaaaagtcaaaagaaaataaagttggtaaaatgaaaaatgtccaagtaagaaaaccggttacatttgcaagttatgtgaagtaaatttagaagttaaatttccattttgtaagagaaaaacatcttacttggcaaatcttttcttttggagctaattattctttgatttttaagtccacataagagaatgaactttgatatcagcttttctgattttttaacaaaggctacccttgtttattatgaaaaatattacttttatgattctattttgaatttttaaattttgaaataattccaaacttacaggaaaagttaaagtacaaagaacctttttccctgaacca

SEQ ID NO: 537136 - DNA, 915 bp, Homo sapiens
  misc_feature (490)..(490): n is a, c, g, or t
  misc_feature (768)..(768): n is a, c, g, or t
ggtacttgctctctgcttggccgtagtgggcggccgtcttcatgatggatctcgtgcactatggcgacgggcgggcagtgcggcccagcaagatcggacgccgagctttccggagaggatgatcgggcgcatgatacagcggctagtcgaccctcgacggagtgcgctacgcagtgcgtgtatacgatgacctgacactctgcgaacgcaattgaagtgtatgtacggatgtcggccatccgtctgcgcggagtcaccgtagtcccggccgctagctcggtcgtcgtcatcatcgggacgccccggggcctctcgcggctcccgtcggcgctcgggggccctttcgtggcatgactctctccgggtccgcgacaagctttgatcttccggatcagccagtggtcgcgtggtgaagggaactggcgcgccgcggagcactgcagcacgtaacgtgcgcaggacgcctggtggcgcaccgtcagcgtagctntggcatcgatgtgtcggagcagcatgcgacggcctcgtatcatgcctcggttcattgagtggtggctcgtggctttgcaccaggcctcgtatgccactcgctcttgtgattgaggtggggcacccgtgcgtcgtggaggatgcggcaaatacctgctgttgaagacgtgcgtgccagaccccacgtgagttgaggctcgcgcaagacacaggatacatcgagcagataccctggtggcgacagatggtcgtccttctgggcggaaaagcgcaggccanattgctgagcagccgtggacttccagtacaccaggcgcagcctcctctgtagaaccccatcccagcgcgtggacccatggacggcaggaattccacagaacgcatcccggagtatgaccaaatcccagaggagtatgtcataaccac

SEQ ID NO: 537137 - DNA, 481 bp, Homo sapiens
  misc_feature (326)..(326): n is a, c, g, or t
agaccacagcctgctttcttctagagtactttttggttatccatgcagggctcaggagctatacagatgggatagagggtgtgagtgctgggaagccccatccatggctcgctggagattagaggcctgttaatctgaagacaaaggaatgaagacgaaaacgtttctgaaaatgtgggtggagacacctgggcctttacagggtacgctccagagctgcttccaggcagggaccccggctgagagaagccagagccagagagtcgcaggcttgcttgctcttatcttccctctgctgggggggtcgaggggagatctggcccctntgctctgccctcctgatttcccgtctaagggatttaggagacttttgccttttcctaatctctccctttgcagaatttctgcgaagtcacaatcccatttccaggcaaaggtgcttggtcataaagataataaagatattcattcatgaaaaaaa

SEQ ID NO: 537138 - DNA, 311 bp, Homo sapiens
tgatgagttgctgtgggagccgacctggtgctgtgggccgttcggaaacacctgcgccggctgtaccgtatgcaggagaggcgcggaccgcaccacgtccgatgccatgctgccccccgacccaacccggctcagtccctgaaactggatgcccaaagtcccctctagggggaaccccagacccttagagagtcctgaccttactcgtacctggggtcccatatcagccccttcattccatgtgggggggggcggcaaacaagtatcaaaatattgggaaataaaaaaaagataggtctgagtcaaaaaac

SEQ ID NO: 537139 - DNA, 2170 bp, Homo sapiens
  misc_feature (1405)..(1405): n is a, c, g, or t
  misc_feature (1726)..(1726): n is a, c, g, or t
gagcggacggcaaggcacagacaggcagacttcgctcagcacaaacgacagaattttctgactaaccatacatggcaaaactgaactgtggctgaccttcgtgaggcgtctgcaacttcttcactcccatgacaggcaattcagcatagaattcgacgactgacccacctacacgacacgaacatactcacaggaactgggtaacccattacatcatgcgcaacttgcaagctgcacacagcacaacgctccctacactattcatgcatgctgcatgctcattcctacagacacaccggacgcctggccctgtgcgcctgacgctggacgaaacgaggcacacgcaccaccggaacacgctgaccgcacacacccaggaccacgcctgcgacacataactctccactcacacacaggaggatctctaacaaatcccatcagtggaacacccaaaccttgagccttgggctcatggcacaacctttgtcacaccataacatggcgtctatatcacgtaagttctttagcaagaacatacccattgggcaccctacagtccgtccaacgggcaccaattggcgcgcccattggctaacgatgcgcaacgcccaacaacgcgggctacttgctctattaaagcctctcgttaccttgttgaagatttccaacatggtcaacgtttgggcgtttcaacctcaatgggaaataacacccgttcacacatcgaacgatcgcattttggcgattccttaataggtctaataagtgtaaaactaacgtttcaagctcctcattttgtgaggagcaatactcacacaagctgccagttctggtgctattcaaccacacgttaatactcatcagggacaaaaggcgatcgccgcctaattatctcctctatatcgcatgcgctgggccacacctctgggcacaaccggcctgtggctatttataccgctacaaagacagcatgcggagcccttttaactacttccactcacgacattactgtttaccacatatatatcgtgtccgaatatatcccgacatttcattcaaacagtagtggcgaggagccctaaaactacacagcgatggcgtgcaacccatcatttaagggccacacacgttgtgactatcactgactgatcacgtaattacactaaaaagcttattgggctctcgacttagtggctcacagcaccagcgttgggcaagtcatgggtaccactaactattagggagtggatcagggaacccctatgattacccactcacaattttgacctaccgctataaattcataaggtaggggtcacattaggagcgcgggtatctgggcgagaacaagaaacccgaaatacaattatacaggggaggtatatcacccaacatgtcggatccntaccagcagatcatagggacagtatagtagaactatcgaccatacaccccagcgatgtcccaccgtcacaaagcatattgcgacacacgagatacttacgctgtaaaacagacccaactacaaatatataactgggctaccctgaatttcatcatgatatcgcctgtttatcctctacctcggaactagagtcagtgtggtgaccattttgggacaccagtcttagtggggctcaagatgctttgtggctactcctgcatcacacaagatcgcacgaccggagtactattggggatgccctacttgagggtcacgtgcatnacatgactaggtgaactccacacgtttttcacatacaaccactccctctcgttgtagataatgcagtcatcactgagcgctccttgctttactcaaaccaacaccgccactttaccaaccaagctataggtgcatattgggacaccaccattataagtttctcccggtgtgtacagcgaatcagcctacggtgcagtatctactacagcaagtagcgggaccgcaccgtacgaacatactggtgcttcccctcacataatagcagtcctcttaggtgagtcgatcgacagaccatcttggcgaacaccatagcaattgtggaggggaccaccgtattactacaacagcagaacactgagccgacgtttggcgtaggtgacccattgtactctccaccttctccccctaaatcccagtgaaaaatctcaagctcattttcccccc

SEQ ID NO: 537140 - DNA, 828 bp, Homo sapiens
gcatggtgcctggaaagtcccctggctcatgcttcctgctctgggaacagtgttgtcctctggtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggcctcctctctcttttctttctgcctctatgggggtgggggtattgggggaacttggggcgatcgtgaggtactaagccccttcagaagagatgggggaccagtgtgggggcatactgcgatgatggccgattcctgcctcgtacacatgccaggaagatgtacccgacatcggtggacacagctgcactagttatactccacttactttgctctgagggggtgagaaaaaaggctttacctctttcatgacactggcaaagactaccagaacccgggcgtagagggatacccctgaggtcaaccaaagtcatgggcccccaagattacaaggacaaaaagggcctaccgagtaagaagcgccaaaaaggataggggaagcatggagcgaatggacaagccaggacccaaaagaaaccccgaaatcgcaacgacaccgacaaggacacaccgacgggacatgaagacctggtggccggagccggcacgaccagcatggaagcaagaccaggccaggagaaaagaagtggacagaagccacagtgacaaacaaacaacccgc

SEQ ID NO: 537141 - DNA, 112 bp, Homo sapiens
gtcaaaaaaatagtggaaatcgtcttattcatcatgaaattctcattgtctttgcgcaactattctttgtggatcacaagtcacatcacctagccataatgcacgtcgacgc

SEQ ID NO: 537142 - DNA, 183 bp, Homo sapiens
tacgtgtgtagaaaccctactagccgagttgtcatgatccagtcctccagccatgcatctgctcacatggtctcgaacaaaggatggatgccactctgatccttcgatctacccaggaatcctccgaggaggagcggaacataaagatccaaaactgcaagtccaacaagggccttggcaata

SEQ ID NO: 537143 - DNA, 294 bp, Homo sapiens
  misc_feature (69)..(69): n is a, c, g, or t
  misc_feature (80)..(80): n is a, c, g, or t
  misc_feature (217)..(217): n is a, c, g, or t
cccacacccgggatcttcctcctcaccctccttggcctctctcagtgaccctgtctacacacagatgtnctgtccatgtnagtggaaggaaggaaggatgaggtccactcacaggggtgaagctgtctcctgagggggcagcccacctccaggtcacaccgccccacccaacacagcctccagtccagctccaggtgggccgcacccagcccttcantcacttcaaatggcccaagacgcatggattccattggccagccggactggaacaacttctcccctttataagtatct

SEQ ID NO: 537144 - DNA, 95 bp, Homo sapiens
agcggggtgtggtgatggccgcggagccgggcggagctggcttgcggtcccggggccggctctccgcgccggagactatggccctggtggtgccc

SEQ ID NO: 537145 - DNA, 344 bp, Homo sapiens
  misc_feature (51)..(51): n is a, c, g, or t
  misc_feature (82)..(82): n is a, c, g, or t
  misc_feature (200)..(202): n is a, c, g, or t
  misc_feature (206)..(206): n is a, c, g, or t
  misc_feature (208)..(209): n is a, c, g, or t
  misc_feature (212)..(212): n is a, c, g, or t
  misc_feature (214)..(214): n is a, c, g, or t
  misc_feature (216)..(217): n is a, c, g, or t
  misc_feature (222)..(222): n is a, c, g, or t
  misc_feature (227)..(227): n is a, c, g, or t
  misc_feature (232)..(232): n is a, c, g, or t
  misc_feature (239)..(239): n is a, c, g, or t
  misc_feature (244)..(244): n is a, c, g, or t
  misc_feature (249)..(250): n is a, c, g, or t
  misc_feature (257)..(257): n is a, c, g, or t
  misc_feature (262)..(262): n is a, c, g, or t
  misc_feature (271)..(271): n is a, c, g, or t
  misc_feature (275)..(275): n is a, c, g, or t
  misc_feature (296)..(296): n is a, c, g, or t
  misc_feature (321)..(322): n is a, c, g, or t
tttttttttctttgccatccttgattgggaaatcattcaaccacccatctnttggtccatctgtccatccactatgtcagcnggtccagcccccagcgcctggtcacatgactgtctcccactcttcctgtagcagggcaggtggccgctcaggcccagaggcctcctcgtccaggcctgagcaggagccgttgaggaannnatcntnnttngnannttgcnatggnaggtngtttttnttttntattnnttttttnttttnttttttttntttnctttttttttttcattttttnattttcatttttttatttttttttnnttttttttttttttgcagtggg

SEQ ID NO: 537146 - DNA, 301 bp, Homo sapiens
  misc_feature (152)..(152): n is a, c, g, or t
ctaccacgttatgaatcctcctcctccttgactgagcaggtatgggttagagagcgagggagtgagtgaatgagtgggctaaagagggccgggtgcggtggctcacgcctgtaatcccagcactttgggaggccgaggagggcagatgatcntgaggtcagcagttctgggagcagcctggtcaacatggtgaaacccttgcctctactaaaaatacaaaaacaaaattagccaggcgtggtggcgggcgcctgtactcccagctactcagaaggctgaggcgggagaatggtgagaacct

SEQ ID NO: 537147 - DNA, 180 bp, Homo sapiens
caaagtcatcagctcggcccgaatgtacggtcacgtagggtattagtacttctagtggggtcacggtaatgtcccctattgtcatatctgatagcataaggtggggggggggatatttttctttttagtctacctagtcaatctataatctttttttttttttggagttttcgggtttct

SEQ ID NO: 537148 - DNA, 161 bp, Homo sapiens
catgcagcaagctagacagcgcatgtgccaccccgaggtgaaattccatccaccgacaccttgggtgatatggaacatttacatacgacgagttagtggatgtataggcgacagatagtcagtgtaggctaacaggtgcgaattagtactaggtatgccga

SEQ ID NO: 537149 - DNA, 503 bp, Homo sapiens
gcgatgttcgattgcctgagttttccgttccagccctcataatcccaagacctgtggcttaacaaaggcggctcaaaaatggcgcggaaacttcccctaattgtgagagccgtcaaaggcatgcttggggtacgtttgttacagattgcccttctgctataaagtctgggccctcctttttcccgattaacacaggcgatgctaagaccccatttgttgcctagcaatgaaacgtttcggatatgggaagtccccgggtttataagaaaacgctgagtccgttctctgtgttaaagttcggctccaaaggttccgtgcgcacctcgctgcgacctttggcgttttcgagaacggtgaataagtcacgtaggtgcgctctccagaggtgaagtgtgttcgctcgaaacggttcggggggcttcttcaatagggactggtactctgtctctgtctgtgaaaaacgcgcacagctggagacaccctgggacagacaaattgtgatt

SEQ ID NO: 537150 - DNA, 271 bp, Homo sapiens
cccccgggggaggggaaaattttcccccccttttttttgggaaaaaccccccccgagtttaaaagggacactttgttgttttctcttttgggcccccgggccttaaagggtcacgcccccaaaaaccttttgggggggggtttctttccacagtttttttttaaattcccctttttttgggggggggggtttttaaccccccttcccgggggaaatttaaaaaggggggttttttcccggggggaaaaaaaaatttgggttgcccttttta

SEQ ID NO: 537151 - DNA, 503 bp, Homo sapiens
  misc_feature (158)..(158): n is a, c, g, or t
  misc_feature (255)..(255): n is a, c, g, or t
  misc_feature (308)..(308): n is a, c, g, or t
  misc_feature (318)..(319): n is a, c, g, or t
  misc_feature (321)..(321): n is a, c, g, or t
  misc_feature (416)..(416): n is a, c, g, or t
  misc_feature (429)..(429): n is a, c, g, or t
acacgatcttcctaagagagtaccaagacccgacaggaccaagtgcatcctataacacccaccctacctgaatgtccagcgggaaaaatgggacccatctcccagatacgtgggaggccaagagcatttcgctcacttgctgatcctcagggacaccnaagacctacatgcttgcttttgacgtgaacgatgagaagaactgggggctgtctgtctatgctgacaagccagagacgaccaaggagcaactggaanagttctacgaactctcgacctttcgcattcccaagtcagattcctgtaacccnattgggaaanngnataattgtgcgccactggagaagcagcacgagaaggagaggaaacaggaggaggggaatcctagcaggacacagccttggatcaggacagagacnttgggccatcctnccctccaacccgacatgtgtacctcagcttttccctcacttgcatcaataaagcttctgtgttttgaacagcta

SEQ ID NO: 537152 - DNA, 994 bp, Homo sapiens
  misc_feature (604)..(604): n is a, c, g, or t
tctataggatccccggttctcgatcaaacgcctcggtacacgcaacttgctcctccagcttagacatcaccgtactgctcaaaccccgccgtcgtgctgccgcccgcgcccaggatatttgcgccgcggcgacaacccccacgtgcaggtccggcacttgcacctgccgattaatgttcagctcaagaatgtctgcaaagggtatcaaccgacgaaacgcggcatcagacgggtaccagcgatccatcaggatgatgctgtcaggtggctgcgcggccagtacgttttgagtaatccagctgcggctgtcggcaaagcgctcacacacctcaagttccagatcccggctgggatctcgggcgaacgtgttaaccagagccatcgtttgcgctcgacagggatcgctcttgcgcgcgcacagtcgcacgacctttatgttgtcggccctcaacgctgtcgtaacggcctccaacagcgtggttttaccggtgcctttggggccatccatcgaaataaacagcgcacgagtcatacgggcgctgcatcatcgttcaggttgtgcagttccatggagcctcggggtctgtgcggttgggcgagttgncctccattatgggcaaccctattgcccaatgcgaggctggactggccgacgtgccctccccgcgtcgacagtcagtcattcagcatccggctttccggcacaccagcctcatacctcaacgcccatggcgcaatcaaccgctgcggggtctggcaggctttgcgtttaaacacgaagttgcggcatttctcggcaaactgctggcggttttccaccatgtcgagtcgcatctgagccagctcctgctcacgacagcgttcaacttgctgagtatccagcatggcttttcgcgtgcgtgcgtgaaggtacttatcatcggtcgacgacacggtcagcctcttgcaaaagccacaggccgaatgtttgatcgacgctacggggatcactcta

SEQ ID NO: 537153 - DNA, 117 bp, Homo sapiens
aattgagctcggccctagtttgtgtgatggagtgatgaggatagttgtgccagcaggcgcataaggcaagttgggtatgccatttcctttgaagtcactccttcacccaaagctagt

SEQ ID NO: 537154 - DNA, 996 bp, Homo sapiens
gaagctgctccgcagaaaatgtcatgtcagtgtcggtgcatgatcagaggcaccgaggatgctggagacaacatgtagctgtaacggcctgggtgagtacggctcggcacagttggccgccttgtcggtgagacgctagcatgcgaggcttgggaaaggagctgtctgggctcggtagccgagacccctgactcgctcggcgaagctcgcgtgttcgtactaccccgccccaggtgcagcagttcatcaactctccaggcgagagaacagcaaggatcttggataggagttcccatgggactaatgatgttcaagtcgcatcacaaagttgtcattgtcgatcgaaatgccattcacctatctgggaaaatttccattgttggtaccatagcatgacgttagttcatcttgcattttggtgcatttcatctaggggactaaactttgtcataaagaatgatccgcagcgcacatctctgcataaacagcttcttcttatggatactaagaagaatgtcctactgccagacctgagctacaacaggtttctgcctattgcacatggggtgccattgcagttctgggcaccgaggatggcgcgtgtgctgtagagaaaggcgcaatgctgcgggtagatgaagcaccgggtgaaattccccaggttagtggctgcattaacaaaccgatggatgtggccaccctctatgaaacttgaatgcgacgagatgcactttgcccgtgctgaaccagtggcagccagtgcacgagcgaataccttgcttgaagagaagctaccgaatggatcgtgcgggaggaaattacactgaggcggtgagacgatgggagaacgtccgtgtctctagcccggtgggtcctctgccaaggcagctaaatgctcctgtgagggaagggactgtcggtgaattcccctccttcctttcacccttgaaaatataaagcccgccaatgaagaataaaatgactccagaatgctaa

SEQ ID NO: 537155 - DNA, 231 bp, Homo sapiens
gcccacctcctacagccagccagcctgcctctgtgaatatccctgggaaggtcttccctctagtacaccttataccatgcctccagagccaaccctttcccagaacccaatctcttattatgaatgtctcgaatgtcccaagtttgcaatgcccaggttcaaaccggttataccatgaatgcgtatcaagacatgtcgccagctcagatgacggctcccctcccagcgtcg

SEQ ID NO: 537156 - DNA, 310 bp, Homo sapiens
caaagcttagtgtgacggtccacgtgtgcactagatacttctcgagctcgtacattacgcggtcgtgacttacgacaatactcgtggcgccagctgcaggcggcgccatatgcatcctaggcctattaatattccggagtatacgtagccggctaacgttaacaaccggtacctctagaactatagctagcatgcgcaaatttaaagcgctgatatcgatcgcgcgcagatctgtcatgatgatcattgcaattggatccatatatagggcccgggttataattacctcaggtcgacgtcccatggccat

SEQ ID NO: 537157 - DNA, 350 bp, Homo sapiens
ggaccatccagctcgtaggcccagaccagagcccaaatgcacacaggtgcggcctctgccatatcacagccctctcctggagccaaatgctgtccttctttgccatagccaatcctcctcagagcagccatggcctacaggcctcagggactacgggtagtctctccgatcgcagaaatcccaaagccagagttgtccctgaaccagctgtgcgcccccatacgccccaggtagggcaatgcatacccccaattccgatacgaacaactcatacacctcctataaaaaaaacttcctaccaatcaccctaagcattacttatattatatgtctccatacgccctggtaag

SEQ ID NO: 537158 - DNA, 565 bp, Homo sapiens
aggagatacgtcatggattgttgataatgacagcatccagtagtgagtagaagaaaagaaatgatagatgctggtcgttattgcacgtcaaatgggcagtatagacgttggcgtaaacagagtctcagatcccactgagtgctatgcaaaaggggcatatttccctgttataacacaggtactatttatggcctcacaaagcctgcagtcgctacacagtgaaatcccagctatgagacacatgcaaataatcctacaattagcaaatatgctacagaaaatatcattctctcttttatgtcgagcctcacatcaccaatagtactcccatagtgcaagggggagactggcccagattctttacactggaagcaagtgattctgcatacagtgcagatacttacctcaatacaggttgatagctcattaacacagcttagatttcatgaaaaagtctgcttcctggacggcgcggtggatcatgcctgtaatctcagcactttgggaggccgaggtggatagatcacgaggtcaagagatcgagaccatcctggccaacatggta

SEQ ID NO: 537159 - DNA, 692 bp, Homo sapiens
aacaaacaatgccatcactggaatttcccaccgcttgtgagccgtgtcgtatgacctagtaaacttgtaccaattcaaaaaaaaaaaaaaaaaaaaaaaaaaaaaaaaaaaaaaaaaacaaaaaaaaaaaaaaaaaaaaacaaaaacaaaacaaaaacaaaaaaaaaaaaaaaaaaaaaaaaaaaaaaaaagacagagaacgagcgaacgcagcagcaacgatgatatattattgatgactaagaggaacaaccagctaccaccgggcagcgcgatcaacggagagggcggcgccacgggaagacgaggggtcagtacgaaaacgagcggggcgagaggacagagagcgcggccgctggaacaagaaagaacgaacgagagagacgagagagaacgaagacggagcagaccagggagagatccactacaccagcagaaaaagaaaagacgaaatgtaatcatagtcagtgggtgcaggaaggtagacgcgagagatagaaagagagagagattgagagaaataacgagtcgatagtagtgatttataggtagttaaggcagggtacgatggtggaaggagggatatagcaaatagaataaaaagaaaaaatgagagatatatatatagatcgagaagagatgcataaataatcaggagatcaggccatcgtaactgtatcataaagagaggt

SEQ ID NO: 537160 - DNA, 221 bp, Homo sapiens
ccaacgcaaagccccctacgaacacacaccaaggactcaaccccagaccacccatgcctcaggatactcctcaatagccatcgctgtagtatatcgcaaagacaatcatcattccccctaaataaattaaaaaaaactattaaacccatataacctcccccaaaattcagaataataacacacccgagcacaccgctaacaatcaatactaaacccccata

SEQ ID NO: 537161 - DNA, 269 bp, Homo sapiens
caggaattctccctggcattgtttcccccccctggggcctgcaggccccccagggaccccgggggaggacgtgaagcctcccgaacccgcccaaaaggaaggagccagctccccgccccctcctcgcaggggtcatgattttttacaaattatgttttaattcccagggtttctgtttcaaggaaggatgaataagttttattgaaaatgggggacctttttttaaaatgatttttacccttatgaggggcggcccagattttaagtta

SEQ ID NO: 537162 - DNA, 893 bp, Homo sapiens
gtgttgagccagcgcagctttacatcaaaacagaagctattgtgaagttcaaaatccagtccacaggaatctggggtatggggttgcaactgcagaaggttaacttgaatcagattcctcttggacgagatatgcagagtcctggtgatgagaatagtgatggagaccctattacgcagcaagaagtgagagagaaaaatgaggctgccagcaaaaagtcttccgcgaggaaggagatgtggtgggtattagttatgacgcatgtcgaattaaagtgtatacttgaatggaaaaaacatgctattgtccagacatcaggtatacgagggacaggtatccagtggtgtatgtgatgagagggcaattgggtgatgccagtagcagtgagtttccatcagtagcgcgctccacgcgggtggtggaaaatgtattatttgaacaggaaatcgtctgaatgtattgggtttgtaagaacttgtatgtctgcggtgtgaaaaaatgttcatgatttaataaaatttacctggctatgagatgaaagtatattcttaagaaatatgttgggtggatgctgtttaaggaagcaagtattcagtatagacaccctgaaagtggtgattagaatgacttatgtttgtgaatgaaaataagcattgggagttattaaatcttatttaattaatagaatctgggtccattaccagtttaactgaataatgtgcgtatttatttaagggaagtctttctacatacgatttggtgacacatgtcaaaggggggggtttggccgcaaggtaaccgcaaattggggcacggggaaaaacggagggggtatataaaacaaagagagaatacgggcagagcgctatataagaaaacgatgcgggagaggg

SEQ ID NO: 537163 - DNA, 113 bp, Homo sapiens
  misc_feature (74)..(74): n is a, c, g, or t
  misc_feature (99)..(99): n is a, c, g, or t
ctctccatctgcactgatagttctcgtacgagtcgtagtgggtctgttgtgttgtagtccacaatcacaccgtnggtcgttgtacaagtgttcggaccncttgaatcttctca

SEQ ID NO: 537164 - DNA, 581 bp, Homo sapiens
ctaactcatgcccccatgtctaacaacatggctttctcagcaaaaaaaaaaaaaaaaaaaaaaaaaaaaacggggggggcgggccggggccctggaaaagtttttaaaacacattcggggtgggggagcgggggccccaagtatgaggtatacgggcgaactggggccaaaaggcggtgttcccaagaggaaaacccggggccaatggacaaagagggccggaggactttctttcacaccaatattaaaaaaagcggccgggggggggaccacgcgcgcgaggcgttcgatgggacaacaaaatcccgagaaggggggagatacgaggggaagggacaaatagcgggggaactctattatacacggggagagagtcacaaaagagcgagaagcgcgcgaagaatatatacaaaaagtataaagacccccgagaccggcggggggaacatgacgtatcggaaaaaaggcacgaaccagcaagaaaacatacagcaaccacaagaacagcacaacaacaacgaagaaccaacaaataccaacaaatagcagaacacgtcaagcaagaacggcgagagcagcac

SEQ ID NO: 537165 - DNA, 597 bp, Homo sapiens
  misc_feature (573)..(573): n is a, c, g, or t
ttttgtctctgccaggttttggtagcaggatgatgctggcctcataaaatgagttagggaggattccctgtttttctattgattggaatagtctcagaaggaatggtaccagctcctccttgtacctctggtagaattcggctgtgaatgcatctggtcctcgacttgttttggttggtaagctattaattattgcctcaatttcagagcctgctattggtctattcagagattcaacttcttcctggtttggtcttgggagggtgtatgtgtcgaggaatttgtccgtttcttctagattttctagttaatctgcgtagaggtgtttatagtattctctgatggcagcttgtatttctgtgggattggtggtgatatcccctttatcattgtttattgtgtctatttgattcttctctcttttcttcattagtcttgctagcggtctatcaattttgttgatcttttcaaaacaccagctcctggattcacagattatttgcagggttcttctgcgtctctatctacttcagatctgctctgatcttaaataactaagatcagaaaaatggntctttacacaggggttccccactc

SEQ ID NO: 537166 - DNA, 877 bp, Homo sapiens
tgggtcaagtacactcgtgtgcacgtggctacatccgctgccccttggggccttacgggcattcgagcccttgcagggctcaacacatccgtctccagccctttggcaagccccggaaccacgatgtcacgaaggagcccttccaactccagagtcatggaatcgctcgggaaaggttctgtcgacatgggcatcaaggaaccagcgtgacttgccctgtcagtgtcctacgtgacggtcagcgtgctgctactcatggctccgcactgaccgagaccgtgcgacctcatgtgcactgtgcacaggcaaagcagtgcatccggtactgctggtccctcaaaggcccagtcaccaatcgccgccaatccttgatggcagccacgtcagcatgctgagctcagacttcaggcccagcctgccgctgccccacttctacaagcacctgctgggcgccgagcactggggacgagccgcagccatcggcgggcctcactctgcgccatgggcctccaccagcagggctctggagcccaagctacctaggaccgcaacggagcatgctgcacggaccgtcctgtgcagcaaccattggacgaacgagcgtgctcggcggccaggaccagtctgcgcgtccgtgtgacggaagctggagcacgatggtgcgcaacctgcagcaagatcaatcagggacctgtctcgacttctccacgcgcttcataacgcggccaggccaagtgaggcacacggagaccccggcccgaggcagacccaggcctgagcctccatgcctcaccagcaacaagggcccacgggtccccccccaccagccaggcctgactctcctcagttctgtgtcgtgttcgggtttttcctctgg

SEQ ID NO: 537167 - DNA, 515 bp, Homo sapiens
atatactatacgtagtgataataaaatctctgcatgttcagcatcctgtctctcgcgtctgtctctgtctccttcttgtctgtttttccaccaagccaggattaggtgagactgaatactaccccacattagtagctgaacgggggagggaggagctcttaaaactgaagcatcccatctgctgtatacgtagaagggggaggaggaggaaacaagatcctaacagtacttccagccttagtcccaattttgtagcgaatcagaattctagctaatggcatatgtgtcgcctttgttgagtagtttaaagacatctaaggaatatactctgaatttcacaatcaacgttaaattcattaagcaatagtaaaagtgatgataaacccgccaacccccagtataatatctccatctacatagtaattgcttcaatggaagaattttatgttttagtattacacacccgaatcagattttagatttctattttagctgttttatacttgatatactcc

SEQ ID NO: 537168 - DNA, 339 bp, Homo sapiens
  misc_feature (29)..(29): n is a, c, g, or t
  misc_feature (47)..(47): n is a, c, g, or t
  misc_feature (82)..(82): n is a, c, g, or t
  misc_feature (101)..(101): n is a, c, g, or t
  misc_feature (129)..(129): n is a, c, g, or t
  misc_feature (229)..(229): n is a, c, g, or t
taggggattcccagggagcccaagggggnttattagatggcccttantccaacctttatgagaacagccttatcccagccgntgagcttttgccccccagntatgtgggttgtttttaggacaccaggntgcagatgatcagggatccaatatgatttagagaaccagtgcagattcaagatttatggaacagggatggggaggcctttttcaggagcaggggcattgntgattttgtttgcccaatccatcctgttcaggaaaccacaaccttgcagtatttttaaatatgtatagtttttttttgtatctatatatatatatacacatatgtatgta

SEQ ID NO: 537169 - DNA, 170 bp, Homo sapiens
  misc_feature (29)..(29): n is a, c, g, or t
  misc_feature (35)..(35): n is a, c, g, or t
  misc_feature (71)..(71): n is a, c, g, or t
  misc_feature (147)..(147): n is a, c, g, or t
  misc_feature (149)..(149): n is a, c, g, or t
accctgcctgtacttaaaatttttaaaancattanctgggcatggtggctggtacctgtagtcccaggctnacgtaggaggatggctcgggcctggggggtggaggttgcggtgagccgtgatagtgccactgcactgaagcctgancnacagagcgagaccctgtctcc

SEQ ID NO: 537170 - DNA, 470 bp, Homo sapiens
gggaaggcaagggttaaaggggtccacaagccccaaaagaaaaagaatcggacggtacccaactttcggggggccaaggcaatgggaattcggaaaccagccaaatattcttggaagaacgcttccaagaaaaacaagcttgaccactatgctattattaaggttccggtgaccacttagttttgccttgagaagattggagaccaccacccacttggggtcattggggatggttaaggcaacaagcaccaaattaaacaagctgggaaaaagcctgattacattgatggggccaaagtcaacaaccttatttcgccctgatgaaaaaaaaaggcatattgtcgactggcttctggatacatgccttggatgttgccaccaaaatgggatcatttaactgaatcagttccctaattccgaaataaaagcccgcttgggcccagtcaattttagactggacaaagcttatg

SEQ ID NO: 537171 - DNA, 1676 bp, Homo sapiens
cttcccccaggtgaatgtaacgggttgcctgctacaatgaaaaattattcctgtttgacgcagggggaagctacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggccattcagcaggccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctcaaatgtgcccgcgtgtatggcagacggtgcggggtggaggccgtcacgcccatacacgtgtgcacacacagcggggggctgtgtccacggactgcgcacacagtatatattaacatatatattgctcaagtatatatgctatttacagtatatatctctatcaacataaaacacaggtatttataggtgtgtacaatagatacgtcctaggaagtctaggggacacacgactctggggtcacggggccgacacacttgcacggcgggaaggaaaggcagagaagtgacaccgtcagggggaaatgacagaaaggaaaatcaaggccttgcaaggtcagaaaggggactcagggcttccaccacagccctgccccacttggccacctcccttttgggaccagcaatgtacgagttttgttctggagttttgtgcaaaacaaattaacttaaaaaaaaaaagttggtttctaattaatgtggtgggccttcaacacccacaaggattttaaagaacagcttctccttctggtgggcttccagggctcagagggtcccactcagagaagcagggaacactttgtcaggactagaaaatatcccttctcctctgaccacagaaacagcacaactcggctgggtgtggtggctcacgcctgtaatcccggcactttgggaggccgaggcaggcggatcacttaactcaggagttcaagaccagcctgagcaatgttacgaaatcccgtctctattaaaaaaatacaataaccagccagacgtggtggtgcgtgcctgcaatcccagctacttgggaggccgaggcaggagaatcacttgaacctgggaggaggagggtgtagtgagccaagatcgtgc

SEQ ID NO: 537172 - DNA, 156 bp, Homo sapiens
tgctggtagagggtgactgtaatcctaacagttgggaggcatgaggcaggagaatccttgcacacgggaagtggaggttgcagtgagctgagatcgcatcactgcactccagcccaggcaagacttcatctcacaaaacaaacaaaaaaaacagag

SEQ ID NO: 537173 - DNA, 908 bp, Homo sapiens
  misc_feature (8)..(8): n is a, c, g, or t
  misc_feature (144)..(144): n is a, c, g, or t
  misc_feature (146)..(146): n is a, c, g, or t
  misc_feature (156)..(156): n is a, c, g, or t
  misc_feature (211)..(211): n is a, c, g, or t
  misc_feature (216)..(216): n is a, c, g, or t
  misc_feature (258)..(258): n is a, c, g, or t
  misc_feature (276)..(276): n is a, c, g, or t
  misc_feature (453)..(453): n is a, c, g, or t
  misc_feature (467)..(467): n is a, c, g, or t
  misc_feature (775)..(775): n is a, c, g, or t
ggcccccnagcggcttctcccggcggccctggggactgcccccccccccctcccccgcctcccccgggcggtgctcccgcccgccgcctgccggggtgggcttcccctcgcccctcccctcttgccgtggctttttcctttggngngggggggggngggggaaacagttttgtgctttgtcgcccctccctttttcagccttcgcgggtgnggggngggggtgggggggttcgtcgttttgccaaaatttcctttgtncggtttttcccgcttggntctgtggcggcggggtgcggggggcttgggccccttccctcccccctccccgcccggggtccaggccgccttgggcgtgcggtcccggcggggggggggtgtcccctccctgcccccttgccccctgggtggtcccgggggcctcccccgcgcccccgtgcccctcccttgggccgngaggggggccgggntttctgccccccccccccccgcttcttggggccggctctgccgatcggggctgggggcttggctctcctggccccctgcccacccccatcaagctcagttattgcataaaaataagggacccccagcacctggggtgggggtggtgagtgggaaggggccgagatatggctataggggcagcaatctccccaccacttcttggggtgcaggagaagtcccctcctttccggtgcccaccatgtcacgcgtcctcagtgttggaactaggggctcccgccctgcggaagaaaaagtgtctttgtgcccncagtgcggaaaagaggggagacgagatgtgtcaggtcctgggggtggggagtcacttcctgcgcccgctggccctgcgatctccgccttccctcttagggttgccctcctctgtggatgaagtagtgggttgt

SEQ ID NO: 537174 - DNA, 2958 bp, Homo sapiens
  misc_feature (167)..(167): n is a, c, g, or t
  misc_feature (214)..(214): n is a, c, g, or t
  misc_feature (219)..(219): n is a, c, g, or t
  misc_feature (906)..(906): n is a, c, g, or t
  misc_feature (911)..(911): n is a, c, g, or t
  misc_feature (917)..(921): n is a, c, g, or t
  misc_feature (998)..(998): n is a, c, g, or t
  misc_feature (1012)..(1012): n is a, c, g, or t
  misc_feature (1032)..(1032): n is a, c, g, or t
  misc_feature (1042)..(1042): n is a, c, g, or t
  misc_feature (1047)..(1047): n is a, c, g, or t
ctggaaaatgtggccaggaggagggggccagtgggaggtggcctgtgttcacctttgaagatcaccaaatagatgctgtgggctttaacaggggcctggcccttccgtgtcttcccagtcttctctcctgacctccagggcatcctctgtcacctcagaggggcaanccctccagaccaagcctcctcctgctgaacaaatgtcaccctggctncgctncggaggccacactggaagcctctgatcccccagctccttcctttcccaccagcagcctggtgcctggaggtgagaggaggtgagaatgccagtggtttggagtgaggctttgggtccccgcctctgaatcttggggaggggaagctaccagggtcaggcctgcaagcctctccagctcagatgcatgcctcgggctgaggacggtggtgtgggcagtgccccttgaaggagggcggtcctggagatgcccatggaggaaggaggtgcagagtcagcaatgcccagatctttgctgggttaggacgacgggctgagggaggaaggggtgtcttgggaaccaggggagccccacgacgaggcagaacttatcagtggcagggaggggtggtcactgctctgttcctccccatccttcagctcccactggtactctgagtgcagcaaggggagagggtggggttgagactatctgagcttttcttaatggagaaccacacaggggccaagacacacactccaggagctcaagtggcagccccagggtcacctgctcacccctagaaattccatgagccgggcacggtggctcatgcctgtaatcccagcacttcgggaggccaaggtgggtggatcacttgaggtcaggagttcaagaccagcgtggccaacatggtgaaaccccgtctntaccnaaaatnnnnnaattagccgcgtgtggtggtgagtgcctgtaatctcacctacttgggaggccaatgtaggagactcgcttgaacccnggaagtggaggttnctgcagtgagctgagatcangccacagcantccancctgggcgacagagcaagatccgtttcaaaaaaaaaaaaaaaaaaaattccacatcatagagacctcttcctcccccgccaggcacctgccccatccgccagcgccaagacaacaggcccactcctctgattacctccgggggatggacggcaaacaggtaaggagttccatgcaactgcggatggagcccctctgagaaacacatgcccctccaagtggggtctggggcctggagagaccctcccacccagcagaccaggagatagctgggggacaagggcagacggcccctgcctgggaaaaaccacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggccattcagcaggccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctcaaatgtgcccgcgtgtatggcagacggtgcggggtggaggccgtcacgcccatacacgtgtgcacacacagcggggggctgtgtccacggactgcgcacacagtatatattaacatatatattgctcaagtatatatgctatttacagtatatatctctatcaacataaaacacaggtatttataggtgtgtacaatagatacgtcctaggaagtctaggggacacacgactctggggtcacggggccgacacacttgcacggcgggaaggaaaggcagagaagtgacaccgtcagggggaaatgacagaaaggaaaatcaaggccttgcaaggtcagaaaggggactcagggcttccaccacagccctgccccacttggccacctcccttttgggaccagcaatgtacgagttttgttctggagttttgtgcaaaacaaattaacttaaaaaaaaaaagttggtttctaattaatgtggtgggccttcaacacccacaaggattttaaagaacagcttctccttctggtgggcttccagggctcagagggtcccactcagagaagcagggaacactttgtcaggactagaaaatatcccttctcctctgaccacagaaacagcacaactcggctgggtgtggtggctcacgcctgtaatcccggcactttgggaggccgaggcaggcggatcacttaactcaggagttcaagaccagcctgagcaatgttacgaaatcccgtctctattaaaaaaatacaataaccagccagacgtggtggtgcgtgcctgcaatcccagctacttgggaggccgaggcaggagaatcacttgaacctgggaggaggagggtgtagtgagccaagatcgtgc

SEQ ID NO: 537175 - DNA, 117 bp, Homo sapiens
tgctgtagctctgcagtgggaattactttatggagaagatgcgagaaaaaggaatcaaactgctgtaggccagaagttggtgcagtacttacgagcaatgtgaggactgtagatgga

SEQ ID NO: 537176 - DNA, 2241 bp, Homo sapiens
tctgctacttgaggaccccggcactgctcggatcacactgtagctctatccccagctccttcctttcccaccagcgctgtgctggggtgagaggaggtgagaatgccagtggtttggagtgaggctttgggtccccgcctctgaatcttggggaggggaagctaccagggtcaggcctgcaagcctctccagctcagatgcatgcctcgggctgaggacggtggtgtgggcagtgccccttgaaggagggcggtcctggagatgcccatggaggaaggaggtgcagagtcagcaatgcccagatctttgctgggttaggacgacgggctgagggaggaaggggtgtcttgggaaccaggggagccccacgacgaggcagaacttatcagtggccctcttcctcccccgccaggcacctgccccatccgccagcgccaagacaacaggcccactcctctgattacctccgggggatggacggcaaacaggtaaggagttccatgcaactgcggatggagcccctctgagaaacacatgcccctccaagtggggtctggggcctggagagaccctcccacccagcagaccaggagatagctgggggacaagggcagacggcccctgcctgggaaaaaccacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggccattcagcaggccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctcaaatgtgcccgcgtgtatggcagacggtgcggggtggaggccgtcacgcccatacacgtgtgcacacacagcggggggctgtgtccacggactgcgcacacagtatatattaacatatatattgctcaagtatatatgctatttacagtatatatctctatcaacataaaacacaggtatttataggtgtgtacaatagatacgtcctaggaagtctaggggacacacgactctggggtcacggggccgacacacttgcacggcgggaaggaaaggcagagaagtgacaccgtcagggggaaatgacagaaaggaaaatcaaggccttgcaaggtcagaaaggggactcagggcttccaccacagccctgccccacttggccacctcccttttgggaccagcaatgtacgagttttgttctggagttttgtgcaaaacaaattaacttaaaaaaaaaaagttggtttctaattaatgtggtgggccttcaacacccacaaggattttaaagaacagcttctccttctggtgggcttccagggctcagagggtcccactcagagaagcagggaacactttgtcaggactagaaaatatcccttctcctctgaccacagaaacagcacaactcggctgggtgtggtggctcacgcctgtaatcccggcactttgggaggccgaggcaggcggatcacttaactcaggagttcaagaccagcctgagcaatgttacgaaatcccgtctctattaaaaaaatacaataaccagccagacgtggtggtgcgtgcctgcaatcccagctacttgggaggccgaggcaggagaatcacttgaacctgggaggaggagggtgtagtgagccaagatcgtgc

SEQ ID NO: 537177 - DNA, 259 bp, Homo sapiens
  misc_feature (60)..(60): n is a, c, g, or t
aaaattttatttcatgttgtttgtccccctttgaataagcagtggcatgcccaaaaagantggtagaaggaaaggaattttttggcccaatccttcaaaccagggacccctttttgaggaactgagagttggctgttttttatggggactacataaaaaatatttccaaaggttttgttatgcagtgaagacattcagattatttgtaagaatttccccaacccccttgggtattgaaagggttaaccattaacaggga

SEQ ID NO: 537178 - DNA, 2114 bp, Homo sapiens
  misc_feature (167)..(167): n is a, c, g, or t
  misc_feature (214)..(214): n is a, c, g, or t
  misc_feature (219)..(219): n is a, c, g, or t
ctggaaaatgtggccaggaggagggggccagtgggaggtggcctgtgttcacctttgaagatcaccaaatagatgctgtgggctttaacaggggcctggcccttccgtgtcttcccagtcttctctcctgacctccagggcatcctctgtcacctcagaggggcaanccctccagaccaagcctcctcctgctgaacaaatgtcaccctggctncgctncggaggccacactggaagcctctgatcccccagctccttcctttcccaccagcagcctggtgcctggaggctgccccatccgccagcgccaagacaacaggcccactcctctgattacctccgggggatggacggcaaacaggtaaggagttccatgcaactgcggatggagcccctctgagaaacacatgcccctccaagtggggtctggggcctggagagaccctcccacccagcagaccaggagatagctgggggacaagggcagacggcccctgcctgggaaaaaccacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggccattcagcaggccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctcaaatgtgcccgcgtgtatggcagacggtgcggggtggaggccgtcacgcccatacacgtgtgcacacacagcggggggctgtgtccacggactgcgcacacagtatatattaacatatatattgctcaagtatatatgctatttacagtatatatctctatcaacataaaacacaggtatttataggtgtgtacaatagatacgtcctaggaagtctaggggacacacgactctggggtcacggggccgacacacttgcacggcgggaaggaaaggcagagaagtgacaccgtcagggggaaatgacagaaaggaaaatcaaggccttgcaaggtcagaaaggggactcagggcttccaccacagccctgccccacttggccacctcccttttgggaccagcaatgtacgagttttgttctggagttttgtgcaaaacaaattaacttaaaaaaaaaaagttggtttctaattaatgtggtgggccttcaacacccacaaggattttaaagaacagcttctccttctggtgggcttccagggctcagagggtcccactcagagaagcagggaacactttgtcaggactagaaaatatcccttctcctctgaccacagaaacagcacaactcggctgggtgtggtggctcacgcctgtaatcccggcactttgggaggccgaggcaggcggatcacttaactcaggagttcaagaccagcctgagcaatgttacgaaatcccgtctctattaaaaaaatacaataaccagccagacgtggtggtgcgtgcctgcaatcccagctacttgggaggccgaggcaggagaatcacttgaacctgggaggaggagggtgtagtgagccaagatcgtgc

SEQ ID NO: 537179 - DNA, 182 bp, Homo sapiens
  misc_feature (77)..(77): n is a, c, g, or t
cggcacgaggtgcaatcatggcttactgctgcttctgcctcccaggttccagtgatcatctcacttcagctactcanaggctgaggtgtaaggatggcttgagccccaaagttcgaagctgcaatgagctataactgggtcactgcaatccagcctggatgacagagttagaccttgactca

SEQ ID NO: 537180 - DNA, 1025 bp, Homo sapiens
gtcaggagttcgagaccagccctggccaacatggcgaaactacgtctctactaaaaatacaaaaattagccgggtgggtggcacatgcccgtaatcccagccacccaaggggctgaggcaggagaatcacttcaatccgggaggcggagatgcagtgagcggagaccacgtcaatgcactccagcctaggcaacagagtgagactccgtctcaaaaaaaaagaaaaaaaagacggagggagaaacggtttgagacttaataccgggtacgcttatacgggcccaacttagaagagggcaccagggggggtgggaaagtttagaccaaggatcgtttctccttccttgcaagttctcagcccagaggcccttcccttccaaatccgggccggggaattctggagccggtaacatccttccctggcaagctcagggggagggggaacgacctccgacatggggaacgtgggaaaactggcttcccctgggtgggtggcactgggccccaaaacgcaccggggtccttctggaaggggtctgggaggggcccatggtccacccttggcccccggggagtcacttgggaacccttctcagggcgtattttcccaaaagggtttggctggagccaaatttctccctcagttctgaaccccttcgtgggccatggttcccaacatgggagtcccgtggtcacagtcaccgtgcgtgggtcctaaagggacggtggtccccaaaaggccggcaacatttcccacgtggcgctggaaacctcacaggaccctcaagtatcaccccacacgtgggtcctccgcgtgggtcaaccatctccccaccaggggcgggttgtgccaaaatgtgcttctgggaccaagcgggacactccccctgtctcgtggcgacaaaagcgcactaagggtcccacacgtctgcctcttgacagggggactccggacgaacatcgaaggcggcccgcctggagtggcatggggcccggccatcagaccccaccaagcgacaatgggc

SEQ ID NO: 537181 - DNA, 1106 bp, Homo sapiens
ctagacctatcgtacttatcatcataatccctatgtagcttaaccagtctaccacatctttagccaattattaagacaatatcgctatcagaataccctgtgactacctgtgccgaaataatagtaacctgatgacagggtagtaagatttcgtaatctcgtatggtctgcacttgactcagtaggcattctgcgcgtaatgagttataaggcatagaaccctccatagtgtgccatggtaattcgttcagtaattacacctttgtgaagtctatcgttccaagtcgcgtttgtaaatagcagtgctggtagtgcccccgtacgtcaacgcctaatgtatactccacaacaatcacattagcgggacgacgcctacatagcgccccgtacggatcttgaaaaagtgcaactagtataccttgatggacacgatagctcttctcacccggtctagctcaatatagacaatgagcatactggtatacgccgatagatgaggacatcttggcctttgtttagaacctgtccccatcgcgttcctaaggtggatccaattatggaaactccatctgggacgacaagacataaacaaatagcgtggccaactcatattggtgcttgggagaacttattgggttccctacacatgttcaaacccacagatctcaaaggagagccgcatcagcgctgatagactaacatcacctttgcggaccatcctaagctgcaaaacatatgactacaatatctaagctaacataacacaggaagacatatcctccacatgttagtgagggtcaatagactccactacagttgttacaatgtactattacacatcatcacggccttgaaaaaactacaattggtcatgttcgacgtgacgtccagcacaatggcacccacccggtaatacgatttaaaactaagaggaacaaaggcacgtgcacggtgaagacaataggtggccatactgtctataacgccaaagagataaatgagaacgcaaataattcccccgtagttgacccacaaactctcttgcatatggggaaactttcgtagggatcacattcggttgaccaaacccatttatattgtcggag

SEQ ID NO: 537182 - DNA, 1179 bp, Homo sapiens
cggcacggtcatgagcgtgcgccgtcatgaaagagttcgccttcggtgcatcagtgcgcgagaactgcgggcgcgctgcgcgccatcgaagccctggagcggtccactggagctgcggccggggggcgcgctcgttgtgtggagatgtcgctgcccaaggcctcttaatactttggaatgactttttcgtgggcatactgtgttcggtatgacatgcatcgatgtccaaggaacatgttgcaggcctacttcgaagcagccgtcggacgacgtcaatcgagatgtgaccgtggtgaaaaggctcgttgctcaggactggtgaaggcgtgtctcactcggaaacccgtgaccccggagtacggccgttaccacgcaggccttgagtagggatttcggccttcgagcatactatcggaggaccatgctaatgtgggatagggctggcgtgggaaatattggtgagctactgcaatataacaggaaatataacgggcgtataagctcggcgaactacttaggagatggacctagaaaggaaccggtcaggacattggacgggaatttgccctacttaactggcagagctcctagcaagcgctatgttactacacgtcgtgtgccatgcgtgcgtggaaaccatgccataactggtgcgcaaagctccgagggcgacatggagagtagacgaggcagagaaacccgtcacatctagaaggttggccattgtggtggcaaccgatacagggttcccaaactcttagatcctgataacctgggtaggccttgcagcagaccataggcttttcgcaccggaagtataagtgcggctccccgggtttccacttcccgtaagtagtttgtagcatttccgagtggacacaaaggaattttattgccccgttattcagatcatctagcccatttgggaaaagtccgcggcgaccaacgatagggtaccttgtcaaggttcggaggaggggcgccaatccaaggtggtgggcccttctagaaataccaccgaaccagggaacggatattttgccacagtgtggccaaaagatcgcaaaattggcccacggggttggccaacgttgtgggttcgcaatcaccaagagcctcaggtccctttagggcgaatcttcggcgcgccccctgcagcagtgggtggcagacccaagg

SEQ ID NO: 537183 - DNA, 420 bp, Homo sapiens
agtgagagaaggtagctgcctgctgctggtgacactttctctttcccggaggcttccgtgttttcatttgctagcagagctgtctctctatctagcgccttcactctcctagcttcctgacccttccatgtatcggttctgtacacattatctgtaggtcctaatacagagagaatttcagcctatagtacaactttaaatgcatatctcttacactcccttccttcaacaaattgtagtgtgtgatgggttaccactgaaaggttatgagtgtggaacttgtatactcgagagagcttttccttcattgtctggagagctctatatcctaagaggcccttctgtttataactgattctcgacaggtatacgatattgtctctctctgtgcgaattgacattcgccattctctctccagt

SEQ ID NO: 537184 - DNA, 349 bp, Homo sapiens
agtggcccgacacatcacagggtaggacattcacaatcagctcagccagtggaagtcagatataaaaagcgtgcaactagaaagactgggagaagtgaacctgtctattccaagtagacaggctcccaatacaggcgaaactaagatcattccatgaaagcctcatctaaagacctcatgtaatggacaacgagtatctaacaactcgtgatcttgatcacgtagactatttggctgtaacctaacagaagcattagtttagtcatgtacaatatatgtagaatgccaactcctgtcattctcgtgcctagcacttcaacaagaatttaccattctgatggttagtcga

SEQ ID NO: 537185 - DNA, 317 bp, Homo sapiens
atgtgattgttcatgtatggatgtccatgatgtgatgtacatgatgtgatagtacatgatgtgattgtatactacgaatgatatgtacatcaaaactcactcagagggatacctgtctgtcatgtcgcagcttcagaaaaaactggactgtgcagagtgtttctgagtgcagtctttctaaagcccagtgctagtactggtaaatataaacatcatataacgtgaacagcacaacgatacaatatgtccccttaatagctggaaaaaccaatataagcccacccactccctactaacaactgattgccaccaaacaa

SEQ ID NO: 537186 - DNA, 917 bp, Homo sapiens
caacacacaacaaacacgttgtgcgcgtatggaggtcatccgcggtcccccattatggtttataggaaggttctttggcggatcaatacagccatcgggttcttttattatgggtccccgttgcgaaaatgagtctaaacagtgtctttcgtgtatcaccccctcttggtcccgagacccacctggtcttgtttcggagcaatttatgcataccttgggccacaatcgttctagttctgcccgcgcccgaatctttctttccaggtcagtttgggcgagctctttcctcgtcccctgccccgccatatgcctggttccacaggcagacccccagttgtagttttgttttcctatagggccagcggttcttttgtcggtaaccggggggcggggtgaacccaggcgcgcccacttcaggggccacacacagcacaacctgctgtgctttcagcggcggttagacgcatgttgtatgcagcgcctgcaccgcccgccgttaattgcccgggagtatacgcagggcgcccaccctcccacctcgccgccgcttttctgagcattattctcagtcacgacgggagggttcttccccccgacttgccacgtgctaggcctgtgtttaccatctcgagctccacccctgaccacccccatgcaccggccagccccacaagaggtggcaggaataaacctccgtatgacccccaacagcttccaagaaacatgtttttttttagcagtcattatttgatgaacacttttatatcaacctcccacacccgagtataaaatttggccaaataaacttaacggctttgtaatagatacagcaccaaccgacgttttgaggcccgcaagatcatccgagatctggatttagagcaacgggggaaacgattcctaaacaaaccatgaca

SEQ ID NO: 537187 - DNA, 198 bp, Homo sapiens
cgcagtgtcatcgagccccattacattcctggcagtgacagctggctggcagggacttatgtctaggtcccttcccagaagcccccgagcctcattggactgtgtggctctttagcccccaccctgtgggacgggtccatgggtcaggcctctgccctaccaacctgtgcctttcaggggccttggcggactggcctt

SEQ ID NO: 537188 - DNA, 219 bp, Homo sapiens
ctgagatcacgccactgcactgcagcctgagtgacagagtgagactccatctcaaaaaaaaaaaaaaaaaaaaagggggcggggcccccccctttaaagtgtttctttttccggccccccaaaagaaaaaggggtttgtttccctttaacttttaacaatgatggaaagtttccggaggcctccaagtaatgcttcttgtaaaccctgggaaactggaa

SEQ ID NO: 537189 - DNA, 400 bp, Homo sapiens
  misc_feature (364)..(364): n is a, c, g, or t
gtttaaaattttttatggaattatatttagttataaaatcaatacatgttcattgtaaccagttaaataatgcaagtatgtataaatacaaagtttctaccccaccccacgttccccattttcacttctgtgaaataacagcttgggagtgggaggtaatgtctttacacaagaaccttttagaatcaaggtacagtgtgaatctattgtccaataatgtatgcacacaaatttggccttttgtcaactcattaatttgtggagtgtctcagtgtagtcttgggagacaataatttgagtaagaatgtcttcatgagagcaggaatttggggcctttttacccccactgctatatcctcactgnctgtagcagcttctggccatcagcactcagtctttt

SEQ ID NO: 537190 - DNA, 151 bp, Homo sapiens
acaataaagataggcattacatagtagacattcacccattcctgatcctctgacaccaccgtgctctgggggatggggtcatagtagctggctgtgtactggcagtcaccattcctcaacgttgtatgctccagacggcacagaactatcc

SEQ ID NO: 537191 - DNA, 408 bp, Homo sapiens
ccgtttgtatgttgtaacttgaacaagcctccatggctgtccctgaagtcacagacccagcagttgcttgctgaggacaaaacaggggcccgcagatcatcggacacaatacctcaatactctggggtaagctatcagtaacagtgggttcctccataactatgtagagatgccagatctcaagaggtgacacaaccaagtcccagatattagaatttcaacactagaatcaaatggtgcctatgctccctacattaccaaaacaagtcaaactcctgaaacttctgtattagagaacagtgtccctgcactctctccctccctccctctctctctctctctctctcacacacacacacacacacacacacacacacacacacaaaaaacacactcagacatcttcct

SEQ ID NO: 537192 - DNA, 222 bp, Homo sapiens
atcgtcgaagatcagtcgatatatcatgcttcgcggagacggacgcagccgcggcagcacgcgcaggtgcccgtcatgccgaggtgcacgatgaaccagcccgcgtcgacctcgaacagcagatacttgccgagacgctcgacggcgagcacctcgcgcgcacgcaactgctcggagaagcccggccggcacgggccagcgcagcatctcggtacggagggt

SEQ ID NO: 537193 - DNA, 363 bp, Homo sapiens
gaagtcagtagagattcgcccaaggctacttaaccaccagcccaaacaagacaatctacattccagcattagcttcttcagagaagaagtagagatgcagaaattataaacatgtaaaggccattgtggctaatatggaagtagcaggtttggcctgctgagctaagtatacaaaatttcaaggtgggtaacttaaaatttctagaagtaggtaaaaagaacctacttctttacttggacagtccttgtgtagtacagtattaggaagtttatccaaggcagtgacagtcttatcttcgtatcgctaagcataacattattaaaatggctattgaacacaaccaaaatgactgactacagcaa

SEQ ID NO: 537194 - DNA, 246 bp, Homo sapiens
atggaagtgatgcagaaaaggagcaagccattcattcttcaggtagagagagagagagagagagagagagacagagagagtgtgcgtgtgtgtttaataaattttggatggtttggtgttcctgttatttttattgacttgtcttttgctagctttctcttctggctaatttgggtaacttacttgaatggtgggcttctaggtatgtattttcaaaagagttgtttgcctggtgtgactatgtct

SEQ ID NO: 537195 - DNA, 343 bp, Homo sapiens
actactgtcgcattattttaaatctttgtacacttctccaattcttgattggaattgttataaattaatcatagaaatagactactaaattaccatttatataactaaaattttaaagtttgcatattgctcacttgtgtatgatggtcggggcatttcaacctagacctagaaaggtgatgttaactgcgtggaagatgtgaactgtaggaaggtggcaggataggtgaaaggttagtctgaaatagggtatcatagcagaatatatctctttatctcaaagattcgaatgctatttacaatggaaatctatgccagctattaatctgacttggtgatatat

SEQ ID NO: 537196 - DNA, 127 bp, Homo sapiens
  misc_feature (2)..(2): n is a, c, g, or t
cntacgacgctagcacaacttcaattatccaactctaaatagctgatttttaagaagaaaaatttgattaaaatcttgttatatgatttctggacttgtttcttttcatctctcttctctttgtcac

SEQ ID NO: 537197 - DNA, 524 bp, Homo sapiens
tctcatagtatcctgattggttagaaggtctttaggggcatatacactgggttagttcggctggtctagctgcgtcatgccatctacacctctacccgccttggatctataccgtgctgttgagcgcctgactggggctgatggtactctcccctaggctattctagctagacaggctgtagattggcatgaccgcaggtgccactggtgccttgtgggaacaccagccgaattggtcttatccgatgactgcgatggcggttccagtgatcagcgcgggtacaaaaatgtgtataacgccctgattcgaatcacccgggaagagggtgtctcacactgtggggggctgtcccttacatggctcgggcgtcgtcgtccatgtgccagtcgctctatccatccagcgtttactggctcggtactcttgcactttgtgcctttggcgcgtcgcggttgtcccggctcggcgggtgcgacgtccactgggtttgggcggccaccggggcggtcggcggggttccggg

SEQ ID NO: 537198 - DNA, 222 bp, Homo sapiens
ggtttgccccttgggccctttttggggccccttttccaccgggttggcccaaaaagccggggggggccgggccgggtttcccggggtttgggttttttgcccgtggggggctggtgggttttttggtttcccggggccggtgggccttttttttttttttggttttccccttaacctttttcaaaggtccccgttggttttttttttttttcccggttgtta

SEQ ID NO: 537199 - DNA, 206 bp, Homo sapiens
attcattttttccctttctactcagactttgacatcttcctaaatgaatgttcaaattttcctcaaattcaattaatcaataaattaactaattcttcattaagcacttatttctgaacttttcattaaacatgtatttaataaaagtcttcattaacacttaatttaataaaaattctttcatataagccccttatttttgaaaa

SEQ ID NO: 537200 - DNA, 213 bp, Homo sapiens
ttgtctgggtgaaggagtgaatagatgagcccatccagaagaacccaggttttctcagaatatttgagatgaagatatttgctgtgcctcccgctgtgatccacagaaatgtctgccatcctccactgacatctctggcatgacttggcctttctagacggtaagttccaggaaggctgagactttccttctcccctcactccttcaccctag

SEQ ID NO: 537201 - DNA, 145 bp, Homo sapiens
ctatgcttaaaataagcaggtggtctatttcatgtttttgatcaaaaactattatgggatatgtatggcgtagggtaaatcagtaagaggtgttatttggaaccttgtattggacagtttaccagttgccttttatcccaaagtt

SEQ ID NO: 537202 - DNA, 390 bp, Homo sapiens
agaattttcaccgcgtcgtgtgaagcgacaccttaacgggcttgtgtgagcaacatggctgtttttttcacctgggtgcaggcgggctgagtcccaaagagagagtcagcaaagggtggtggattatcattagttcttatgggttttgggataggcggtgaagttaagagcaatgttttgcgggcaggagtggatctcacaaagtacatcctcaagagtggggagaatttcaaagaaccttcttaagggtgggggagattacaaagtacattgatcagtttgggtggggcagaagcaaatcacaatggtgggatgtcatcagttaaggccatttttacttttgcggatcttcagttacttcaggccatctggatgtatacgtgcaagtca

SEQ ID NO: 537203 - DNA, 134 bp, Homo sapiens
gcagaatgatttgacaatttttattttaaagtacatttttacatctttcaatggaatatgaaagcatctggtaatcgagcagagttttgccagcctgcatgtgaactggattattttaaagagtgatgtattca

SEQ ID NO: 537204 - DNA, 150 bp, Homo sapiens
  misc_feature (33)..(33): n is a, c, g, or t
  misc_feature (45)..(45): n is a, c, g, or t
  misc_feature (98)..(98): n is a, c, g, or t
  misc_feature (110)..(110): n is a, c, g, or t
gaagcattgaaaaaagcaaatatcacctttaantacatgtttgangaagtgccgattgtaattaaaatttcacatctgatcaatgtcctaatgtgggnacttgaaaagangtcagctgttgcagctaaacatgatttgctcagccttgcc

SEQ ID NO: 537205 - DNA, 210 bp, Homo sapiens
aattcttctgatacgtgttgcccttcctcacagccctttggccattgtgagtttggctgtccctcagagccatccggtcaagaagatggtgttttgtattttacagcagaaaattcttttcttccaggagttctgtctgaactgaacatgtaaaaagtgtgggaaacagatgaatccctattaaacatgaagttttgattgtatttaaga

SEQ ID NO: 537206 - DNA, 137 bp, Homo sapiens
tgccatgagcgcaaaaagagtctagtaagtcgtcaagcagatggcgcttgttataattatgcctcatagggatagtacaaggaaggggtaggctatgtgactaaatgtgctgattcagcacatttcgtatgagacag

SEQ ID NO: 537207 - DNA, 160 bp, Homo sapiens
ctgcccccatcaggatttctatacattgacctcttgttggttatcaaaatagctgatgggagaagatgcgcgcatcttcgtcccatcaggggatttctatacattgacctcttgttggttatcaagaacagagtaacgacgtgtcacacaatgacgctgg

SEQ ID NO: 537208 - DNA, 642 bp, Homo sapiens
gccttattagaccctactaaaggtactggcttcgtcaatatattggagggtgtgtacaacgtttgcttgccttattgtagacattcaagagcctggtgccatttgctaggaatagttaagcatagtaaatagtagttcctgcgacgagtgtacacagttgtggatacgtgcacgggagtctatatagtgaatatgatacgacatttttgaatgcatactcataatgtgttgtccactcagagctgtttgccttcctaaagtgttgacccgttaagccttaacatgtatcttcattcagaaaacagttatattggtcataccatagtaggaagaaaaacctttatttgggaatatacactactgtaagttggtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgtcgggagcagggatttggaaatttctgagagatgtgtagttaatttagtaattctgtttcatgagatatgat

SEQ ID NO: 537209 - DNA, 715 bp, Homo sapiens
ggctgcctcctctgactgtggtgaagcagctcagcaggataataagcttacgtcgcctgaccttggggtctctctcgtcatcctttgctcttggctaaccttcattcttggtgccaaaacccaggaacggggataggctctggtcatgggacgtccgttagaggattctctctctctctctcctatcatccgttagcccaggccaagctccgcgcttcctcgtaactcgtgctaatagacaccgctagaggatctcccaaaatttctctccattgtcgggcgcacctcagtgccacatgcaaagacctctgagagggggccgatgtgtaagagtccttgccacccgtgggaaccagtagcgaagaccatcgattgtctagcaccgaagaaatgaccagtacctagggctccttggaacatgcagtgccctactaaccagcacttctaccacacagaagacatcgcccgtatactagcatgtaatgctgcctgaggataacggtgcctcctcttctattacctgttatataggctggagattgttagagaaccagttggaccgagaaagctctcttcctatcctgaagattgatgttgaatgggccttcttccaagtgacctttgctgcagaacaggcaagcagcattcatacgcctggtttgtggtccaacgagaattctagtggatggccaattaacagacaatacacggacac

SEQ ID NO: 537210 - DNA, 320 bp, Homo sapiens
atatcgaaaccctactggaggttgtctgtggtgtgggaaacacagtctttccatattttacaatacgaacaatgacccaggactctttgtgtattgctgttatttttcttccatcagctttagaactggtccagactaattcagaatatcatcctttcccgtttcttttgtcctttgttcacgaccttgtgtcatgaacagaacagtttccctagtgcccaatgggctctcttgatcttctctattctcatatttgttctttcagcatattgttccagacaacatgcagaatgctatcaacaggctgagcaggcttctga

SEQ ID NO: 537211 - DNA, 284 bp, Homo sapiens
  misc_feature (2)..(2): n is a, c, g, or t
cnccacccagagaagagcagataaaacaaaaatttgtgatccccccatgaattcttcaaagttaaacagggcagtcttctttcgaaagttaagatgaccagggcgccctttccttttgacaaaataacctttaagaagggcgccccccctccacaatgcccccagatatgccgcattgtactgcttggttatatgctatgtacatgtcagaaaccattagcattgcatgcaggtttcatattctttctaagatggaaagtaataaaatatatttgaaatgtaaa

SEQ ID NO: 537212 - DNA, 110 bp, Homo sapiens
  misc_feature (51)..(51): n is a, c, g, or t
  misc_feature (87)..(87): n is a, c, g, or t
  misc_feature (89)..(89): n is a, c, g, or t
gctcctgcacaagaacattgaaacacctgttggttcttcctcctggcttgntggcagcttcccagagtgtcgttcctcgtacccagngngccagctttcaggagtttggg

SEQ ID NO: 537213 - DNA, 189 bp, Homo sapiens
aggatcgtatgagaccaggctgagacagcccaaagccatatcccagactaatacacagccatccccaactgcagccgcaaacccaacccaggccatccccaaacccatcccaggcaaactcaacaccatccccttccctaaatcacctctcctgccccttttctccagcctgggtctcccatggtgtac

SEQ ID NO: 537214 - DNA, 792 bp, Homo sapiens
  misc_feature (210)..(210): n is a, c, g, or t
aggcattgaggctcactgaggcgggcttgtgctgagggggcaggctgggctcgtggacccgttgtcagtcctttctctctgaagagcagacaatccactcctcaagatgtctagggatgaggttactaggatattgcttagcggcaagccacaaacgtgattctaatacgctcagagtgtaagagaaactatgaagacttacaagacgtngcctgatgaaggaaaagatagaaggctccttatcatgaccgccgtggagatgaagcttctacatggagtctaacttgtatttaactgagaactggaagataggactacacagccccgaatgtaataccactagaatggccctgctagtagatgaaaatgaaggcgactgatacagctcatagtatagaccaaaagctgcaggtgattacaatagatggaaggccatcttttacaaagagattagacgcatagtgattgacagaccttgtaatccatgactcaaggagaattgctgtatttaaagcctatttaacgcatttactagacgcagacgacaatggaaagactaattggcagtggtacgacgaaacaatctggagaagatacaactttcgagtgcgagactggaagacagaagctcggcacggcgatacaaagaatttagatgatagggatatggtactgtcaaacatacttttagagaagataatttaaaccgcgtggaagccgatttaacatgagcaagttaatgatctggcgcgctaggcccattgacttagacttatcaggttttcttcagcc

SEQ ID NO: 537215 - DNA, 458 bp, Homo sapiens
  misc_feature (5)..(5): n is a, c, g, or t
  misc_feature (90)..(90): n is a, c, g, or t
  misc_feature (107)..(107): n is a, c, g, or t
  misc_feature (126)..(126): n is a, c, g, or t
  misc_feature (143)..(143): n is a, c, g, or t
  misc_feature (145)..(145): n is a, c, g, or t
  misc_feature (181)..(181): n is a, c, g, or t
  misc_feature (187)..(187): n is a, c, g, or t
  misc_feature (207)..(207): n is a, c, g, or t
  misc_feature (225)..(225): n is a, c, g, or t
gcagnaagacctagtggatctcagattctaaatggccagattactggcatgtggtggaactagttaacactggagcggtatgtataactnttgctatggacgataangtttcaaagattgtgttcntcaggtgggtttgattntnggttttttaacgcctctcagattataattactagtntaaatnctttgctttattcattaagnataaaaacttcggtctcngatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatac

SEQ ID NO: 537216 - DNA, 981 bp, Homo sapiens
  misc_feature (1)..(1): n is a, c, g, or t
  misc_feature (87)..(88): n is a, c, g, or t
  misc_feature (94)..(94): n is a, c, g, or t
  misc_feature (127)..(129): n is a, c, g, or t
  misc_feature (135)..(136): n is a, c, g, or t
  misc_feature (138)..(138): n is a, c, g, or t
  misc_feature (141)..(141): n is a, c, g, or t
  misc_feature (150)..(151): n is a, c, g, or t
  misc_feature (160)..(160): n is a, c, g, or t
  misc_feature (178)..(178): n is a, c, g, or t
  misc_feature (190)..(190): n is a, c, g, or t
  misc_feature (192)..(192): n is a, c, g, or t
  misc_feature (211)..(214): n is a, c, g, or t
  misc_feature (218)..(218): n is a, c, g, or t
  misc_feature (231)..(231): n is a, c, g, or t
  misc_feature (234)..(236): n is a, c, g, or t
  misc_feature (239)..(239): n is a, c, g, or t
  misc_feature (244)..(244): n is a, c, g, or t
  misc_feature (246)..(246): n is a, c, g, or t
  misc_feature (276)..(276): n is a, c, g, or t
  misc_feature (278)..(278): n is a, c, g, or t
  misc_feature (280)..(281): n is a, c, g, or t
  misc_feature (288)..(288): n is a, c, g, or t
  misc_feature (294)..(294): n is a, c, g, or t
  misc_feature (481)..(481): n is a, c, g, or t
  misc_feature (486)..(488): n is a, c, g, or t
  misc_feature (843)..(843): n is a, c, g, or t
  misc_feature (909)..(909): n is a, c, g, or t
  misc_feature (957)..(957): n is a, c, g, or t
ngggcgggggggtgtgttgttggtgaccttgggggtgggggctgcggaatgcagctgaacctctcctggctctgtctgctggtctannccaggntggggctgatcaggggcagagagctcaatcttnnnggatgnngnggngaggacagnngggccaaangggcctcttcccctcctnttcacccatgcnanagcattaaataaacaaaannnnactntttacagcacaanttnnncanggaantncttcctcccagccctgggcgcacagcatgntngnngagcttnggaggncagggttggggcctccagggtctgacaccaccccactcctcttcctagcaccatggggtagggacaggcagctttgaacagaggaaacaaaactccaacttcctccaaactcctatgcaggcaggtccatctagtctggtacttctggcccaagggttttctgctccttccaaacctttgagctttnttttnnngtgagcttagctgagacttctccaagaggggctggagccctggtctctgaggcacagtgggcctgggaaacaggcaagagtctggttccaaagtttttcccagcccaggcctctgccttggcaagcaggaagcagggccaggtgagagccggtgagacccaggctcagaggggccgggtggtgtggttatagaccaggtgctccgtgtcctcggtagtggagacagtggagctggcaggggtgggtggtgggtggtggtggtgtccgtggaagtcctttctctggttcttgaagaagcagtaacccaagatggctaccaccaccacaatgcagatgaccaggaacactgcgacancatctccacagagcctgtgctgggaatggggatttcccgcctcaggccaaacacatccttcttggngatgccgcgacaagactcgaggcactgctgctcttcctcaaagttgtncttgttgcataacaacaccataag

SEQ ID NO: 537217 - DNA, 937 bp, Homo sapiens
gaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgggggtctattttggttaaggaagtttaaggattcacttgttgaagaagttgtgtgtctaaagattaagtttaaagctagaagcagacaggtgagtattgggtaagtacttctgtgactcgcctcaattcccactggccaggggccatctcaaactgcacggtgaatcaagatgctggtgtcatcctccttggaaacaaggaacatgttcaactcatggttaacaactaagtacatgattcccaagggatcatttcttatgagggaagatgacattaaggagaatcttaagaaaagcatcagagaaagacgatatgcatgtgaaggacctgattctgatgtaggaaaagttaagcgaaaggaactggttcagacaggggcagatgagttcgtaatgcgattgcatcctatgagtcacttcaaatcaacggcaacattgtggccatacgtcatcaacacaagagtacgtatgcccgatcggtacagagagtgaagtgtcgccaagttatgaggtacggaacaatgtatgaagtcagtagataagtgattgaaagaagagggggggagtaagtataagttaaagggtcaagaaatagaatccaataacttgtttgtagaccaagaatagcaacaattagctggtctcaaataaggagggggaaaagggtataatatgaaa

SEQ ID NO: 537218 - DNA, 390 bp, Homo sapiens
  misc_feature (6)..(6): n is a, c, g, or t
  misc_feature (169)..(169): n is a, c, g, or t
  misc_feature (251)..(251): n is a, c, g, or t
  misc_feature (335)..(335): n is a, c, g, or t
gcaacncaaccaagggtttctctggatgtgtttgggaacagggccatgagcacagtcctctctgtccccgcagaaacatcctcagcctcatcaacgactttgacttcccagagcagagatctccagggacgactacccagccgtcctcatgcacctgaacgccacctgnccaagagggtggcccagctccccctgaaggcctgcctcctggaagactttctggataaggtacctgcacaccccctgggtangccaggcgggggcgtccacaggagcaccagggccgcactggttgtgtcccactgccaaaggtggcaaaacaattcccacagacncagggccagggcttgttgaaccaagaaccccagtctatcttttgtctcagggttg

SEQ ID NO: 537219 - DNA, 123 bp, Homo sapiens
aagatagatcttagcaacacacaatacaaaagacacaggctaaaacaggcctcactaatacactttgagataggtatatatatgggtataagatatataatttccagatccataatatttttc

SEQ ID NO: 537220 - DNA, 606 bp, Homo sapiens
gagtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtccagagcagtaaaggatggctctgaaaaatgaagaggactgggcaaaacaggtatctcagtcataacagaataaccttcctgaagccgggtgtatttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgac

SEQ ID NO: 537221 - DNA, 281 bp, Homo sapiens
ccaggagatgttgggaaccagttcatttagccagccagctacctccacaagcacgggcttggggttgggtacgtcaacaggaacagcaattacctggttgggaactgcaagcacagggaccagtctcttctcatcccaaaacaatgccttggcacaaaataaaccaacgggcttgggcagtaagggggacatcacgggagttctgcatctaataattgggttggcttatggaatgtgtggtcttttctccgtttttctgtgttcatctaccttcttttcct

SEQ ID NO: 537222 - DNA, 234 bp, Homo sapiens
agggttttttttttttccccccccgggggcccccaaaaccctttttttttatagtggggccccgggagggggcctttcttccccttttccccccgagaaaatgtgggtttttttgggggaagcccccccttaaggcccccttaaaaaaaagggtttttttcccgggggccccccccttttcccttggttttttttttttttgggggacccaataattgtgccctctccttccga

SEQ ID NO: 537223 - DNA, 335 bp, Homo sapiens
tgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgatttgggataccaatcataagtctccttcttcttgggtatccaaattcaccacacttacgctggaacttcatggcagacgctccgatttcttgggactctacagaggatgaggcatcagggattttatgggatgagccaaa

SEQ ID NO: 537224 - DNA, 1429 bp, Homo sapiens
cagctgaataggctgcgttctcttggaacgcgcagcagaacgaggttctggtgaccctagccgcgttcgctccttagtcctttcgcctacccaccggcgtaccaggcagacccaccccgtcctgtgccaggaaagcactgccaccggcaccatgccccacccatacccagcactgaccccggagcagaagaaggagctgtctgacatcgctcaccgcattgtggctccgggcaagggcatcctggctgcagatgagtccaccggaagcattgccaagcgcctgcagtccattggcaccgagaacaccgaggagaacaggcgcttctaccgccagctgctgctgactgcagacgaccgtgtgaatccctgcattgggggggtgatcctcttccacgagacactgtaccagaaggcagatgatggacgtcccttcccccaagttatcaagtccaagggtggtgttgtgggcattaaggtagataagggtgtggtgcccctggcaggaaccaatggcgagacaactacccaggggctggatgggctgtctgaacgctgtgcccagtataagaaggatggagccgactttgccaagtggcgctgtgtgctaaagattggggaacatactccctcggccctggcatcatggaaaatgccaatgttctggcccgttatgccagcatctgccagcagaatggcattgtacccattgtggagcctgaaattctccctgatggggaccatgacttgaagcgctgccagtatgttactgagaaggtcctggcggctgtctacaaggctctgagcgaccaccatgtctatctggaaggcacattgctgaagcccaacatggtcacccctggccatgcttgcacccagaaattttccaatgaggagattgccatggcaacggtcacagcacttcgtcgcacagtgccccctgctgtcactggggtcactttcctgtctggagggcagagtgaggaagaggcatccatcaacctcaatgctatcaacaagtgccccctgctgaagccatgggccttgactttctcctatggccgagccctgcaggcctctgctctaaaggcttggggtgggaagaaggagaacctgaaggcagcccaggaggagtacatcaagcgagccctggccaacagcctcgcttgtcaaggaaagtacactccaagtggccagtctggagccgcagccagtgaatctctcttcatctctaaccatgcctactaaccagagctgatctaaggctgctccatcgacactccaggcccctgcctacccacttgctattgaagaggggccttcaggctctttcccatcactcttgctgccctcgtgtgtgcagtgttgtctgtgaatgctaaatctgccatcccttccagcccactgccaataaacagctatttaaggggga

SEQ ID NO: 537225 - DNA, 603 bp, Homo sapiens
aaagattacaacatgaatgggcagcgcgtgacgagaagtatagagctgaacatgtgctactaacctgctctagtgaagaaatcgtgtgcatgatcatgagatcgagcaccctgaaactagcccttgaggtgtgcaagcagagcgtagagaatgtggtcacagatgtcagtattcgaggttcgctagcacgtaggtttcatagtagaagaggactaggaagcatggaacgaatttagggataagcacagacttagaatgaggtaaagacagagtctcataatggatgctatccataatacaaaagagtcttacaattcaagaataaccatggatgcaaagaagaactatgagcagaaatgccgggacaacagatgagcgcagaaggaggccgtcagtccggagtgccaagctggtgaacccgaaggcaacaagaaaagcttcccaagtgaaagtgggaacttcaaagaccgcagtagatggacgtcagacagaagcatacatggtgcaagattcgggagcctggtataaggtccgagaagagtggcaaagtgagcacgatcaagggctgcgaggcatttgaggctcaaggaatgtgaacgaata

SEQ ID NO: 537226 - DNA, 367 bp, Homo sapiens
ggttcgatctagaggatccctgagagacggtgttgcatgactcacggcctgaattcacaccacccttgggaggctaagcgaggtggatcacccgaggtcgggatgttcaagaccaccctggcaacatggtgaaccccgtctctactaaaaatacaaaaactagccgggcatggtggtgcacacctgcagtcccagccactcgggaggctgaggcaggagaatcgcctgaacccgggagtagcagttgcagtaagccaagatcacgccactgcactccagcctgggtgacagagtgagaccccgtctcaggaaaaaaataaataaaataaattgagggcagacacagtggctcacaccctgtaaattc

SEQ ID NO: 537227 - DNA, 299 bp, Homo sapiens
  misc_feature (198)..(198): n is a, c, g, or t
  misc_feature (210)..(210): n is a, c, g, or t
  misc_feature (274)..(274): n is a, c, g, or t
  misc_feature (283)..(283): n is a, c, g, or t
tacagataataacatggacactataagggttttgttgttgttgttgttgttttgagacagagccagactctgcttaaaaaataaataaataaataaatattcatacacatttttcgttgtttaatgtttgatgtattacactgctttctattaaacaaaactttaaaaactgattttcttgtgtatctaaatctgggntataaatttggntagcttaactcccataacaaatatagtgtttatttataacttgtatttggttgattcttttggnaaacttggnatacaataacatttag

SEQ ID NO: 537228 - DNA, 1119 bp, Homo sapiens
  misc_feature (174)..(174): n is a, c, g, or t
agctttcttacgtagcacactatcgcgttgggcgcgcggcggccccacgcatagtgtaatagatgatagacatggtgtgcattaagtactgtgtcctacgtaagagagtacctggtgtgcattgatgatactatgtgttgtggagtatcttcatcacaacataataacaaacgncgccggcggggcaaccccgacgacgtgtcttgcagacaacaataccacgcagtgagggatgacttgcatgaggtcattcaatcatggtgagtactactacataacagcgagaatcctcaagaaggacgcgttcgtacgtactccatacaattaacgacgcacgcggccgaccggggaggaaaggaaacaaaccagagcaagagaagaaaaaaaaaaagacaaaaaaaaacaccagagaaagaagaaagaaaagaagcaagaaggagaagacaaagacaaaaaaaacaagagaaggagaaacagaaaaacggaagaaaacgagacaggggaaacgaacgacacaaaaacgagagaaagagaacgaagagaaaacaagaaagaaaaagaggaagagacgagcaaaagaagagaacaaaaaggagaagaaaagaagaagcaaacagagaagagaagaaaaagaaaacgagaaggaagaagaagggaaagagaaaggagaagagaacagaaaaacgaaaaaaaaaataaaaaagagagaggaaaaggaaacaaaaaagagaagaaaaaaaaaaaaaaagaagaaacaaaaaaaaaagagaaaaaaaaaaagagaaaaaacaaaaaggaaaaagaaaagaaaaaaaaaaaagagaaaaaagaggaaaaaagaagaaaggagaaaggagggaggggaggagaggaggagagacgaggagagagaagaagtgagaaaaagaggaacagggagggagcgcagacacagacgaggaagagggaagagcggaacaggacgagaagaagaggaaaaagggcacgacagaggagagacagaggcaaacgaacaaaggaggaaagagagaaaagaagaagacggaaaaggggaagaaaaagaaaaagagacaagaacagagaagacggagagaaagagagagagaagcaggacgagag

SEQ ID NO: 537229 - DNA, 144 bp, Homo sapiens
aaaatttcactcttctatatctaccccaagagggttattacctctctctggaattttacatgggccgaacattacagaacaccatgatcaacctcggtctgcttatttttgtatttttagtagatatagaagagtgcacttttg

SEQ ID NO: 537230 - DNA, 463 bp, Homo sapiens
ggtcgacgagatatattacatttcttctctcaatttgtgccttttattctcttattaattgaacagaagttcttaatttttgtcaagtcctatttgtcaatctttttgtgtcctgtttaggaaagcttaatcaacattaagatgttttcctatgggcctggcacgatggctcatgcctgtaatcccagcactttgggaggccaaggcaggtggatcacgaggtcaggagattgagaacatcctggctaacacagtgaaaccccgtctctactaaaaatacaaaaaaaattagccgggcatggtggcgggcacctgtagtcccagctactcgggaggctaaggcaggagaatggcgtgaacccaggaggtggagcttgcagtgagccaagatcgcgccactgcactccagcctgggcgactgagcaagactctgtgctcaaaaaagataagaaaataaaaagtc

SEQ ID NO: 537231 - DNA, 223 bp, Homo sapiens
gacgctctctctgtgggggctactgccaccctggtggtgggcttcttccgggtgcaccggccgcacaggagctgagcaccagtccacatcctcaaggggcaggtcttcgcctctcggtcctacttcttggaccgggctgggcactgtaaagatgagggctgctcctgggagcagagccggggtgagagcaccaggtgccaggaccaggcggccaccccagagt

SEQ ID NO: 537232 - DNA, 194 bp, Homo sapiens
acattatttgttcatccttccaatcgttgttctcatcactctctcttttactcacagtgtcccatcctagattggcctcccttcaattccataatcacgcaagattttcttgcctccggaatcttcacatctatcattccgtttatataaaatgatgttcctcatcttctaagtggttggtctctcttttgaca

SEQ ID NO: 537233 - DNA, 351 bp, Homo sapiens
cgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaggttgcagtgagccgagatcgcgccattgtactccagcctgggcgatgagcaaaactccatctcaaaaaaaaaaaaaaaaaaaaggtttacaatcggatgggaagatgtcaaacctggtgaaaggctaattagcagtataaggcaaggcaaactttagggccaatggcttgatacggggtaaggga

SEQ ID NO: 537234 - DNA, 573 bp, Homo sapiens
  misc_feature (6)..(7): n is a, c, g, or t
ttgtgnngtgtgaaagaaacacacagggcatctcctataaaaatggacttatgccgccttccaaggacatgttaccacccaggagagagaacaagaaagaaacagagggggcatcgccgtataaaaatggacttggctccgttccaatggacatgggaccaccgcgaagaaaacaagatagtcccagccaaggatttggtattactctcagaaatagaggtggcacaggctaactgacattagtatcatccacatgaaatatcctcgtgctgagaagggtggcttttgtcctcatgaaacatgaggtagccactggccagggaccatgacagctgcccgccggaaaaccaaacgtgaatcttgaccaatggataaatgcactaccgtttagacagcagcaggtggccccatgtcaacggacatggctcaaagtcccagaaacagaaatagccccgggcaaggatgttggctccgtccacagtaaaagaagtgggcttgttgaaggacatgtctccactatcagaaacagaaatggctctgggcgaggatgtgactccagctccagaaaccaga

SEQ ID NO: 537235 - DNA, 491 bp, Homo sapiens
cagctgttactacagtcatgcttcaccatgccctgctatgttttgtatttttagtagagatgggcttgggccatgttggccaggctggtctcgaagtcctggcctcaagggatccacccgccttggcctcccagaatgctagaattataggcatgagtcatcatgcctggcccatacaatggaatatgattcagccacaaaaaggaattaagtactgatcatgctatagtatgtacaacacttgaaagcattatgccaagtaaaagaagccagacataaaagaccacatattgtatgattgtgtttgtatgaagtgtccacaataggtaaatacatagagtcagagaatagattcgtggttgccaggagctgtgggaaggataaaatgggaagggactgctgatgaatatgatatatgaaaataatttcagaatatgaaaatattctgggaatagataggtgtgatgccttgcccaatcttgtgaatatat

SEQ ID NO: 537236 - DNA, 461 bp, Homo sapiens
acagtctgatagtcgacccaccccaatatcaccagattacattatgtttcagacaccacaccacacctattccaaaatagaccacatagttggaagtaaagctctcctcagcaaatgtaacaagaacagaaattataacaaactatctctcagaccacagtgcaatcaaactagaactcaggattaagaatctcgctcaaagccgctcaactacatggaaactgaacaaccacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaa

SEQ ID NO: 537237 - DNA, 339 bp, Homo sapiens
tttaccttttttttttcccaataaaaaaaccattaacttaaagtggtgttaaatgctttgtaaggcaaaaatctaattgggaacaaggcagttgaaggggaggccagtttacttttaattgcccacagcccagcataggtttccctctcctaaggccccagcaccatcctctgagcccaaaaccttgcctgaaaataagcaatttccgatggctacaccctattaatggcctcttaggtcttgttgcttttccactgcgtggagggggcccggtgaattttggtagcttaaattgatctatccaggcggcaaagctcttatggacaaaaacaccccatt

SEQ ID NO: 537238 - DNA, 282 bp, Homo sapiens
ccctgtacaggactggagagctctggtgtactgtcgtagtagtaacggagaagtagaggccggaggtccgtagtctaggggcaggagagagatctccgcgtaatttcctgtcggctcctgaacagcatcgcccatgtgcagcctcagtcaggaaaatgcatcagaatcgacagccccagggggcgagcggcgtccatggtgcagggggtcgagcggcccgctgagcaatgcgtccgagaaagcgcctgacgggaagaggtagcagggctaccgtgcctgacc

SEQ ID NO: 537239 - DNA, 106 bp, Homo sapiens
taccccagtgctgttgttagtgtctctgtaggtacagtaccattggtggccaattgatttgatggtaatgggagggatcgttgacctcgtttgttatgtaaatgga

SEQ ID NO: 537240 - DNA, 361 bp, Homo sapiens
tggagtagtcaaccaatatggagcacttagagatgcaacaaggagacgcgccttttgcctggtctctcaagcgtatactttcaatcatcgccgatgattttgcagcctttgttggacttcctgtagaagaggctgtgaaagggctattagaaccagggagggcaaggctgatttcaccaaaaagaatggttcttggcccagaaaaggccagtggcagggggccttgggatgtttccttttaacaagtttatttcccttatacagagccctgctcccaagtttccccccaaataccccaaatggaaccaaggcaagtttaagcccagaactggacgggattaatggtgggctttcccttgga

SEQ ID NO: 537241 - DNA, 476 bp, Homo sapiens
  misc_feature (269)..(269): n is a, c, g, or t
  misc_feature (323)..(323): n is a, c, g, or t
  misc_feature (395)..(395): n is a, c, g, or t
  misc_feature (436)..(436): n is a, c, g, or t
  misc_feature (448)..(448): n is a, c, g, or t
  misc_feature (453)..(453): n is a, c, g, or t
ttgagacacacacgcacacttttcatttagagggaaaataatttcatatgacagtatcatttaaaaaatttaataaacttattaaagtataatctccatacagaacagtatacaaattttaagtatacagcttgatgaattattacaaagtgaacatatcatctaacctccagccagatcaagaaatagaacatggctggatgcggtggctcatgcctgtaatctcagcactttgggaggccgaagtgggcagaaggtcgggatttcangagcagcctggccaaaatggtaaaaccccgtctctacttaaaatgcaaaaattngccaggcgtggttgcaggcacctataattccagctacttgggaggctgaggcaggagaattgcttgaacgcnggaggcggaggttgcagtgagccgagattgtgccattgcantccagctggganacaanagcgagacttcgtctggaaaaaa

SEQ ID NO: 537242 - DNA, 281 bp, Homo sapiens
tgagggcacagggagaggtgcttaggctgaggaggagatttgagaaggcagcccctttggtcctatcagcagcttagaggaatatgaagcatgaaactgtggaagcctccttgctggctccttttttgaggaactgtctaaaaatgggaggcattcacaaggtagttctcttttccctctgcagtctttaagatataaattttaaaactgcagtttctgggattagagaagaaattgccaattattgaagtccaattttctctagtttggcccttatcgag

SEQ ID NO: 537243 - DNA, 206 bp, Homo sapiens
  misc_feature (64)..(64): n is a, c, g, or t
agactctagaggattcctggcaggcgaagcaggataacacgacatgtgaggggataagagaacnatttatcaggagcatccctctccaaaaactctggcttccacctcctttggaggtgcagctccaaagcagaaagatttttcctctgggctttctatttgacaccccgctttccctggacctcaccactggggagaagccagcc

SEQ ID NO: 537244 - DNA, 1454 bp, Homo sapiens
  misc_feature (502)..(502): n is a, c, g, or t
  misc_feature (540)..(540): n is a, c, g, or t
  misc_feature (769)..(769): n is a, c, g, or t
tgataattttccccggacttcctatgtatagcatgtatgactggagcagttgactgtgccactggagccaacgccataggatacagacataagtggagatgtttgcgccgtgtgcaatcggggcgaactcaaccacacgagagaccaacgagttccagtacttgacgtgacatagtgtatgcaacctcgaaacgaatctgcgggtatccattcggtagcatgagaacatgagtgtagtacgatgtaggtattgaacgatcctttgcgagacagggaaggaatcgtaaagtagtcgcattgcccattggcatgatgaacggacatcccatcgtcttccaatctattgcaatcgatgtccgtgagcagaagttctgatgtcatcacatccaggagggagctttgcatcgcggagttctccaagaccagagagaacaacttaagcacctgaagtcatcgtagcgactatgttcaaagacaaggcaggcgacgcagagcagttggntcgctaggccatcgttgccaatcgcgcagaaaacgccncgaatgtgtccccacgcatccatatatcgagcgcctaggctttggcccaactcgaggactgtgtccacgaaccgtaggcgttcactttatgcatggggactgcgcgtaaaaaggggaacgggaggtccgggcaggcgcggtcagatggtaaagtggaagcaaaatccaatgacagggtctgtgcgaaagtccgaggagaatgacagacgcagagagaaaggtctcgcanaggaggagacaaggacgccccagcgattgggcggggccgtgggacgtggcgtacggcgaaagcggagtgcccaccgcgccaatctttgtgggttggggtagggcagtcgcaaagagtacgcaaggtggcgtggtggcaatgtggcccgcgaaagggcgccctgcattgcgaaggggggaccatttaacaaatcggtcgcgggaaacggctcaacggacatagcgggatgggagcacgacaaagtgctgtggtcgttggagggccccagagaaacccccggagttctttccccaatggaaggtgcccccaggcgggtgttccagggccggcggggaaaggcccatttggctatgtttaagaccctgttcataaaagggattctcctcttggcctacagagacgaacgacaagggtcccagaaaccaggggcaaggacgcatggcacaaaggtggtcgtcctatgtaaacaccaacctacggccctaagaccagggcctaggacaagttccttccgccgttgggggccatgaagagggccacctcagtgggaacacgggcgcccccttgtgttaccaccacaggtgtgactttgagaatcacagcggagaggtccgagtagaaaaggtatgcgcgcgggcccttatgaaacaagggagtctctcaagcacccatggggggggcctcc

SEQ ID NO: 537245 - DNA, 575 bp, Homo sapiens
cggacgcgtgggcagcgcctttggaaaccgcaagaacctaaagcacaatgccgtgcccacggtgttcgcctttcaggaccccacacaggtgagggagaacacagaccctgccaggtgagcacgacggaaacattgcccagcttcttttctttcagaaaaggacaagggtctctgggggcgagactctggaattgccgctgagactatgccatgcagcgtaacgttccagagcgacagagtgtgcgcgagcctggctaagacccaacactctgtccgttgcttgatatcctaagattcctctagaagaagctcgaacctgcggcccaagctgtgagcgaggtgtcaccctcgtgctgcagggacgggactcagcagactgggcagacacgagctgagccccaaggtccggagcgagtgggggaccagccgaagttggagtcggtgtggactttgttgtggacctgaaagtggctgagctttggcggatcgagacgtagccactcccgggaacccatgcgctggggacgttagggtgcctagatgcctctgtgactgaagttctccatgtacgagtc

SEQ ID NO: 537246 - DNA, 926 bp, Homo sapiens
gggatggggagagacagccaggtatcgtgttgtatcacgtgtttgttttacacttgttggtgtactacacacctatggccgatgtctgtactaccgagtgataatcgctttgggcgccagtggccacccatgtggctttcagcgctgggcccaattacaggcgattgtgttacccagaagtccccgtggaccccacttgttggggctcccaaccctggaaatgggccaacaaagtgtgaaacgtccgggcgcaaagatgctccttgcggagcatacttatcccggggcgcgagccctaaattgtggttcactggagaccccgctaggtccaagagctccaaagcgtccaccgaaaccttgtgtgacaagcgacacatctttctactcttggacgtgtagtaacaaaaacgtcccacaagttttatatccgtgacacaccccccgtccccgccgatattagccaccacttttggtgaagggtacacccatccagaaacaaccacactcacctgtttagcctttgggtgaacaccaaaacccccggcccacccaagtagcgaaacctttaaaccttttttgtgatgaagttccccaccttttaaagaaattgtacaacagcgtgcaaataaagaaaccctcctttttcccagggaagggttaaaacctttgttgtcatgccaatcacatactccgcttatggcgattactaaccatcactccttgttcatccgtcatctaccgcccctccccttaggatttatgaagagaaagaaattgagactcccaaacgttaattctatcctgtttttcctttttctcgtttgtgtaaaacccacacccccttctttataaaaaaaaaaatttttttaacctttccccttttttttgtgctccaataaaaaaaaaagggaaaaaaccccaaaaaa

SEQ ID NO: 537247 - DNA, 450 bp, Homo sapiens
ctgcatagcccagaaatgttgaaaaattaagaaaatgttaggtatgtcacaagtacataaaatatatgtaaatattagtctattttatcatttactatcataaaatatacacaaatctattataaaaattaagaacatcaacatttatgcacacaaacaccaccgtccatagcaccatatgcagttgggagaaatgtaaacaaacataaagatacagtactaaatcataactgcataaaattaactgtagtaatactgtactactcaaataatttctacaactatactgctaccatactactttaataattttgtaaccacctcctgttgctgttgtgatgagctcaagtgttgtgaatctctgcttaaaaactgtgtcacgctaatcatctccctgtgagcagttagtctctccagtacattgtatattgcagtaaaaagtgatctcct

SEQ ID NO: 537248 - DNA, 172 bp, Homo sapiens
cgtaccaggtactgattagcacacactcctttgatagacacaactcctctctcttctgctcaagttgatagctatgatgtgaggttcgctcttctcccggaccccgtcaactcgagccgtcggggtggatgcacaagaagaagcccccgtatatgcagtacagccggggtac

SEQ ID NO: 537249 - DNA, 348 bp, Homo sapiens
acagctacgggaggtacagctgctgaaaggttgagagcttggttgtgggggtccatagtgaggcagatgctgtgcgtgaagaatctgctgtgaggcagatagtttgggactgtagagtgcctgacgggaggcagaggctggtgcctggaggggccaccaagatgcaggagctgggcctgtagaggctgcacacacgctctgatgcctgtgcctggtgaggtcgacttgagaaagttcatgtcctggagaggaatgcttgtgaggcagtagctgtggtctaaagagtgccattgtaactgatggagctttacctcaaccgtagctgtacctcaaccgttagttgtcctc

SEQ ID NO: 537250 - DNA, 140 bp, Homo sapiens
gggggggaaccccccccccccttttttaactggggggggggccccccggcccccccccaaagccctgtgaggggggggggttttttaaacttaaaaccggggttttttttggggaaaaaaaaaagggggttgggttttta

SEQ ID NO: 537251 - DNA, 353 bp, Homo sapiens
cacggtcagctctgccgcatcaacgctaagacaggaaattgacaaagcagcacctaaaatagctaattttttcatggtataaccctaataaaccaaattttgacagtgtattcacgagcagctacttcgaacaccgagcctagcttacatgaggatccttgggaataagcatgcatttctggccaattaggcttgcaaccctacagttgcgatcatcagcggtcctcgcgggtttgccataaacgcagcaggtaaataatagagcctgcaatctcatagcgcatttcatagtggccgatctgaattcggcgcacatcccgtggtcgaactctcccaggcgttcgccaatgcgc

SEQ ID NO: 537252 - DNA, 625 bp, Homo sapiens
gcccaagcctggctgagatgattcagaaaggtgagcagctattcctggagccagagctggtcatccccgcacgcgacagcacacgatgtcttcacggaccccactattcactgggcagcttcctgatcacccatggtcgcaccatgcgtgctcactgatgcctccttcaaggtgaagagccagcgtcgacagctctggagggccaggactgcaagtacaccaccgatgtttgggcccgaggaccgctacgcctgagtcctgacgcctcgctcagcgtcatcacagcaggcgcaaatgacagcagccaagtgccatctccgagcagtgtgcggagagcccggctggaccactccttcctctcatggctgggctttagctccatggacaccaatggctcctacacagccaagcgacctggacgagatggggcaagacagtgtccggaagacagatgaatacctggagaaggccctggagtacctgcgccagatattccgggctcagcgaagcgcagcctcaggcagttcacactcgccttgggcaccaggccaggatgagaatggaaaagaaagcaatccccgactgcatcgtgggtgaggacggactcatccttacgcccctgggt

SEQ ID NO: 537253 - DNA, 926 bp, Homo sapiens
  misc_feature (64)..(64): n is a, c, g, or t
  misc_feature (66)..(66): n is a, c, g, or t
  misc_feature (73)..(73): n is a, c, g, or t
  misc_feature (84)..(84): n is a, c, g, or t
  misc_feature (93)..(93): n is a, c, g, or t
  misc_feature (95)..(95): n is a, c, g, or t
  misc_feature (102)..(102): n is a, c, g, or t
  misc_feature (110)..(110): n is a, c, g, or t
  misc_feature (113)..(113): n is a, c, g, or t
  misc_feature (128)..(128): n is a, c, g, or t
  misc_feature (146)..(146): n is a, c, g, or t
  misc_feature (148)..(148): n is a, c, g, or t
  misc_feature (152)..(152): n is a, c, g, or t
  misc_feature (156)..(157): n is a, c, g, or t
  misc_feature (159)..(160): n is a, c, g, or t
  misc_feature (165)..(165): n is a, c, g, or t
  misc_feature (176)..(176): n is a, c, g, or t
  misc_feature (181)..(182): n is a, c, g, or t
  misc_feature (211)..(211): n is a, c, g, or t
  misc_feature (216)..(216): n is a, c, g, or t
  misc_feature (331)..(331): n is a, c, g, or t
  misc_feature (365)..(365): n is a, c, g, or t
  misc_feature (711)..(711): n is a, c, g, or t
  misc_feature (713)..(713): n is a, c, g, or t
  misc_feature (922)..(922): n is a, c, g, or t
aatatggcaataaatgcttgaaaaatacacattttaaacttaaaaggatattgaaaacaattantntaaaagnaattaccaatnaaacctaangntggtagntgtaaaancanttgattagatatatnttttggtttttttatatntntttntttnntnnggggnagttgattttnttttnnttactgttcccatctgagagaagtatggnatttnttaattgggaccatttgtgggaagacattgagaaagctcctttgagacacttttttttctgcttggccaactgctctagaaagaagaaacgtcaaggtgggtggagacagtggtntgggcccaccaccctcccggctgaacagcctgtnatgctatttccaaagagaactcgccaggaggggagatgactgcagaacaccaggagatggatagaatagggtaggctttaggtgcagcgtgtggcccccccatcctggggcccccagggaggaagagggggcttccgttgagataaaggccacatgccttaggaaatatccccccagaaagaacccaaaggtccagtgttcttgcagatccaatggagtccttgtagaagggaaggtggatggtgacgcctgctggggtcatgtagcggttgttcagtcagcgttcttgggggccttgcatgtgtgcacatccagagcttccaggcagtcctgacagcgcacggcnanacccagtggaacttacacccacacttggtcatccgggtgacatgggaggtgtcgtagcctctcccacagcacatgacttcacagctgtccatgccccgggaagtcaggttgcacacacggcctgctgtacccagggagcctgcctctcggtctctgatacagtagtctggagaattctcaaaatacacgaggtcatttttcgtggcttnttaa

SEQ ID NO: 537254 - DNA, 408 bp, Homo sapiens
ggctgcaggatacggcacgagcacgagattgagaccagcctgtgcaacacagcgagactctgtctcaaaaaaaaagaaagagtgaaagtgaaaaaaataatgtttctgtattactgtgtaggtttaactttatggaatttctggaccattctttgggaactgcttctgtgcattatcaggttctcacttacagtggttggacttatgaattttcatctttacagtgatgccaaagcaatatgcatttagtagaaattatactctaagtacccttacaaccattctgttttcacttacacggtagtattccataaattatatgagatattcaacactttattatctgagcatgtttaagggaggccccgctaaactgtgatggtcagtattaattttgcgtttttcctt

SEQ ID NO: 537255 - DNA, 1073 bp, Homo sapiens
tcttgaaacatttacacagtattaagtaaggtgggcaagcagttctaaccagttggtaattataggtctattcatatcttctataaacacaccctacacaaatattattgtccctatttacaccccatttttcactattatagaggaaaacgagaaaacacgaggcacaatataacatctgtgctccagggcccccgagctaagtgaaggggtgtgcataggatttgtgcccccaggacagctcgtggccctcatttttaaccctctccatctccagtgcgtggtgaagtggcttattctcattctcacaatgtgtgtgggagaaggggggaatatttgtggaaaccgtgatctcataagaacccagggcaatgagagagaagcgccaagaaaggcgcgccctatattccacaactcctcacaaacccccggtggggcttctcttgggagaatagtgaaaagcgcagggcacatctctctctcaaaaatgtgtgctgtcgccaagggagagtcgccccacaattttttctcgagggggggaaacacccagaattctataaacagtgtggggaaaacgcctcgtgtgtttaaacctgtgtgcccaaaatgtgatatcactctttgcgtgtttcccactgtggcgctataaatatttgagacctcgggtatattgggccccatttggatacatttccttgtgtgcgcgtgcaacacaaacactatagccaagtcttctctatatataacccgagtttgtgcgcactacgcacgggggttacactgggggctctttaaaatattttccaccgtgggaaccaacgttgtttacaaaatatctgcgcgaggtataaagcaaagtacacgggtgcttaaaacattcgtgggaatttcacgcgacagcgagaattaccctttttaaggaaaaactcttatctttcgtgtgggccacaacactcgtgggcatgtttgcgagaaaacagtcctcgggagacagtgtttggcaagactttaattcactattataagcgtggcaagaaaagttgtctccacaaaaattatattatcaccccccc

SEQ ID NO: 537256 - DNA, 798 bp, Homo sapiens
ctgctaggtagcgaggctgggctgctctgccgcctccggcagccgcgccgctccctccgctgcactgcccaggctctgagcagctgatggccacctgggcctgcgcgctcccagcttctgctcgtgacgctggcttctgtgccctgcagatgggttctgtggccctggactgcggctgagatgctgtggcccatgtgactggtgctgtcctggcctcgccctgtggctgctcgcaccaacaagtttgaacaatgatcacctgtcaaccccgatgggaagataatggtcagaagatgcctggtcaccctgagaccctttcggcttttttgtcctgggcatcggcttcttcactctctgcttcctgatgacgtctctgtgtgagtgccagttctctgtgccctggctgcctggtgggactctgccattcaccatcctgcacatgaatgtgatgtgggggcccctgagtccctgctggctgtcctgcgcaatgatgagcgacctgctggagctgatggtgaatgcgcatggactgcacttgtgccatgtgctggagaacatgcatgtgatgctgcacctgggcctggctggctgacctgcactttccctgcagacatgtgatgccccctggggccgtgcctcatggatctggatccagtgctatttgcccagaactgtctcctgacatcgctgtgaagtgtggaccagatccttgcgccacagtctgctcctgcaccagaaggtgtcagaagtgctggtgggaccagttgttaaggcacccagtgacccaagttcctgacg

SEQ ID NO: 537257 - DNA, 193 bp, Homo sapiens
  misc_feature (17)..(17): n is a, c, g, or t
  misc_feature (64)..(64): n is a, c, g, or t
tcggcggtccggcgcanggtgctatgatgcacacacaaattatccagaatgtgagtttcttttngataaacaaaagaaaaaaggtgactaaaaccccctaacacagcgaatctttcttctcaattaaatcatgccaagaagaaatatcaatgtaatgttatgtaactcagcatcactcggcacgcgtgcgccg

SEQ ID NO: 537258 - DNA, 311 bp, Homo sapiens
  misc_feature (2)..(2): n is a, c, g, or t
cntagaggatccttttctctgatcgctcacttgaacccgggaggcggaggttgctgtgagccaagatcgtgccattgtactccagcctgggtgacgagcgaaactccgtctcaaaaataaaaaaaaaaaaaaaaaaaggccgggcttgagggtgagtgcctgaaatcccagttactcggaaggctgaggtcggaaaatcgtttgaccccgggtggcaagggttggcagtgaacccagggccagtgccattaccattatattctagccggggaaacaggagtgagacttccatctaaaaacaaacaaacaaa

SEQ ID NO: 537259 - DNA, 979 bp, Homo sapiens
  misc_feature (57)..(57): n is a, c, g, or t
  misc_feature (63)..(64): n is a, c, g, or t
  misc_feature (66)..(67): n is a, c, g, or t
  misc_feature (76)..(76): n is a, c, g, or t
  misc_feature (86)..(87): n is a, c, g, or t
  misc_feature (89)..(89): n is a, c, g, or t
  misc_feature (99)..(99): n is a, c, g, or t
  misc_feature (135)..(136): n is a, c, g, or t
  misc_feature (140)..(140): n is a, c, g, or t
  misc_feature (158)..(158): n is a, c, g, or t
  misc_feature (166)..(166): n is a, c, g, or t
  misc_feature (182)..(182): n is a, c, g, or t
  misc_feature (206)..(206): n is a, c, g, or t
  misc_feature (215)..(216): n is a, c, g, or t
  misc_feature (275)..(275): n is a, c, g, or t
  misc_feature (291)..(291): n is a, c, g, or t
  misc_feature (334)..(334): n is a, c, g, or t
  misc_feature (372)..(372): n is a, c, g, or t
  misc_feature (428)..(428): n is a, c, g, or t
  misc_feature (430)..(430): n is a, c, g, or t
  misc_feature (458)..(458): n is a, c, g, or t
  misc_feature (465)..(465): n is a, c, g, or t
  misc_feature (467)..(467): n is a, c, g, or t
  misc_feature (474)..(474): n is a, c, g, or t
  misc_feature (479)..(479): n is a, c, g, or t
  misc_feature (503)..(503): n is a, c, g, or t
  misc_feature (505)..(505): n is a, c, g, or t
  misc_feature (509)..(509): n is a, c, g, or t
  misc_feature (515)..(515): n is a, c, g, or t
  misc_feature (519)..(519): n is a, c, g, or t
  misc_feature (530)..(530): n is a, c, g, or t
  misc_feature (532)..(532): n is a, c, g, or t
  misc_feature (536)..(537): n is a, c, g, or t
  misc_feature (557)..(557): n is a, c, g, or t
  misc_feature (726)..(726): n is a, c, g, or t
  misc_feature (790)..(790): n is a, c, g, or t
  misc_feature (799)..(799): n is a, c, g, or t
  misc_feature (803)..(803): n is a, c, g, or t
  misc_feature (841)..(841): n is a, c, g, or t
  misc_feature (892)..(892): n is a, c, g, or t
  misc_feature (967)..(967): n is a, c, g, or t
ttaaatcgtttatagattacacatgataatggtttacaagcatcattcccatctatnattttnncnngtaccattnttcattttanntntattgcttangttgtgccatttatcacttttataaccattccatcnntttncttgggtaatcccttttnatggtgancttcaggtcacaacanttactatcagttcaactacaccanggtttccgnngacaatggcttctccacccaagcaggttgtatataaattccaaatagaacctggcatcnccctgcaggaattctnacttcacactgttggggaaatttaccaagatggcttaagagtngactaactttacacagcacattaaaaaaaagacatttnttcagcgtcacgatcagactgttacatttagcaatcaacagcatggggtgcaaaananaaatctacattaaaaccctttgttggantgctttncnctttccncagancagaaactaaaataacctgttatncnattngtcccnaatnccgtcctcgcntntttnncccatacccttgagtctttntctcccacatgtcttctttgtagcagctaggccctgccaccactgtgcttggctgagttcacaaatctgttgtaacctgtagcttccctgtcacttctctggctctcctctcctgctaagctttgtttcctaattaaaatcttctgccactgccatagctactgctgcngctggaaccgccatagccaccttggtttcgtggttttgcaaagtattggcctccaccgccatangggccagancttntgcctccaaaatttcctcccttcatgggtccaaaattngaagactgattgtcgttattcccaaaatcattgtagcttccaccacctccnaaaattgcttccatcattaccaaatccattatagccatccccactgccaccatatccaccaccaccacgggtgcnaccaaagccacc

SEQ ID NO: 537260 - DNA, 4149 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgggggccca

SEQ ID NO: 537261 - DNA, 683 bp, Homo sapiens
gaggcgggttatctgactcttaggagcaaaaaggtctcacagactaagcctggtctgggctccagaacacacattgcctgctgtcataatacagtatgaacgcgtccaatgagtacaccgaagaataccgtacggtcttgactgaagaatcatgtgggctgcaaatatgggatgttgccactgccagggatcaagccatataggaggaccggcaaggtgccggacggcatattgagaataaaacgcgacaaaagatctgcgcagctcattacaaacatggcgggagtgtacacttgctgtcactgtcgcccaggttcaagaggacacttgccacatacttgccagaaccggggactgtaggatgtcccctctgacaaactatgctcccattacgtcctataatgaccactacattgacacagcagctatagcattgtctgacgtacaggtgactgactcaacactagaggcttacgcatcccgaaaaacaagaccctatactggggggaccttgagaattaacacgactactggaacaagatctgtaactttgtcacgcctgattaatcactggggagaaaattctcagaggtgccaaaattaagattttgcgggatgctttatacaaagtaccgaagttccctcgacaaaattaaagcaccctgttggggcaaaaattttcg

SEQ ID NO: 537262 - DNA, 4011 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactggaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgggggccca

SEQ ID NO: 537263 - DNA, 160 bp, Homo sapiens
aactagtgtgtgtgtagtagtaagcagagtacacccacacttacatcagcacttatatcaactgccccatattaggacttgcctaacattctccaataaagttacacatagtccaggattaaattgtgttttctatacattttccagaggatgacatact

SEQ ID NO: 537264 - DNA, 3280 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacaggtaagtgccagaagcctggattgagcttggaatctctggcagcaagagggttgggcagtgatgtgtgttgtgcctgccgaattcggtaccagctcgattcgtatca

SEQ ID NO: 537265 - DNA, 255 bp, Homo sapiens
  misc_feature (11)..(12): n is a, c, g, or t
  misc_feature (39)..(39): n is a, c, g, or t
  misc_feature (73)..(73): n is a, c, g, or t
  misc_feature (82)..(82): n is a, c, g, or t
  misc_feature (99)..(100): n is a, c, g, or t
  misc_feature (114)..(114): n is a, c, g, or t
  misc_feature (122)..(122): n is a, c, g, or t
  misc_feature (151)..(151): n is a, c, g, or t
  misc_feature (155)..(155): n is a, c, g, or t
  misc_feature (182)..(182): n is a, c, g, or t
  misc_feature (188)..(188): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (204)..(204): n is a, c, g, or t
  misc_feature (213)..(213): n is a, c, g, or t
  misc_feature (218)..(218): n is a, c, g, or t
gcggacttttnncaagctggtctttcttccccagtgtanggaatcctcctactaaaacaccaacaacaaaacncgccagctnttaagtgccgcagttannggggctagtcaggncatttttntaactaagaatcaccagatacccaccatngtanctatcgcagttttagtcgttctcccancccagngccngnaggtntcctnatattaccncagantctatttcctttttcatttacagctttataattagaa

SEQ ID NO: 537266 - DNA, 256 bp, Homo sapiens
tacccaaactgagctggatggggaggggatgtatcctgacacccacagggaccaagtgtcatgaagattgttgcttgatctctcaccactagtttgtgatgtccccgttaggacgataggtggtcatgggacccacatcaggagggggtgagggcaccggggcctccatgatgagcaccactgggctccgactgccattgaggacacgatgccccccgggacctttgacacccgggggtatgaggggccctggtta

SEQ ID NO: 537267 - DNA, 3576 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaaagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 537268 - DNA, 322 bp, Homo sapiens
atccggaaataaaaagagcgtcaattaacgcttccttgtagacaggaaattcaaaccggaattttctgcgggccacatcgtgccctaaaaacgaaatacgtaaacgacattctgttcattaaaaggtaaggggctgcattaaatgcctgtaaaacattctcacaataactccggtacccgggttttcgcagcgctgatgccggtaatggctgcggtactggtcggctttattattatcggtgtggcacttcccgtcctgccgctgcatgtcaaaaatgacctgggcttcgggacgtttatcgtgggcctggtcgccggggca

SEQ ID NO: 537269 - DNA, 1376 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaagtaaggactgatcttggctcattctattctccaggagaggacaaaagaaaggggtaataaatcttaagagcctgaactcttaagaacataatgaagtctgcttcttttgtcaccgcattttaacctaacttcaggttccagttctgatacctgtggactttttaccttaactgaaattaggagaaataggttagggaagtgcatagtgaaactgagatccaggtcataagaaaagaagaaagtgtttaggaaaagcccataaagaaagggagagaccgaaaagaaaaagaggggaaaaaggaaagaaggaagggctttactaggaaattttgcactatgaagttttatgaccaaaccactccagttatcatctaatccacaaaagcctcctcattagcctcattaacccactccttcccaaatcatttttcaagttcacagaatcgaatcacttgttaaaaatcaatattggtttctcattaaaactttatttatactagaaaaaaaaaaaa

SEQ ID NO: 537270 - DNA, 1123 bp, Homo sapiens
  misc_feature (42)..(42): n is a, c, g, or t
  misc_feature (46)..(46): n is a, c, g, or t
  misc_feature (461)..(461): n is a, c, g, or t
tcaaagttcagtgatggcagatgtccctccccccgaccaagntgantgtccgagttcgacttcagactgcagtgctagcatcgagaatttcaagtcagtagttcgtgacttgctgcgcttgtgggagtgggacccgctgagtgagaccacttggctcccttgcttcagccccctttccaggggagtgaaaggttctgtctccctggggttctaggcgccactcagttggaaatgcagaaatgactcagttggaaatgcagagacttctgcgttggtctcactgggagctgcagactggagctgttcctattcagccatcttgccagctcctataaatggcatttcttaatcttactgtatttccatggaataaaagtaattcttatgcacactgaagttaaaaaaaaatagcatttaaaatttctgctcaggaaagtagtataatttttaacataagtgantttctctttgtgttataatgtaatgaattcttatacgcatatggagaggaaaatgacatttttctatttatggttttagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgggggccca

SEQ ID NO: 537271 - DNA, 910 bp, Homo sapiens
  misc_feature (22)..(23): n is a, c, g, or t
  misc_feature (63)..(63): n is a, c, g, or t
  misc_feature (100)..(100): n is a, c, g, or t
  misc_feature (110)..(110): n is a, c, g, or t
  misc_feature (128)..(128): n is a, c, g, or t
ttctacaacaaaacaaaaaaanngatttcagtgtacttccaacatatggccctcatccttcanaatgtggatctgcccaattgaagaggccttatttcanctccggcgangggcagacttaaaatttnttttctttttatcactgtcacacagcttataacatgtatgcttttcagaatacagttctctagccaagccatcaagtgtctgaaattcaatattggtttatgcaaataccgcaaacttttatttaattaaatggggaggggagtgtttaaaatattaggaatcctaaaccatattttcaagacatcttaacagctaaggattctcaaatggaagttttatatataatatgttaaaaacattttcctttcctgggtaattatttcatccttttaaattcaattcaaatcatttgtcctgtatcattatttgtgttaaatctgcacagtatttaagatgagtttttcgtgacctctatttgttctcatatcttttgtctcaaatatcaattacccaaattccttctttgtttatttttttaaaattgtccttaaaaaaactatcataaatttccacaatcatttaaaaaatatttcccaatgtaaattagagtccttaactaataactcatcccattatacttttttcttttattttcaaaccttctttcccacaagctcttcgaaacccccacgacccaccctctctaaccgccacactggactttatgattatcaaaagattcttatttctatcattacaaaccttctctaatgcaaaatcaactcaaaatcaccataacgatgatcagcgttcctaccggccgccccctcgtcctccctaatccacacccaacacaaccccccatccacctatttcccctcacatcacgctcgaccccccg

SEQ ID NO: 537272 - DNA, 767 bp, Homo sapiens
  misc_feature (42)..(42): n is a, c, g, or t
  misc_feature (46)..(46): n is a, c, g, or t
  misc_feature (461)..(461): n is a, c, g, or t
tcaaagttcagtgatggcagatgtccctccccccgaccaagntgantgtccgagttcgacttcagactgcagtgctagcatcgagaatttcaagtcagtagttcgtgacttgctgcgcttgtgggagtgggacccgctgagtgagaccacttggctcccttgcttcagccccctttccaggggagtgaaaggttctgtctccctggggttctaggcgccactcagttggaaatgcagaaatgactcagttggaaatgcagagacttctgcgttggtctcactgggagctgcagactggagctgttcctattcagccatcttgccagctcctataaatggcatttcttaatcttactgtatttccatggaataaaagtaattcttatgcacactgaagttaaaaaaaaatagcatttaaaatttctgctcaggaaagtagtataatttttaacataagtgantttctctttgtgttataatgtaatgaattcttatacgcatatggagaggaaaatgacatttttctatttatggttttagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 537273 - DNA, 260 bp, Homo sapiens
  misc_feature (68)..(68): n is a, c, g, or t
  misc_feature (72)..(72): n is a, c, g, or t
  misc_feature (106)..(106): n is a, c, g, or t
  misc_feature (109)..(109): n is a, c, g, or t
tggccgatcaggggtgatttaattttctagtggagaatttacatatctccctcaccctgtcttttaanttantgtgacaaggttggggggggaactacttaaaaanaanctttggtcaaaaatgggatgagatcgcaaaaaaacaaacaaaaaaattactgcgttaaaaaaaccaacactttcaccaattttatattcaaacaaaaccacacgggattggcgtgatatgtgttttcagggggggcttggggctggcttcc

SEQ ID NO: 537274 - DNA, 360 bp, Homo sapiens
  misc_feature (60)..(60): n is a, c, g, or t
atacggattcatgagatacttagatacaggctgcagagcatattagtcacatcatataanatgggataatccatccgccgtatttatcctttgtgttacagactatccaattgtacacttttagttactttaacctgtacaattcaattattattgactatagtcaccattatgcgccccgtcaggatttccataaagtccccgggtaacgcttaatgttctagttctggtgcgttcacagtttttgatttgcctgtgtgaagtcaggcaagccctttcatttcgatgatttagctagttgctatgttactatacaggcagattatactctgccttttttgttgaagtttttcaatattc

SEQ ID NO: 537275 - DNA, 374 bp, Homo sapiens
agtctcagcgactttgctctcttcagccttctgcactccctgggggcagatgattccagtactttctcatcctcctcagcttgaacatcttcatccccatcttcgtcattttctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgtaacttctcccttaactgggtcagctctcgttcccgagagtgaaccaggactttatattgctgtatttcttctgtcggttggccaggaagccggaagaagaaaatgat

SEQ ID NO: 537276 - DNA, 406 bp, Homo sapiens
catgtcttggtgtgtttaaaactaaataagtcacatctgtaatttgaaggagactaattgtaacgtttatgactagaactgcttgaagaagacagtaaatgttgtattaaaaatcatagatgaggccaggtgggatggctcatgcctataatcccagcactttgggaggccaagacggtggatcacttaagatccagatttggagactagcctgggcaacacagcaagaccccatctctgcaaaaaatgcagaaattagctgggcatggtggcatatgcctgtggtcccagctacttgggaggctgaagtgggaagatcacttgagccagggaagtggaggtgcagtgagccaagatcccaccactgcactccagcatgggtgactgagtgagatcctgtctgaaa

SEQ ID NO: 537277 - DNA, 129 bp, Homo sapiens
gttacgggtcctgggtaggggcacagcgaattaggcgggtaaacgttcgagtacttgaaacgggagcactcgctgtcgaagccctaccagtgtgtggtgcacaggcagttcctcactgtggaatctaga

SEQ ID NO: 537278 - DNA, 384 bp, Homo sapiens
cgtcgacgttttaagaaaatctattagatggtgcatcaaaataatgatttgaaatttttattttaggaaaagacccttctaagttccagcccaggcatattaacatgtaaagtgcatgtgttggcctagagagcgggctgcgttattgaggagagtaggatgttagcttacacagggcagcccctcccaccagacaggaaactcaggctgcctgccttcaacagctcaggatcagtgttgggagcgataagaccaacctcccagtaggaggataaaacacatgttacagaaacacgtttgcagagaaacggaatcagtaggtgatggcggatggatggatggatggatggatggatggatggatggatggagagaggtcgacgc

SEQ ID NO: 537279 - DNA, 115 bp, Homo sapiens
gtactcggagacaaagtaaacacacgagtggtcaagacaggaggtgggattcgagaagtggtgtcagtaatctttcttgattcggtcaaggagagcctcatgtacccattctcta

SEQ ID NO: 537280 - DNA, 352 bp, Homo sapiens
agcattatgacgcataggtaaagtgacatgtagtatatctgtgcaaaataaaactaatccttaactcagttataccccacatcaatgattacctgagtactagtaatgcccatgagaagagaccagtatatttgcaatcagcaaatgtgctggactaccacaagcaaaatgcaaggggaaaaatccaggcccaggcaagagactctaatgtgtagagccaaagctcagaatcaagatggtgattataaagagatacatgataaccctgcacaatatacctataaaaagcacctgggttcttgatatccattttatatttataatcctgtggctcctagctaaataatctcag

SEQ ID NO: 537281 - DNA, 679 bp, Homo sapiens
tccacaaagagagaggcaattttattcttccaaaaaattgccccaagagagggtgaccacaggagcaccccgtgtgccattcccccatcctaagcagggctctgagatgaggccaggccttgacgtgggcttgggaaaagctgacggagcctccctgtttggccttggggagggacccaggcagacctggaagtggaactttgttgttagcaccaggagccgcccacagctgggctcggcaacagggcagcacattggcccgtgtttgccttccacctgaaagttctgggagaggggcttggtggcaaaaggcctcccgtgcaggaggtcacctgaattgactctcagattcacaagacccccttttgcccccaaaaccccgtgttaaccttgaaaatgtgggcctcggtgaccacccttcaacaccttcaggacaagatgagggttccgaaatgtgtggctgggctatcaggcggcccaggagctgccgggcattctccgtgcatgaaagcgctggtccctggtccccccgaaggccaccgtttctccaggccctggaccttagggcgcaggtgtcgtgacagtggcttcggggcttctgggcgccattgctgccttctcgggcattggcttgcaagacagccctggttgagcaagctgtggtctacttggatacctg

SEQ ID NO: 537282 - DNA, 325 bp, Homo sapiens
ccagttccaactggaagaggttttattggaagggagagagacaaagaagtggtagagagagaagaggggggggggcggagagagagcgaggagaaggaaagagagaggatttctcgggttttttgagataagatctctctgtggagccttttctagcctggaaatcactgcaaagaccaggctggtctcaaattcagagatctgcctgcctcttcctcctgagtagtggggttaaagacctgtgcccataggcctggcagttaagtactgtgtattgatgagtatctgatgcctataacatctgtaggaggctacagtcatctgc

SEQ ID NO: 537283 - DNA, 255 bp, Homo sapiens
ggattcttctcttacaagatgtgagagagcataggcctgttgacatctagatttcagacttccagcctctagaactgtgagataataaattactgttgttctaaaccactgaatttgtttacctagttatgacagctctagcaaactaatacatcatagatattagtagtcatggtctcctggagaagtaattagcaaggtagtcaagtctggacccagtttaattcccaggttcagtgctcaatgcctgtctct

SEQ ID NO: 537284 - DNA, 1514 bp, Homo sapiens
  misc_feature (470)..(470): n is a, c, g, or t
  misc_feature (522)..(522): n is a, c, g, or t
  misc_feature (543)..(543): n is a, c, g, or t
  misc_feature (546)..(546): n is a, c, g, or t
  misc_feature (568)..(568): n is a, c, g, or t
  misc_feature (648)..(648): n is a, c, g, or t
  misc_feature (694)..(694): n is a, c, g, or t
  misc_feature (720)..(720): n is a, c, g, or t
  misc_feature (747)..(747): n is a, c, g, or t
  misc_feature (786)..(786): n is a, c, g, or t
  misc_feature (789)..(789): n is a, c, g, or t
  misc_feature (912)..(912): n is a, c, g, or t
  misc_feature (932)..(932): n is a, c, g, or t
  misc_feature (934)..(934): n is a, c, g, or t
  misc_feature (937)..(937): n is a, c, g, or t
  misc_feature (940)..(940): n is a, c, g, or t
  misc_feature (1011)..(1011): n is a, c, g, or t
  misc_feature (1026)..(1026): n is a, c, g, or t
  misc_feature (1146)..(1146): n is a, c, g, or t
  misc_feature (1163)..(1163): n is a, c, g, or t
  misc_feature (1196)..(1196): n is a, c, g, or t
  misc_feature (1300)..(1300): n is a, c, g, or t
ggactgaactcagtccaggtggcgcgcatgtgctctgcacttcctacgatggccggcgagcaatgactctcagtagagatacgcgaagagacgtcgcatgcgtctatgcgtatcatctatacacatgcttcgctgaggcaccgtggccgacacctgtactcgcctggcggaggtccgtctgccaagtcgttggcgcaattgtgaaacacaacctagctcgatggtcaggtgctgatactctcgtgccagggacttcctaggcgccgtgagggcgtagctgctgtcaagtgttgcgtcgcgtggtgccacatggtcacggcacgaacgtgcctacatgtgactagcgtcctgctcctatgccaatgttcccatgaggtagaatggcgtctcccaagatcagaaacccttaggtaagtacccgaagggccccgaggaccgtgttcgcgacggaggagcccacaagcgggggnctctccctttgtggtggcggttgtgacggttcgcattctccccctacgtggntcctgggagcacccaacgccnagngctccattcctcgagcagggcnatgcgcctagtacctcctaacttggttgttgattaaccctatggacaccatcattctcaaaataaatgggaagccttggnttggctacaaccctaacgaacggaaggtgcattcccgtccgtaacngtcctaaccttagatgaggaaccatnttaggccacaggtcgcttctagtaggncgatagggaagaaacaccatgggaagaatgcttgtcagncgntgcttaggcatggtgtgctcctatgacattgttttgggtggtgccgatgcgaggcggcgctgtcagtccgccgattacaggcgtaacgcctagggcgtggcacggtggtgcggcgtgtaggcnattctaacagcaatgaatcngnccncgnctccgaaacatccacaccgaacagagtaggggcgtacccgccgttttggctttgcccttggtgtccagtcntccgcgcaaccgggntcgtggaggatcggatgcgactacccattgggccaggaaggaatcctgtgacagaatagaggcaacggaaggcttaggcggtctggggtcgggcatgaagaacgcataggtgacttcggngagcacagaggggcctngagtaggtattgtttcgcacggggctggacctnggggggacttgtgtctccctcggggtccacggtgtagcttacctctatgcgtacatcccgccggtggattagtggtgcacccatccgtgcgtactggaagcgtngtgcacatgggtggcccgtctgggtgacatggatttgcagacaatttctcgtccagctcgaagaacctggggcagctctcggctgggcaccgcgaagaacttgtgtcttgcagggtcccgctgggtcgacgcgctggcacttgtgtttgaacaccgcggcccgcgcttgttggtccaaccgggtgtgtggcttccgagccgcagcgcttggcca

SEQ ID NO: 537285 - DNA, 274 bp, Homo sapiens
ctttgatctgatggctgagtctaaatctatccaagacctgatccttgagctccagtagtcatgaacccgaaagcacacagtgcactggcactatggggtgtcttctattagtcccgtcctcatgtccaacattgaccatatgccactaccaagcactcaaaaaaaacccaagctctgctctcagctttccctctaacttcccctcacaagatggtactgcaatagcctgttactcaagccagaagcctgggagttcatcactgacatcttaccg

SEQ ID NO: 537286 - DNA, 487 bp, Homo sapiens
ggtaaaatggaaacagggcttattcttgattcccaattctcaactgtacttttcctatttgaatttctttggtgctgtagaaaacaaaaaaagaaaaatatatattcataaaaaatatggggctcattctcatccatccaggatgtactaaaacagggtgtttaataaattgtaattatattgtgtacagttctatactgctatctgtgtccatttccaaaacttgcacgtgtccctgaattccatctgactctaattttatgagaattgcagaactctgatggcaatgaaaatatgtataatgaaaaaaaaaggccgaaataaaataagaatctaagtccgtgggtttggttaataataaaaggccttttgtttttaaaataacaaaaaaatggccgtcgttttaaaaccttttgactgggaaaacccttgggttacccaactttttggggggggcccgaaaacccacatttcccaatggtggggt

SEQ ID NO: 537287 - DNA, 1001 bp, Homo sapiens
agtgcatgatggaccggccgtgtagtaatgatagtgcgcgcgtgctacgtactataccggttggaaccgcggtcgtgcgtagggtggagcaatcagcgccgcttgtggctcgccagctaaaggggtggtggcgcacgccgtgagcagggcgcctaatcaattcgtgtgaaagcgtgcgcgagtttgcgtgaaaactcttcgccagtgttacctgtggggctacgaactctcggcggaacatttggcgcaaatcacgcggcgtatttaagaccccctttgcggtcctcgccttcttcaaacacactgtggggtatagcacacaagtgtgcacatgtccaccggggcctacagaatgagttcttgcgcagcgccgtgggttttccccgagacttgtgggtggccccccgcctttgtgggtcgttatctgggcacacgagacagcgcgggaagcagtacattgccgcaccgcgaccacttgggggcccactgcttgttggcggacaccgacgtcgcgtccctgtgtgtcagatattacccgccgccaataacgatgcggcgcctcctcacgaccacacgttcattcccgcgcgtgatgcagagagagttctctcatagcggggttcactcgggggcaccccctgtcggaggggtctagagagtagatacacgttttcccccgggggggtgcaccctcattgcacatatctggcccgctgggagaccatattaatggaacgatagtgtctcccggagcacgcaatgatgtgccctcatctttctagagagcggtgtttgttcgagcgattcacaatcaagcagtctcctccccacgggcttgttcttccaaatgcgcggcattgttccaataaaaagtcgcgtcggaggcaacatcaaagtctgtcctgccctatagaaaaaaaaaggagagtgcaactgctactacaaccagtcatgtggaggacttcccccaaaagcaaaaaacaatacaaaccaaaaaaaca

SEQ ID NO: 537288 - DNA, 423 bp, Homo sapiens
cagagaatgggggggaggaaaaatggggtatactaattagtggtagcaatttcacttatgcaagggaataagttctagcaatctactttacaacattgtcctatagataaaattttgtatacttaaacttctgtatgggctgggcatggtggcttactcctgtaatcccaacactttgggaggccgaggcgggtggattatttcagatcaggagtttgagactagcctgacaacatggagaaaccccatctctactaaaaatacaaaaattagctggtcgtgttggcaggcgcctgtaatcctagctacttgggagactgaggcaggagaattgcttgaacccaggaggcggagtttgcagtgagccaagattgtgccactgcactccaacccaggtgacagagcaagactccatctcaaaaa

SEQ ID NO: 537289 - DNA, 510 bp, Homo sapiens
  misc_feature (145)..(145): n is a, c, g, or t
  misc_feature (159)..(159): n is a, c, g, or t
  misc_feature (174)..(174): n is a, c, g, or t
  misc_feature (180)..(180): n is a, c, g, or t
  misc_feature (190)..(190): n is a, c, g, or t
  misc_feature (198)..(198): n is a, c, g, or t
  misc_feature (266)..(266): n is a, c, g, or t
  misc_feature (288)..(288): n is a, c, g, or t
  misc_feature (309)..(310): n is a, c, g, or t
  misc_feature (312)..(312): n is a, c, g, or t
  misc_feature (314)..(314): n is a, c, g, or t
  misc_feature (317)..(317): n is a, c, g, or t
caggggcaggagacgggatggtgctttggatgcctgtctctggctctgaaacgggctcttcgtgggtgcacaaggagctgtgagatccccgagagctttaggatgtacagacgagatgaatgggtttgcatcaaatgtacatttntgactgcatacaanaggtgcctaatctgngctganagtcaaaatntacatttntgactgcatacaacaggtgcctaatctgtgctgacagtcaaaatgtacatttctgactgcatacaacnggtgcctaatctgtgctgacantaaaaatacatttctgactgnnananaanaggtgcctaattatgctgacagtgaaaatgtacatttctgaccatacaacaggtgcctaatctgtgcttgacagccaaaatgtacatttctgtgcatacaacaggtgcctaatctgcactgacagtcaaaatgtacatttctgactgcatacaacaggtgcctaatctgtgctgacagtcaaaatgtacattt

SEQ ID NO: 537290 - DNA, 1109 bp, Homo sapiens
taaacagttttcaaaatttcttaaaggcaaaagtgaatttctgtggattttatactggctcccagcttttataggtctcttttaagaaccacttaacgaggaactacattagaaggccttttctacagcatttacgtggtgttcgttcctccggtgccagaattgttgcgcagaaattccaccattataccacacatgtcggaaattttacacatttgtgacaaacgcccatctgtagaactcttatataggtgtgtatgtgccacagccatttctatagagagaagagagggtgttacacctcaccactctatatagagagagccctatagagggtgggtattacaggttctcacaatattatctctcatatattgtgtgttataacactgtggtgtgttatatatattacccagtgtgttctgtgcgcaagtataattgtgcgcgtgtgttatacgcttgtggagacagtggttataaaaggcgtggttatgtggggaaggcgcacttaccggtgtgtataaagtggagtttagtgggcgtgtataaacacaacatgtgtttgtctcccaaaatctcccggctgtacaaacagtttgtgtcccctagaaacagccctgtgagtgtgcgtgggttaaacccagtgtctcaaacacaaatctcccggtggggcgtggcctcacattatctgtgtggcgcaattacttttttatactctctctccccccactgtagaaacgcaagagttaatacacggtttctagacacgcgctcgggctccttgggaaaaaaacgcccctgtggaaagttgcgcgttggtttccaaaaatgtctattttggggatacaatacatctccgctttatatacccccgacaattaatcccgaaccataaaaacgatctcccgtatttcccccccgttagatgaacactcctaccccccctgtatcccatatgaagcgtctcggcactcaaaaacaccgtccataaacgggtattcccaaccaacattaggtggtttaaccgttagcagaaaccgacataagtgtatgactcactacacagggggaaaattatttatgaaactagtggagcgccaccagcgaaa

SEQ ID NO: 537291 - DNA, 1693 bp, Homo sapiens
  misc_feature (541)..(541): n is a, c, g, or t
  misc_feature (1693)..(1693): n is a, c, g, or t
tggttattaagttttaatttcataatcataaacttaactctgcaatccagctaggcttgggagggaacaaggaaaactatggacacccaaagggaaacgtgcaggcgagaaccacaaagaattcataggaatacgtgcgaagccaaagtgggggtgggagggggtgcctctccgtggagctacagaaaggaagtgactcgtgggtggttaagaataaaacacagagtctcaaacttatattctcagagtgtgtgctccaaaggctcacgacaaggtgggtgatctcctctcttgggcgtggctcttgtgcacattctcctgtggaccccaaaaggggcgcctcacagtgggcctctccaacaaatattctcatgtggccttctctttcacacttgtgtgcacaaaaacacccacacatgtgtcgtgtgccatatcacaaaaccacctctcaggttctgtgtggggcaggtgtgccacagatgtgacaaaaacgtgtggaggaacccaccctctgtggtggtgtttgtgggcgtctcccaanggcaatatgtgtgtcccaattgtgggaccaaagaagattgtgtcctgatggtgtacaccccgcggataatgtgtcttattaagaggggaagtcgaacagggtgtctctctcaatctcctgtctacaaagatttttttctctccccccaatatatgtgatgtggggcctgtgtggccccacctcagggttgtggtccccatatatatgtggcgggggtgtgtgtgagaaaggtttccaccacaactcgctgtgataacaactatataaaaaagcgcgtcgtgggtggagaacactaacattcctgcgtcgtgttgaaacagacgcccgaggcggaaacatccctcgttttatataaaaccccaaaaaattcctcgtattatatcttcctcacccgaagtggtgggtcttacgagagaggcccactccgcaaaacaacttttctcttctggggacagggggtcacctttgtggggggacccctttgtgctttcttggccaaaacaccagaggcttcccacacagggggacagaaacaccgccggggcgcccccaaaaggggggtcttcccgcgcagggcacgaacggggacgcaatgtgtctcgcaaacagaaaacacccggggtgcgctgggtgcggcgcccatcgcgggtaaaaaaggaggtgaaccccgaggagggcgaacaacaaacaatcgggcgcagaacagaagatacaagagggaggcgcggagagaagacatacaggactctccccaccccgctcacttcaagcggtaccaccccccggaaggggtgttgcccccctgggggaaaaaacccgagatggtcccccaggtggagacccccaggagagcacgggcaaatagagcggcgcgaggaaaacaaggacaccacctgagtgtgagtagagagcaagggaagagcgggggtctgacagagagacgcagacaaagagagaccgctgtggggaggcccaacgagattgacgagagcgaacgaaacaccgcgggaggaactaagacacagactacacgtggggacgagagagaaaaaagcacaacgtgtgaggagaccagaatgattgtgcgagacagagagcatagcaggaaaccagaagcacccctatctacccagatgcgtggagactcaaggn

SEQ ID NO: 537292 - DNA, 138 bp, Homo sapiens
taccgcgagcgcatgcaggacagacacctcccgtggatcacaaggtcaaaagctcgacttgatccttatctgcatgtacgaatacagaccgtgatacgcggtgccttcacgatccttctgaccttgtgggttacaacg

SEQ ID NO: 537293 - DNA, 120 bp, Homo sapiens
gatcttgagaatcccccatgtcgaacggactgatcgatgtctgagtcgctcggagacacgccgaattgcttcgcctctcggatcttcaccactcctatagatcagatccgtacgcatgtt

SEQ ID NO: 537294 - DNA, 273 bp, Homo sapiens
acagcagacacctgtacaactccgcataggaagctacaacggcactgcggggggactccctccagctatcatcaacggacgcccttttcttccacagaaggatagacgacaattgatgtttggcagtgactaaactggtgccaatgtcgtacacagggagccatgcgtggtataaagaactagccaccgggaccaaacctacaatgggacagtacggggaagtccagtgcacacgtcagggacatcacactgtgtaccatttggcaacggcca

SEQ ID NO: 537295 - DNA, 143 bp, Homo sapiens
gtgacctcgtggcagggcctggcgtgtagggtctgcttgggtgctcaggtcaggtagctggtcacggtaaagaagccggtgatgacagccagctccgagcaggggatgcagtccttgcttggcgaatggggcacaggagaaga

SEQ ID NO: 537296 - DNA, 814 bp, Homo sapiens
tggtcggcgggcggcggggcgggggaggagaaaggaagggaagggaaggcagggagggaacgggaaaaggcaggaaagggaagggaaggggaaaggggaaaggaaagggaaaaagcagctttattgtaacagccaaaaactagaaacaacccagatgccttcagtagagaaatggttaaacaaactgtggcacatctgttatgtggaatactactcagcaataaaaaggatcaaactattgatacatgcaacaacactctccagagaattgctgagtgaaaaaagccaatcacaaaagtttacatgctctataatttcacttgtgtaacattttttaaataacaaagttatagaaatgggaaaaggactggtggttactaggaggattgcttgaactgggagtcagagggtgtggtgagccgggattgtgccgttgcattccagcctggtaacggaatgggactccctctcaaaaaaaaaaaaaacaaattttagggcttaccctaacttttaaaaggggcggtccgtgggtgcagggatatacactgcttattctccagaaatatccttgtggccctgcaagttctttgaggaatttaattccttttgtttttttttccacacgcacgttttttgcgtgcccccacaggcccttttagagggtctttggcgacacgtttaattaaggcgcgagggggcacccctgatcccggcttggacccgcgggggacatggggcggttaggccctgcgtggggacactctctcaagcaatccctttgtgcccggccgccaggcgggacgtctgaccgcct

SEQ ID NO: 537297 - DNA, 852 bp, Homo sapiens
  misc_feature (588)..(590): n is a, c, g, or t
  misc_feature (596)..(596): n is a, c, g, or t
  misc_feature (601)..(601): n is a, c, g, or t
  misc_feature (604)..(604): n is a, c, g, or t
  misc_feature (609)..(609): n is a, c, g, or t
  misc_feature (615)..(615): n is a, c, g, or t
  misc_feature (625)..(625): n is a, c, g, or t
  misc_feature (627)..(627): n is a, c, g, or t
  misc_feature (637)..(637): n is a, c, g, or t
  misc_feature (642)..(642): n is a, c, g, or t
  misc_feature (666)..(666): n is a, c, g, or t
atctgggaagcgccatcttcacgggactgggatccgcatctgcctgggatcatcaagccctagaagtcagggatttacttataaacttatagggctcgcacgttttgtcatggtctctctcaccgggcgtcatgcaggaacagcctagacagatctgtctatcatagacttatacaaggctgcgtggctgttccactcgttttattccacgagggtgttctaggtctgcaagatggatgaaatcccaatggtgtagacctagtggcgatggatctaggagtttaccaactgagacatttttcaatttctttctggtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggnnncccacncctgncancaacnagccanagggcaccananagacccccgnccagncagcatcgcagggctcaggacaancgcatagctgcctatgcccccgaagaactggctgctgcgtgtgaactgaacagacggagaacgatgtgctaggggagaatcgtgcctccaaggtcacccattttcattgctcgcctgcggaaagagactgtgagactgacatatgccattatctctttccagttttaaacactcatatgcttatgg

SEQ ID NO: 537298 - DNA, 476 bp, Homo sapiens
cccttcgacggtgttctgatcagagactggagaggtgagtgagaagtctccgctgctcgggcctcctgtggagcccccgttccaggtctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacaccgtcgaag

SEQ ID NO: 537299 - DNA, 317 bp, Homo sapiens
gggggaaaaagcaagcccaccccacatgatgcggaagaaaccaagaagctggtgaagggccgggaccctgttgagttgcacaggttttaagcctttgaccttttgagaaatgatgtcctgcccaggcccgatggccattaggacccggcaagcaactctgttctgtgaccaggccaggattcctggagttggcctgagagggctcaatggaccctcggggacccaagtggggctttcaaccctctcccccaccacccagcccactgcactgaaatgagactttattctgaaattattaaaaagaacagagatgctca

SEQ ID NO: 537300 - DNA, 929 bp, Homo sapiens
aagccagagtatgggcgtctaatgtgtcagcagcaaatccccgaggtgtcttcatgatgtgcatcccaaccccccaatgtgacagtgctacccttgcacctgtggccatgcactcaaccagatgccgatccatgtgactccactgaactctgatgtgcacctgcattgcgatgagggatgaccagaccttgatgtgaaccccttgtgcttgttgaacccaattgcaagagtaatcaggcctaaccacaagtgctgaccttggattggcatcacagcacaagcctattgggccgctggagccaagtggcaaccttggaagacccctgggccaacccaacgccttgggtacctccgccctgcactcgcccccgtatcactcccttaacaactgcgcgaaccatgtcctttggcgcaccacgattggcgaacccaccgctgaatcgtgacgtctcacacacaccgaccctttggaccccctggggacacttatataagccgccaacccctaactcgcattttcgcacctggacaccactccccctatcggcgcgcaaaggccgtattttccgccagtttattggcggcgacacactttgtgcgcagtcaaaagtacccggagaacgcggccccccctgtttttggccttacagctaaccaaagccgcaacaaccgttttgggcagctatacagcgtccccccccgttcaaacacgctgaccccacctgttccctcgtttccccacaatgtcctccaagctgcccccagtttgtgcgcagtggaacacgcgtaacagttcaaacagtggctgcgccccacacatatacaacacgtgggcaatccccccgaggagcgaccccttcttctcacgacaccctagaaacagtctgtgcagtcaccaaaccgcgtaggtcggcacaaatttttcccca

SEQ ID NO: 537301 - DNA, 646 bp, Homo sapiens
gagagagggccttctcaggaagcttgaaggctctggcttaacagagaaagagactaatgtgtccaatcatgtttaaaaatcatccatgaaaaagggtcttgagttgtggacccattagcaagtgacatcgtcacatcagaactcatgaaactgatgtaaggcaattaatttgcttctgtttgtaggtctgggagggcaataaaagaggtgggtgggatgccaacaatgtctctggggggggatcgcactgaataactctgagaactatcctacctatcactctaggttttgaagcaaacgtatggacttcaactggggaggggccaataaccgttgttgtgtcctcaacaatttatctttatacaactgttgtgccacgtatccttccctctctgtaaaaactcgtcttaaggctctaaggtggtctcagatattgcaagtatcatgtaagtttgtatgagatttgccggctgaggattctgtcacacactgaaagaaaaacgtgtccatatagaccccattggaaaaagcaaaacgctctcactgaagatcagggatcccaaattcaatgggaccttatataagacaggacaattcactgctgatctgggtaccgggggacattactgtgcgtgactgccaaccc

SEQ ID NO: 537302 - DNA, 276 bp, Homo sapiens
  misc_feature (153)..(155): n is a, c, g, or t
tggacccttgcaattcaagcccttgttgttcaagggtcaactgtaataggatatagctatttttcttcctctatcaaccaaatggtaagcatctattttgtagtccactctactgagctaaattatagatccagctatgctatttataatatnnntgatgaataaatttcaattctctcttgccattcagacatctccaatactcataaacactgaggaaattgagtctggaaatatatcaccaactttgggattagtgctaagttaaataagcta

SEQ ID NO: 537303 - DNA, 139 bp, Homo sapiens
tatagggctggaagcagcacgctgtggtatcagacaaaaggatctccagaaagccgctgtacttccagcatgaccctgagacctctgtgtatggtcctgcgcaagcctggagacaaggtgtgtttgccagagaatgaga

SEQ ID NO: 537304 - DNA, 405 bp, Homo sapiens
ggggagcctttttggttggtttttggttgggtttgggttttggttttggttttaggtgtagggcccagcggggaaattttttggggctgggcccatagctcgcgccttaaaaactttaaaaattggttaaaaaaaaaaaaggggggcccctttccaaaaaaaaaaaaaaagattaaccgtttccccctgttttcaatgggggggtgagggccccgaatttttcatggttttgggggatttttgatttggaaaaggggcccaacagggtgtggggtgggggtccttcaagacaaaaacaaacccaggttgggcaaggcccttacctgttttccctctggaggtattcgatgaagtcatggacatggccgttttggagcaataaatgggcccttttttttaactgga

SEQ ID NO: 537305 - DNA, 367 bp, Homo sapiens
  misc_feature (8)..(8): n is a, c, g, or t
  misc_feature (10)..(10): n is a, c, g, or t
  misc_feature (13)..(13): n is a, c, g, or t
  misc_feature (16)..(16): n is a, c, g, or t
  misc_feature (238)..(238): n is a, c, g, or t
  misc_feature (321)..(321): n is a, c, g, or t
tcatcctnanggntcngcttctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttntcctccaaagtgctgggattacaggcatgagccactgggcgcggccagataagtttttaaggttccttcttgctttagcattnctgagaaatgtctaattgggtagtaagacaagagtaattagcaacc

SEQ ID NO: 537306 - DNA, 375 bp, Homo sapiens
gagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgtcctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgc

SEQ ID NO: 537307 - DNA, 132 bp, Homo sapiens
ttcgaggccacacgagatgggcaacaacttcgtccaccacgatttgctcaggtatggtccctcggcgttgcacacgccgagtacaccacactgtactctctcggactcagatccgtgtggacgaagttgttg

SEQ ID NO: 537308 - DNA, 243 bp, Homo sapiens
tcttttaattggttcatctggaccactgatatgcaaagggatgttgatataattggattaatagctgcctttttttgtttttactgttttctatttgttgcctttgtttctatttttgtcttccactctttttctgcctcttgtagtgttttgcctttggggtttttcttttttttattttcttttactttttttttttttttttgagacagagtctcccaggctggagtgcagtggaagaca

SEQ ID NO: 537309 - DNA, 282 bp, Homo sapiens
cgggagcagcatgtctatctgactgcgcacagacacagggaggaggggtttcaagccatctatcatgtcctgctgcatggtctgcagggagtctggtggatggccgtggagcagcggtcagacatgtttcgacccagctccttcctctatgtggcggtggcagctcatatcttataaaccttgaggagctactcggagaagggtggaagtccatctggtaatcgtccaccagtacagaaggtggccaggctacacagcacatgtagggtctggggtctgggt

SEQ ID NO: 537310 - DNA, 125 bp, Homo sapiens
  misc_feature (106)..(106): n is a, c, g, or t
gcggttcttgtgttaatttgagttcacctgtgggcagtgggcagtgggcagcgtctggattaaagggaacggatactactttttgcctcaccgtaaagtactcacntagtaaatatttccttcat

SEQ ID NO: 537311 - DNA, 148 bp, Homo sapiens
atttcagtggtctgcactcagataacagtttcttcagattagtatacaccagagtgcctatgtcagtatacctgcaatgttaagggacacaatctaccaacccacgcctcgttttcctttctcttctaaattactaaacccccccttt

SEQ ID NO: 537312 - DNA, 140 bp, Homo sapiens
tgtatctagagatccccaagattcgcgcacctaacaatggcaggtgctaaaaaacgatatggtgaaattaccgaatcaatatcgggagcgtattggatttatgaatatgctgactgatttcgacattctaggatatccag

SEQ ID NO: 537313 - DNA, 665 bp, Homo sapiens
  misc_feature (535)..(535): n is a, c, g, or t
ttacaatgaggacgagagggtaggtcctaatacaacgtgatggcagtgcttataggatggcgacatttggccacaggcgtgtgtgaagggagaacttctatgtaacgtgtagacctgcactgccgcggaggggactggaacagatccatacttaacagcctcgaatggaaccaacctgatgtcacactgatctcaaagttctgcctacagaactgtgctacacggagtgtctgtggatgcagccacccatgctgtggcaactagatatggcagccctagagaaggaattcagccgcttcaatttactggggaagccgatgtaaacgagcttcgtgagatgttcatgcaatattcgggacgcgcctgagtgtgcagtggacaggtccgtctgcaggcggaccagcatgcggcgctggcatgcacctactgagtcacccttcatgcatacagatgaggaagcagatcatatgtagctcttcatgcaccaagttacataccttagttggaatgctcgaaggctctctagatgatccgngttcaggcctgactatctgaggcattagcccgagtgggtaggtggctgaactagatctcgtctgatctagccactaacgtaactcttgggagcatttgccattctgagctgttgccagagtggctgctgc

SEQ ID NO: 537314 - DNA, 372 bp, Homo sapiens
ctcagggcgctcccaatggacagagttgtcatacatcacagcttcctcagtcagtcacctgagtacttccttcctcatgtcctggttacctgccagggcataagcatagcacatcagtgctcctggtatactcatgcagtccatggtctccctcgtgcgctgtcttacagaatgcctccaggcaactcagggcgttgcgtactgcagggtcagcggctgtcgccactcagccctttatggcattgctgagcagtgtcccagaggtcctgaatcagccatctgtcctctctgcgtgtgggagacccatatgacggcctgggaaatgtgtgctgctcctgtcccaatgcaggcttgagcttggcctccagtcag

SEQ ID NO: 537315 - DNA, 127 bp, Homo sapiens
gtccacatgtcttctccaaaaatccacccagactgatgttgtatatgcctctcaacctgcttggtttgaccaagcctgtaatcgctattggtaatctagcgggcacgggttctcacttgtcagcctg

SEQ ID NO: 537316 - DNA, 146 bp, Homo sapiens
gtacccaacaggccacccagtattgtgcatcagtgcatatgaactggacctgcccagaaggaaacagctgtaaatttgcacatggaaatgcctgaacttcatgaactgggaatgaaatgaatgatgatgcccataaatgattgaat

SEQ ID NO: 537317 - DNA, 368 bp, Homo sapiens
aaagttgtaatcatagaagatgccaatgacctatcaaaatcaacacaatgtgtacatgaaactattcgagactaataccatgcatctgtgatcaaagaactctgtggttttgaatcaggatgtagaccataagtactactactatgacctcaactatctgcatggatcataagtataagacagagttagtagttaatatgcatgttatcgtccttgcttccattcttaacagtatgtgcccatttgcaacacaaaacatgctaataatcagtaatagtcctataacagatgttaactctgtatagacattgactgatcttgctctaaccttaaacatacgagattattgtcctctgtagcatttattc

SEQ ID NO: 537318 - DNA, 197 bp, Homo sapiens
tcaggcacgaggttgggcttgtaggcgtgagtcatcagactcagtttgaaaaattttgcgattgagtccaagaacaggtctggcagagaaaatccacatttttgggttgaatgagacacggtgatactctgtacacagtacactgcccctttggcgccagagtgagactctattacagaacgtacccccaagaaaga

SEQ ID NO: 537319 - DNA, 102 bp, Homo sapiens
ttggcccttactacttacgacgacgaccacgacgacgacgtacctcacgactgacccacactacttacggaactcacgacggactgggaaccctaccacgac

SEQ ID NO: 537320 - DNA, 219 bp, Homo sapiens
gtaggacccttctccctgggataaaaaacctgcctgtaaacgctctgtaaatactcccttccccccatcccagcccctgggcaaccgggcagaagggaattcaggctatggacctcccaagtccccgctccccgctcccctcggcggcccccccctgttttgatctgtgtgtgagtgtgtgtgaacttttgaaagacaatattaaaaagacttagttga

SEQ ID NO: 537321 - DNA, 159 bp, Homo sapiens
gaccacatggcggatgacgccggtgcagtggtggtgcccgggggcccttgtggccctgtgaatggggaaccgctgtggcttccgtggtggtttcggcattggcatccggggccgggttcgccggcgttgacggtgccgtggccgctgccgcggagctcg

SEQ ID NO: 537322 - DNA, 267 bp, Homo sapiens
ggttggcacgtgttaccaggccgagtggtatgactatgtgcccgggctgttcgagcagctgtctgggaagctgagggttagcttggggacctgaactgccctggaggccccaagccatgttccccagttcagtgttgcatgtataatagatttctcctcttcctgccccccttggcatgggtgagacctgaccagtcagatggtagttgagggtgacttttcctgctgcctagcctttataattttactcactcactctgtatgggg

SEQ ID NO: 537323 - DNA, 556 bp, Homo sapiens
agaacagatcatctaaaatatgtagttttatatgctgtagtacattttaacaaaggtttcataatataaagcagaaataaacagacaaaaagaagccattaaaaaaaaaaaagaaatttatactacctgtgtggccagaaattcacaagccaagagatcaaaataaaagtattcctcagctagggatactcctggggcagcaggcagaagcaaagggcaaatttctctggcaagaaataccttcaacctagactacataggattctcacagatcaagtaccactgaagataagctcacagcccgcaattataaaacatgtgacaaaacaatctaccatgaagagtaagcagttagacatgaaattagtcctcagcaatttcagataatagagtcagctaaaagaaactacagacacatgtttaaaatgattaaagacaaaataagaaattttaaaataagaatctaccatatgaaagaatggacaggtttgagatagaatcaaatggaaattttagaaatgaaaaatacggtttctaaacacaaaaacaggtttct

SEQ ID NO: 537324 - DNA, 159 bp, Homo sapiens
cctcgctgaggtttcaccgtgttagccaggatggtctcgatctcctaacctggtgatccgcccgcctcggctcccaaagtattgggattaccgcgtgacgcaccgcgcccggctgcaaataatctttctttttttctttttttccgagactccgtctta

SEQ ID NO: 537325 - DNA, 1240 bp, Homo sapiens
gtgccctctcatggacgatatacctatgcttctacctattaaccacgcgtcacttcttggaatactaaatatatcagtgttaaacgaatgttcatatacctgcctctgagcatatgcgcgtaaacgaataggcaactatatagcatatgcgctaggacaatatagtaagctacctttcatagaagccctccaagagccagctcccctctataggccaagtcattgtgcctaattagcgcaatactggatctttgtccgccatgcgagacacttgggaggagagagccactattcctccataaagtagaatgcgtcacaatgcatacacaaacagcgctactgcgcaccttggtaactaccggtatcactgatacctagggatacgctagcgtgcacacagtgccttgcccaggtatgcattcgtctttccagtcagaagtgagtttgtaaagcataaccaatcttgaaccattgtatctcttcccctccaaagaagcgcaacccagttgcatctctctgtgaacttgaaaacagagccattacccttacacactcagcatctacgcctcccatataccctttcctagtacgccctactttacctaacacaaatcatattcgttatctccttcccctacacctcgatggactctccagcacactaccagccacttactccacaagcctctgtgtccccaagccctaaaccacagttaataccccaccccacgacaagccacgccaacttacgacaagagttctctgcaactgacactgaatatcagccttaacgacataaggcaccatcgtaaccgtacacgtaaccgcacgccatttaagcaacgcttcggacgtgccgccatatatcggccccttaaatttgggccaccttggtaattgtgcacaccttggacagaacaccaactttggaacttggctggcaaattccccatttgccaccccgtgggcgccatcccttttcatcaccaaacaccttacttgttccatacacgcgcgtcaccaggaatatcgtgccctataccacctcgtgcaatgtcaaacccatctttaccctaaggcacacttcccgaacaccgtgctgtgtccccaagtaaacaactatggaactcaatccagtttatcgggttcaccgcaggaagacgcctatcaaacgacttaacaattcacttacaccacatcacatttgggggatatatacttatgtccacgcacgcaggaa

SEQ ID NO: 537326 - DNA, 514 bp, Homo sapiens
aggcctcctacgtgactgctaccaggcttgatctcaagggaagccatgcacgacggagaagggccgagacagagcacagtttaccctatagaagcagacgaccaagatgaagtgccaccttgatattgctgaaatgagggagccagtaacaaacttgggcgaaatggcacgaaccatatcactggtcggggataaggggacctatacacatgcactcgcacatggacgttctaccacgggagctacacactaagaaattgctgagggcactagacctgcacaggagcttactgatgacacattatatgatatcaagatcgccctgcggctcgctagcggtaagataggcgcagaaaggcagaggaggctgagttcgactgacacatgcaattgggccactcaaccaatgggtaccagtctttagaaccgggggaatgtctctgccagccggaaatatcagatatataagatgctttgcactggggcacataattgcctacaggtctaaagcctg

SEQ ID NO: 537327 - DNA, 190 bp, Homo sapiens
ggacccaagacttagcttggaagagacgagacgaggcgagagagagagacgagagacgagagagacagagagagactctgagaaggagagacagcagtgacaatcctggtggttcccctgacgaggactggggctctagccaggcctggggcggagcatggggtctggacggctgtcgggctagtcgtgg

SEQ ID NO: 537328 - DNA, 114 bp, Homo sapiens
caacttggctgtgtgtgtctagagaaaagcatattacgagaaagaaacatccagacaaaggggcagtcagtgcaggtatcgagaaaaattccctgtgtgatcgtggggttgtaa

SEQ ID NO: 537329 - DNA, 1100 bp, Homo sapiens
gccacctgacgcgggccgttgagcccctgactgcaccttctcgagtgctggagacctcggtgggcccggcggctgctgcggtcggagacgtacagcgccatcgcgtggtagtgagacggtcggcggagcggtccgactgccgtgtcgtcccagcaacgggcaggcttcgttcctgctattgtaacttcgggcgagttgctcatggtgagaacgttggtgagcgacgagcggcagggtgagcagtctccggggtggtctgctagaacgacgcagtttctgggatccagtccagcgacgggacctctggtcaccgtggtatcctgtctgtaggaggaggtgctggacactgagaatcccatttgtgcagctgctgagtggggtcgtgttggctgattcgtaatggcaagcatctacagtcaaccgtacgagctcccgaccacagagtggtgacgagtacacaggagacaggttcctttacgcaaattccgtgaatgtgatatcagaacaggacggccatcggccacgaccggacttgggcagctggtgctctttcatgcagacggccaaaccggcagccgctgtggcatcaacctgtgggacactggcggagttcctgctgaaacaggacgtggtcaacgccatcaacctggatgggggtggctcgtgcagctttgtgctcaacgggaccttggcacaagatgagccgtcagatcagctgcacgagacaacatgtggcgcttgttcccgccacagtgtccaacgtgactgtgtgtgcaggaacaccagctgtccgcacgcctcaatgacacagcacacaggacccttgcctgtacagcgcactagcaatcgcccagagaaatctgcgcagcggggtcccgacgggagagtgagcctgcgacagaggaccgccttagccggacgcccgccggaaactggcacaggccaacccggataccagacacattccctcgaatgcacggagaacaagtggaagagaaacgtggccctgcgatggcaatgagccggaatgacacagactagagtgtggacgccacggaccgatatccaaccaggcacaagcactgtccaaacaagccgtc

SEQ ID NO: 537330 - DNA, 605 bp, Homo sapiens
cctggaagtgatagtgggtaattatgtatatatatttctttcagttaaggttttctaagatcattcttttacaaaagcatttttttctgctaataaaatgacaataaatgtttaaaaaagcataatgataggtttgccgtattaagtgtgcagatatattactaaacttaatgattaagtggaagtagcacagaagtagatttgtaaagactcgagaaatagatcctcactctatgaaagcttaatatgtgataaaaaggacattttatacctttatgaaaaggggtggattaatccaataaatggttggaacagttggctgttgcactttagataaaaaggcgagttgtattccctatcattcttagggaatgggagaacgtattagggcaagaatgtaaacctcagaatcgattaaagggaggaaaggtcagaatatattaactgcacggaaaatggcaaaactctcatactttgagagatagtataatatgaagagacaattcacaaaatagaaatatctatgaagagatattaaccttactagtgatcagagaaatataaaacataacttattcagattcataagtcttataacagagatg

SEQ ID NO: 537331 - DNA, 236 bp, Homo sapiens
ccacctcagcctcccaagtaactgagactacaggcacataccatcatgcctagctcacttaaatttttcgtagggacagggtctccactgtgttaccaaggctggtctcaaactcctggtctcaatccatccttccttgatttctcaaagtactgggattacaggtgtgagccactgagcctggcctaaccttattattaaagcaactccagggcatgcagagaggggcggagcag

SEQ ID NO: 537332 - DNA, 452 bp, Homo sapiens
ccgcagtgagattgacctgctcaacatccggagggaattcattgaggaatatgacaagtctctccaccaagccattgagggtgacacctccgaagacttcctgaaggccttgctggctctctgtggtggtgaggactagggccacagctttggcgggcacttctgccaagaaatggttatcagcaccagccgccatggccaagcctgattgttccagctccagagactaaggaaggggcacgggtcgtggcaagggttgggttgggctctgatcttcagtggagtttaggaaaggctcccactcccgcgggccatcgagggcccagctcggctgaccggctgaagccccgcacccatagatgctgtccccctccccttgtcacagtcctcggccctggtttgggctatgtcagatcccataacatcctgaacctctgtctgtaaaaaaaaaa

SEQ ID NO: 537333 - DNA, 830 bp, Homo sapiens
gaccgcgctctcacataaatgtggtctgtttgagagctgcaataatccacaatgactactctgatctatgtcgatgcatgataaatgtacaaccagcgcaccctcagttcgcctggtatgctaaggataggtctgaatcctgaggtctgcaccttcaacccaaatgcctcagatggggagattctccatagttttcatgcactcatcggtatcagtggctatactacctgcttgcgaatgcccgccgtcgcagccttacctaccgctactacaaaaggcttaggagaacagtcagcatagctcctgagaagtctgtaaacatcaaggtgtaaccctcttacacaataaataagtgcaagcttatgcgtgtcaaattaaatgatgaatgcagaataggactgttgccagcagaaatgctctgttcctggcctcagatgatgcctatcgcaagaattattagaaagattctttcccttgcatatcctactagtacatggagagctattggaccttgtcctgaaggagtcaccagattggtcggcaccctccccttgcagtgcgaagtgcctctcatgatcctgtgcacagcatgagagcagagcttgaaaagaactgtgtgaacttgggacccacgctttcacctgtgtactcatgtccctcttccacccatggtgaatcctctgctgaatgcagtcctcccttcaatgcgttctgtcgaacctggttgtttgaattcgccaacgtttggttgtgacatcgctctttaaattctttttgccgccaaggtcgtgagtaattgtaataaagccttttaacgcaaacgaaatcgg

SEQ ID NO: 537334 - DNA, 254 bp, Homo sapiens
ggcccgctttttttttccccaaacagaggaaaccggggtgggttagggtcccaaaaaccttcagggggccggcgagcccccggaaaagcctcagctcccgggtggggctttggcttctggagcattttttgggtgggggggggggcccagtttcccttcccccccccccgggagggttttccccccccaaggtcccccagggggccccccaagggggccgtcggggcagggggggattaaccttttttccagga

SEQ ID NO: 537335 - DNA, 123 bp, Homo sapiens
gctcagggccttggggaacgggggggactcctacacggtgccccggcctggtagcctgtaccctcagctagccgggcgcctggctgcccctgctgagcaacggcccccatgcgtggattgcca

SEQ ID NO: 537336 - DNA, 163 bp, Homo sapiens
gtgggtccatagtattactcaaggtttactgtaatgcactaaacacaatgaaaactatacaagaaccatgagagatcaattttactgtgatacacaattagctggagagataaacactcacatggtgatgactagcgtcacacaacattgaaccggatcgctt

SEQ ID NO: 537337 - DNA, 313 bp, Homo sapiens
ttatgcacaacctagggtcagttcgcaggtttaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 537338 - DNA, 577 bp, Homo sapiens
ctatatactcgatcgtaatccggaatcattgggtttaaagggtccgtaggcgggctaataagtcagggtacaaatcgttcagctcaactgagcaactgcctatgaaactgttagtcttgaatagttgtagaagtagttagactgtgtagtgtcgcggtgaaatgcttagagattacacagaacaccgatatgcgacggcatattactaacaattgattgacgctgatggacgaaagcgtggggagcgaacaggatatagataccctggtagtccacgcttgtaaacgatggatactagctgtattggacgcgagtttgagtggctaagcgaaagtaataaagtatacccatctggggagtacgttcgcaagaatgaaaactcaaaggaattgacggggtgccctgcacaagcgcatgagcatgttgtttacttcgatgatacgctaggaaccttaccaagggtttaaatggagactgacaggtgtagagactcctttttcttcggacagttatcagggtgctgcatgattctcgtcagctcgtgccgtgaagttgtccggttaaggtcctataacga

SEQ ID NO: 537339 - DNA, 513 bp, Homo sapiens
aatgtagatgatggacaccatcacaggtgggagcagagttcctggtttgacactgtcgtgatctagtgacgatcctggcggggtgtatgtttacacagggttttcccatccttgattaaattaggtccttgcaatagtcctcagaggtgggaagagcaagcattttatcccagtgtcacagaagaggaaactgaggccaaaagttgagagagattgcccatgattactggagctaaaattgggcccaagtgttctcattcccaagcgtgtattcttggttctctccaccatctcgaacacaggcgtccctgttccctgcagccctgacctgcttctcttgtctctttcttccactgtcacacaaattccagagggcaatttgagcatagccgctcttttaaatgtcatttggctctttgtggaatcctggcaggagttagtggagagcagggaggggggtcagcccagcctctaccagtgccctctcactgcctcaggagaataggacccagg

SEQ ID NO: 537340 - DNA, 380 bp, Homo sapiens
aagttcccctcaatctcaggacctcgccaacgaatcatgtgtagatcatccgggcccatatatgacgagctggcgtcggaaaaaccgacgaggtagtctacaccagtactggtctcagcacattgacgagatctccacagtggtcaccacacagtctgctgaggttggacctgctaagacgtacagtccagtcccttggagatcgacctggactccatgagaaatctgatggccatcttggtgaacagcctgtgtgtggtggtggtcccgctataccctacagatggagcagctcaacgggatcctgctgcaccttgagtcagagctggcacagacccgggcagagggacagcgccaggcccaggagtatgaggccctac

SEQ ID NO: 537341 - DNA, 700 bp, Homo sapiens
  misc_feature (451)..(451): n is a, c, g, or t
  misc_feature (456)..(456): n is a, c, g, or t
  misc_feature (461)..(461): n is a, c, g, or t
  misc_feature (466)..(466): n is a, c, g, or t
  misc_feature (546)..(546): n is a, c, g, or t
  misc_feature (561)..(561): n is a, c, g, or t
  misc_feature (575)..(576): n is a, c, g, or t
  misc_feature (581)..(581): n is a, c, g, or t
cacaccttccttcgccccgggaccaggggcatctcaaacacagtcgcccaagactcccctctgggtggcactctcaacccagctagcgctccaggagacctgccctcgtgtcgctgggggctgcagccctctcctctctgcaattcgtctctctctggatttaggaagacttccatttcaggaagggctgagattcctggaagccgcttcaggggctggagatgaggccccagagtgagggtcaccatgtgtctgtctgtcttggattgatttgcgtctgtacctgccactgtgtatctctcgcctccaacggcgtggtttacaaactgtgatgggtcctcacactggggtctggcttgaaacacgacccccacctccgctctgtacaaccccgccctatggccctggccccgtctagttgtcattacatcgcccactacaggcatcagcnccaanggccngaagnaagccgggattgagccactgctatctgaggggccctggcactccgctagactctggggaagggaaggaatgagcctagtnggatgagacaacagncccggcctcagttnnctctnctgcatatcgggacgaacgcaggacacagatgcgagtgggagtgggagtgctttgcaaaactgggaagcgccacgcacgcggcagcgctggctgtggccgttgggtcttctgtccccac

SEQ ID NO: 537342 - DNA, 429 bp, Homo sapiens
aggcagacattttacatatcaacatgaaaaaagaattggtgtaaatcaattcttttttccgtagctacttcaacctgaatcttgtatggttgttggacagcgagcaacgccgtgccgtcgcaacatgtcccatgccaccagtgatcacaacggatgacagcgctaatcgataggtcatcatggcctgatgtgtaggtgtcataccaaccatgaccagtgtgccaagttcacgcgcttgtaattggttaatgccccccataattttgatgtcaccaccgacttcaaccatatcaaaatagggtaaaagcgtgcctgggtgattcgcaaaaatcacatcgtgctgtaaaataatttgccgttgtgcctgtttcaccaagatggccataatcttgttttcatcagcccgagttgcatcaacgccgtggctaa

SEQ ID NO: 537343 - DNA, 157 bp, Homo sapiens
tagaggatcctgacagctgtcatttgatcttgagtgcacgaatctactgggactactccaaacattgacatcagatctgctttcaagagaagtggagaaggtcaagaggatgcaggagaacttgactttagtggtctcctgaaacgtagggaggtga

SEQ ID NO: 537344 - DNA, 188 bp, Homo sapiens
cctacgcagctattcaggcatacatgatgttggtagcagttcggagcccaaacaagtagggggctgccctcttctggctcatctgtgattgcacaaccgaggccacacggagattaaacactgccatctttgaaacatccctttctggtcattctcccacagcctgtctcttcatgcttacttcacat

SEQ ID NO: 537345 - DNA, 438 bp, Homo sapiens
acaatcgagctcggtaccattcgtgtctgccggtaccagcctgacagtacaggtccagcttgtgtttgttcccaactaggccctagtgtagtctggtgccagatgtgcgctcaaatcctgggcatgatgggccgagccatctcggatcccactgattgtccagccgagcgaaaaccaggctgctgcatggctactgaccggcgcttccagctatcactctgaagaccagcagggcctgctacgcgggcaagcgtgctgcctctcttctgtgtcgttttgttgccaaggcagaatgaaaagtccttaaccgtggactcttcctttatcccctcctttaccccacatatgcgatgacttttaattttcacttttgtagtttaatcctttgtattacaacatgacatatagttgcatatatagacacgaatgttcaggtga

SEQ ID NO: 537346 - DNA, 264 bp, Homo sapiens
acggtcggaactacaagcgactgtgaggcggatcgacgatggcaccgctgtcagcgactcatgaactgctgcatgagcggcgcgcatcgggaaggcgtatgcgcagcagctcactgacgtgggccggcgctggaggcagctcgtggagacagggcccgagtacgggaccgtggagaaggcctggatcgccttcatgtccgaggcagagagggtgatcgagctgcacctcgaaggtgaagcgctcactgatgaacgatgacttcg

SEQ ID NO: 537347 - DNA, 133 bp, Homo sapiens
tgagataattattcagggtttctccccacctttagtccattaataggttgaattaccttaatacaatttctaatgttgacttaactttgcattcttagaatacacccccacctggagcaaataaaaaaacata

SEQ ID NO: 537348 - DNA, 148 bp, Homo sapiens
tataactgaactcctcacactaattggaccaatctatcaccttatagaggaactaatgttagtataggtaacatgaaaacattctactagctagactgcgtccagattaaaacactgaactgacattaacagaccattatctacatca

SEQ ID NO: 537349 - DNA, 505 bp, Homo sapiens
cgttcggagggtcccggagggccacggaaacagaaatctgggtatcgactagatcagggagggatctcagttgatccagaaccaggcacccgagaaaataatggagaaaacattactagaacaatttggagatagaaatctgagtgttgatgaaaggtgtcacaacataatgaaagtagctcaagccaaactggaaatgataaaacctgaagcacagtcaaacttggaggaatcatgaggagtggcatcaggattataggaaattcagggaaacaactatgtcatctccataattgggctcagcaaacttttcaacagagaacagttatatagcattccttgctgttcctcatctgtgcttatcagacataacaacagacactctggtctaaaggcttatacagaggacatgatgaagaattgatatcacattatagcaagagcaagtttgctaaaattaaatgagcaagccgcagaactcttcgaatctggagaggacgagaag

SEQ ID NO: 537350 - DNA, 160 bp, Homo sapiens
ctccgctatatctgctgtggttagatgacgagagggactcgctggcagcagcccagcctgactgctcggagtgtactttccttgacatggcaatggctgttggccatgactcgcttgacatgctcctcctgcgcagccttcaggttctccttcttcccgc

SEQ ID NO: 537351 - DNA, 801 bp, Homo sapiens
atgacatgagagattcctctgaaatacagaagtgaagagatcatactgccgtgttccagacaggccgatgggagggcttggaccatgaggaggaggccctgtcatcgggcaggtgtgcgagaggcagaagccatgtagatgagcctcaggaatcaagcggagggctccctgacttgtgtactgtgatatcgtgaacactccttcacttcttccccaggacatgatgagctacattgggcccaagaggacagcaggtggtgcggggggataatgcaccgggaggtcttgtaacatcattggccgtcgatacgtccaggtggtccaggccgatgtctttgactgatggatgtgcttgcgtgcgtgcttctggctgacgagcttccagaggacaaggtggacgcgcgtgagaagaggcggctcgtcaagtcccgagcttgggctaggagatcgagccgttcagttgactcaagaccagacccgaaggtcccgatgagtgtctacgtgggagcatgtgaggggcctgtccggcgctctgttgcagcgtttgctgaatgcctcggtgccgttggtcaagcatcatctgggggactctcagagtacgttaacgaggcgagggtgagggtgaaatccccgaatggagtcagatatacatcagcatacaaattagagaatgcacaaggaataccccaagtgtaacacaccaggggggccggggaggacacaaggtgcgcacaggtaccgtgtacaagttaaccaaaggtgacgtgagaacaagccgggtgacaacggaagggaatggca

SEQ ID NO: 537352 - DNA, 2879 bp, Homo sapiens
gggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggtaagaattatttggataatataactttaaattcttgtttctctatgagaagttgatggtaacgtgtgtgtgtgtgtgtgtgtgtgattctcctatgtgccccccaactccaatagggagttgtatctgtaatactaaactgatcattgtgttaagccatgattgtaggattgtgctttgctgtcgggactataactcctataacctcatagagggcaattgcccaatatctattcacactttaacaagtgccttttacttttaaaagaccagctatcccactttttaacgcgatctcctaatagactattcatcatatcctttcttattagtacaccacactcaatgtaccatttgggcacacacgaatacaagaacaggccacccctgttccgataagcgagaaatgactcccaaaaaacaccactaccggttacacgggccacccgttccgtcttac

SEQ ID NO: 537353 - DNA, 85 bp, Homo sapiens
tctgactctacctatctgctgctcatgggaagaacagaattgtcctgcatgcaactaattcaataaaacttgtcttgtgagcttg

SEQ ID NO: 537354 - DNA, 1882 bp, Homo sapiens
gggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtaaagtattttatctgagtgtgtagcacctgatgacaagttaatgaaagctcttttgcaacctgtttacaattattctttttgttctttaaggtttcatcatgaatatgtttcaggctcctacacttcctgatatttctgatgacaaagatgaatggcaatctctagatcaaaatgaagatgcatttgaagcccagtttcaaagtaataactatttaaaagctactaagtgcatagcattataggtggttatcacagaaaatatcaagaattatttaagaggtgaccctgcccttgattagcttgtcacataaaggcagggaatgcatgaaataaaaataagacagttcttgacaaggtactcaatgtgtgtgatagatttgcttgattaaagggaaaataaaa

SEQ ID NO: 537355 - DNA, 1662 bp, Homo sapiens
  misc_feature (1061)..(1061): n is a, c, g, or t
gggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgagaatgcttgaagaaggagtatggggaaacttcnaggaaaaaggaatccattgaagacagatgccatgctttgagaagatgtaatgcctgattagtagtattctggacttcatggttttgtttttgttgtttgtttgtttaatatgaaaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctgggtaagctgaaggtagtcctagagatcacagtgatgtgagtggcacctgtcaccttcttacatgacctgcattatcaggaacagtatgtaaaagatgaatgatgtctgccttttatttttagataggtatgttgttgaaaaagcaagtggcaaaacattgctcccaatcctttaggcttacttattccatgcttcttttagaatatttattttatactttcgtgaa

SEQ ID NO: 537356 - DNA, 786 bp, Homo sapiens
cccattcctgcgggggaggccccaaaattagcagggcttggaggtgctgtatgcctccagtaccacctactggcgcgagctgcggtaggaggatcacctgaccctggaaggcggacagctgctcgagccatgatcacaccacgggactccatcctgggtgacttgtgtgagagctatgtctaataacagaaacaaactctcaatgggacccagcatggtggctcacgcctgtaatcgcacggcttaaactgactgggatggaagacattgcctgaagccggaagtgtgagaacagaccgagctacatggactcctaccaaacactgtttctaaaaaatagccacgtggagaggcgcatgcgctaaacactatctactcattaggctgacgcgggaggatcgtttaaggccaacaagatcacgctgcagtgcgccatgataggaccactgtactcccgcctgaacaacagagctagtggagacactgcctcttaaaaaagaaaaaaaaaaactccgagggggggccgcgacccattttgcccataaggaaggcgagaaccaatggctgggccgagagtttaaacaaggggaggggcgaaaagcctgggcgtacccaactgaataagcgttgcagacaaccccctttcacaaggggcggaatagcaacaaaggccggaaggagtggcctttccaaacagtccgatcctggtggggaaggcagattgggtgcaccatcactcgcaaaaacacggttaatctcggaaaaaaactcactttctacgcccgc

SEQ ID NO: 537357 - DNA, 733 bp, Homo sapiens
  misc_feature (379)..(379): n is a, c, g, or t
  misc_feature (398)..(398): n is a, c, g, or t
  misc_feature (403)..(403): n is a, c, g, or t
gaggacccgtcgtccatgggccggtgtgatccgtggacagaagaagggcgccgggtctgtgttccgtgcgtcacgtgaacgcaccgataaaggcagctgcgcgcctgctctccgtggattatcgatgtagacggacacgcgctacatcatacggtgcatcgctcaagggatcgatcatccacagatacctgggaccgcggtcagcagcctcccgtcggccaagagtgagtcattcctgggagtcctggtagtcagtctttaagtaatgcgcggacggatcatgcttcatgtgccgacagatggagctatatcatgagcggcgctcaggatttgatggtatatgcaggacaaggcaacgggcgcctacgcttacaagcanttgggcgacattgatgcgntcccntggtggcgtcgacgcagatgctcctgaatgggttaggcgaagacagctggtatgccttgtcacgtagggaggtgaggaacgcctgggtaggaccgcgctggacacagcggtgtgctcgctggcgtcgactctatggagtaagacgttatggcaccacacggatctgagttctcacgcgacagaaacccgtgagaacccaatgcacagacaccggtgatggagagcctggccactacccgagtcttcccaattgagaaggtatagttctcgctctatgctcaaccagaagctcgtgtgttcgcgtggttggtgcgcttggtagggttggcc

SEQ ID NO: 537358 - DNA, 374 bp, Homo sapiens
aactctcgaggatccccaacgcgctgatagcctcctgcctcagcctgccgagtgcctgcgattgcaggcgtgtgccgccacgcgtgactgtttttcgtatttttttggtggagacggggtttcgctgtgtcggcccggctggtctccagctcctaaccgcgagtgatccgccagcctcggcctcccgaggtgccgggatggcagacggagtcttgctcactcagtgctcaatcttgcccaggctggagtgcagtggtgtgatctcggctagctacaacctccacctcccagccgcctgccttagcctcccaaatagctgagactataggcacgtgccacacaaccctgggtaatttttttttttttttttttgg

SEQ ID NO: 537359 - DNA, 112 bp, Homo sapiens
gtctgagggcggccgaagtggctggctcatttaagatgaggctactgctgcttctcctagtggcggcgtctccgattggtccggagcgaggcctcggccaatcttgggcggc

SEQ ID NO: 537360 - DNA, 210 bp, Homo sapiens
gcatacggattacactgacattgccatccttacaggtactactccatcccttaaccaagcatttagcactatgcactccagcatgtaatcaccattccaaccacaaattggcacaaattctactgtgtctgggttgtagaccaattttcttaatgtgagtgcagacttccttatcaatttcctcatatctcttctggctgtacggatgga

SEQ ID NO: 537361 - DNA, 170 bp, Homo sapiens
cccccaacgaccgctccatacaccgcgcgggctcggcccacacagcgcgccgaccgcccgcccgcgcgccccctggatcccgacacgcggaggacgcgggctaactgcgacaccgacgctcgccccagggccccgcgcgctcctcccgcccaatgggcgcatggcggccg

SEQ ID NO: 537362 - DNA, 111 bp, Homo sapiens
ctcgcggggggggggggttgtgtgttttttttttttcctctcccccgcggagaaaaaaaaaaggggggggggcggggggccgcttcttctcttttttttttttataaaaaa

SEQ ID NO: 537363 - DNA, 884 bp, Homo sapiens
ccaggaacgtggtggtggtccctactttagcaaaggtagagaggaagcccggtggactgcagcttgtagcacagcctgttggcctgatacaaggagctgagccttgtgtttcaacccaaggaattggatggatatggtgactaatgaagcatgcacctcattacgtgcacagaatcttgccatttcttgtcatggacgtgctaatattatttgctaaatgaatacagtgcttgaggggcaggcaacaggcatgagtgtgcataggtattgctagcattattttatatattgaaggagagttctgcttggacaggaagaactcctattgattgtgctctttatattgatcaacttattgatattatggttttattgacgcaaaccctactgttacaaccaatatgatcgcaacatgttactctactattaactaggcttcagtatatcagggtttatttcattgtgttaaatgtatacttgcaaataaaataggtgcctacctgccccaaaagaggaaactggtctccctcttctctttggggggggtctgtggccggttccctttactgaggggtatgtcctgatccttgctcactggctgactgggttcagtcctttcaaggggggagagcgggttttccctcactcccggggggtactccgggtatacccatcggtacccggatgcccccagaaggcaacataccgcaaaacgcccgcgctagggccggttttccttaaaatgccccgcccctggccggtattccataaggttgccccccctgacgaggtggccaaaccccccggtcttttaaaagcccgggactcccccgggaagattattacccggttctttcccgaacgtcgtttagggtttcctgtcc

SEQ ID NO: 537364 - DNA, 920 bp, Homo sapiens
gaagccgcgagagcgcgacggtgggctgctgctgggcgcgcggggcgggaggggctgccgggactcgggtccccgcgtgtcccgtgtccccagcttgtcttaagcctctggcctgctgtaccccggggtggagcggcggcaattgggccgcaacccgggtggcgcttgggcccagggagcacctgttggtgcggcccggtgaaggactgagggaccggcttggagaaaaacctccgggaggggacccggaaaatggccgaggaaagccctcttggtgtgggataaaagaaaacgcgggcagcggcgcggggaaccaaaggggaggaagcctggcaaggagagcatgggggggcagaatgggatgggaacgggaccccctgaaggttggcagcgcccaaggcgcttggggaagaaacgggcccgaaaagtgtgctgggcaagcctgaaacgagtcgagccaggagcggcagtcccacacaggtggttggctacctctggcgggagaccccggggacgagcaccccaaaggcgagcagagagccagtctgttgagcgggcgcgaaaaggcggaaggcggaaagtcacaacgcgacaggcgccgcgggccacaaccatccaccaggcgggccaagtgccacggagtgggtgacaccaccatgttgcggtgcggccccacggcgtggcagaggggcactgacgagaacggacaagcgcggcgcaacgaggagaggaccttcccggtgaacaccagcgggggacgagagagcccagcggccagggatgtgcagaggaggggcgacagacgctaacagaagaggcacatcggcggggggggacaaaaacgccccgagaggggggggaccaccaccgagagagcccgcgagcaacggagaggcgatgccccgtcgaggggcagactc

SEQ ID NO: 537365 - DNA, 489 bp, Homo sapiens
actccttaccccactattagctactggttgggaaatgaacaaacacatgctagctgatttagctgcattcggtttgttctttaactgactatactcttacttggtgatatgtccattgaaactgtaccacttttaaatgggtcactgaggggaggggaccgcttggtttcgcattgtcttacattggaaaacaccttgcggcgggcgcagtttgagtccttgctgtccctccctgggcgtggactctggttctgatctcccctgctttgttttcctactctctctcgtgcagagacagggcagggcattgttcatgcactgaccgacctcagcagccccggcatgacctcagggaacggaaactctgcctccagcatcgccggcactgccccccagaatggtgagaataaaccaccacaggccatttgtgaaacccaaatcctgacgcatgttatcgaagggtttgtgatccaggagggggcggagctt

SEQ ID NO: 537366 - DNA, 313 bp, Homo sapiens
  misc_feature (11)..(11): n is a, c, g, or t
  misc_feature (82)..(82): n is a, c, g, or t
  misc_feature (105)..(105): n is a, c, g, or t
  misc_feature (120)..(120): n is a, c, g, or t
  misc_feature (191)..(191): n is a, c, g, or t
  misc_feature (220)..(220): n is a, c, g, or t
  misc_feature (226)..(226): n is a, c, g, or t
  misc_feature (243)..(243): n is a, c, g, or t
  misc_feature (255)..(255): n is a, c, g, or t
  misc_feature (261)..(261): n is a, c, g, or t
  misc_feature (269)..(269): n is a, c, g, or t
  misc_feature (285)..(285): n is a, c, g, or t
  misc_feature (288)..(288): n is a, c, g, or t
  misc_feature (299)..(299): n is a, c, g, or t
  misc_feature (305)..(305): n is a, c, g, or t
  misc_feature (311)..(311): n is a, c, g, or t
agccaccatgnacgtctttgtgttttggtgttttttttgttttgttttgtttgtttttaagagacaggatcggccaggcgtnagcacccgtgcccagcctctttnttctttttgagacanagtctcactctgtcacccactgcactccagcctgggcaacaaaatgagactccatctcaaaaaaaaaaaanaaaaaaaaaaaaaagaaagttaggaaatntatctnggggagggctggtaagnagcagaatgagntttgancccagggntgtttaaagccatatnctncatcactatgntatgcngaaatngg

SEQ ID NO: 537367 - DNA, 179 bp, Homo sapiens
attttgcctgtaatggtgatcctaatggctatcagaagggtacattgtggctccatgccgccttgccccgaggctcgcgcgatcatgaggatctgtcgctgatcatccacagctctcgatttgatcgactcgtcgtgcgcttcatctatcgtgacggtgccgtcgagcagcaacatgtc

SEQ ID NO: 537368 - DNA, 224 bp, Homo sapiens
  misc_feature (130)..(130): n is a, c, g, or t
gaggaggggaattccttcctgaggatttcagagatggagagtatgaagctggctgttacttttagagaagcaggaggatcttgacagacactttctatgcccacctctgtggacccttgggtggagcaancagtgtgaaacagcgatgaaacaacgacgaggcagagcttcaaaacagaaaaaactagaacaacagatcaaacgcttgaaaactttagacaggg

SEQ ID NO: 537369 - DNA, 185 bp, Homo sapiens
gttctctgctgtacgtggtaattaaaactacatgttttacaacgttaaagtaaagggtgccccgaataacaactaggttctttaaagttagtgtttcgggggaagcatgggggcttctttgtagcactcctttgaaaactatttccgagaaagctccaatacaaacacctttttcttcctaagga

SEQ ID NO: 537370 - DNA, 347 bp, Homo sapiens
ggagagccccggccggcttgccagagagatcccgcgcgggagagagcgcccagtgtgtacactgagagttcacacccaagtgacgcggcgcgcctgtgcatacagacgcgtctctcgttttacgcactacacgtctggacgcacgtctctcacagagttcaacgggagagagtgcgctctcgtagagagagagcagcgtctacgctatatcccccgtgttgtcccccgtctctctgggccccctcacagaccccctcgctctatgctctgcagcgtctgggagaggggtgagatcccagaattgaaagagggcagagaaaggggatatttttttgacagacaatctg

SEQ ID NO: 537371 - DNA, 191 bp, Homo sapiens
cccccccccccagaaggggaaaaggggggggggggggcccctctttgggggggggtccctcccaaaataattcccccccaaaaagggatttcccctccttaatgtttttttttaaccccctttagggggggggggggttggggggcccccccttttttttttccataaaaaaagtcccctggggtcaccca

SEQ ID NO: 537372 - DNA, 118 bp, Homo sapiens
tctagaggatcccacattgacgtcccgagagagatggactgtgggggctcgtccccaagcagcagggctgtgcgtccgagtctgtgtctgctatcagcgcttgccaagctccgtgctg

SEQ ID NO: 537373 - DNA, 473 bp, Homo sapiens
cgcgcaataggcgtgtgaggatcagttatatatagtgggattttttacagtcgatgggtgttcgagcttgacacgctttctttattagatggctgcttctacagcctactataggtgttaaattttttactctctctacaaggttcacacctagtgtccaaagatctgttcctctttggactaaccgcttaatttacgacgtgatttagagctgttctgtgttcaattttcatcaagaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatatttggcccttatgag

SEQ ID NO: 537374 - DNA, 177 bp, Homo sapiens
ataaatgaacctggaaaactatgctactgaaagaagacagtcacaaaatgaccacaacattgtattgattccattttattacaacaatatctaagatacagcaaactctttagatgacatgatacatattttaaacggctcccctcagggctgggagtctggggacaggctgggagg

SEQ ID NO: 537375 - DNA, 121 bp, Homo sapiens
tatatcagctcggccctgattccccagttgcgatctgtgcttctaataagcgaatacgggcccttttcgatgagtcccttattcatggcttggaacaaagagatgatgtttcctgtttcag

SEQ ID NO: 537376 - DNA, 776 bp, Homo sapiens
taaaaggaaaacccggtaatgatggtcggggttgagggataggaggaaaaggggggataggttgtttgaactatgagggtgtttcctcgtgtgaatgagggtttaattgttgtgttaagtggtgggtgggtgtgagtgtgacccccaattgtggtgttggggtggctaaatctattgttagaagggaagtaataggcgcgtggtgacctagctagtgttgtgagtctccgtgctaagtatagagagaggtgcatattgtgactcaggaagaaacggtggtttaacatagaccacacagagagagagttctctctcccagttaggtgtataaatacgcgtggcgcggcgtataaaggggcgcaggttatagcgcgagagagcctgttgcatagaaaagtctcatctcacaaaaagccatatttataggtggggaagtataagaagttgtgtgaaaagtctccctttgtgagagaaggacggcaccttaagtgaacgtgcgcagcaccgtggtgggaagtgtgcgccgttcgcgcataagttgtgtagcacgttttgggctcataggcgcaagcaaatttagttaaagtgacgagggcattgtatatagcgccccgggtgtggcgcagaaattatgtgtgacaaacagtgtcacgtggcgccccgggtagaaaagccttctgagggggggggcgttggggccagtgaacacaagtggggcgtgtgttcacataacgagaggggccctagtggtgggcgtgaatggcaacaagaatagt

SEQ ID NO: 537377 - DNA, 142 bp, Homo sapiens
gctaattgtgggttgaccgtgtgcttgctcaatgtgttgcccagaaggcagaggtgatcatgaactacccatgtctggggagacggtgctgtccttgctgacagaccacgctgatacctgtgaggctcagacagtcacttgt

SEQ ID NO: 537378 - DNA, 184 bp, Homo sapiens
attttttttttttgggtagagatggagttaaccatgtaagccaggttggtctctaactcatgggctcaagtgatctacctgcctcggcctcccaaagtgctaaaataacaagcgtaagccaccacacccagcctgtccacttttaaaattcctttttcctaaatttaatttttaataatcattt

SEQ ID NO: 537379 - DNA, 440 bp, Homo sapiens
cggcctggacgaccgctaccggggcgtgcgcggccaacgtgaggtgctgttcgccaacgaagccgacatcatccgcctaggcttccagccagggcagaaagtcgacatcgtttcgctgtggggagatgagcatgtgcgccgggtgcaaggctttaccttgctgcctttcgacatcccggccgggcaggcggcggcgtattaccccgaggtgaacccgctggtgccgctggagagcattggcgatggcagccacacaccgacatcgaagttcatcgcgatcaaactggagcgcgcgcgggacgacgggcgcatcctgtaaaaacgaaaaaagccctgttccgttggggttcagggctttgtcataaaggtctcagacagccgaaaatcgataaagtttcacagcaaatacagtaacttagagaattgtgtacaactcgtgt

SEQ ID NO: 537380 - DNA, 1501 bp, Homo sapiens
  misc_feature (1090)..(1090): n is a, c, g, or t
  misc_feature (1501)..(1501): n is a, c, g, or t
ttcttttgcgtcgccagccgatccacatcgcgtcagacgcgggtggcggcatatggtgacatggtcggagtcagcggcattatggtcgtagtatgggctgccctgggtcaccagggtctgcttgttaaactgtggtgaaagatggatacttgttgccatcaatgaccccttcagttgacctcaactacgatggttgacatgttccggtatgattgccataccatgggcaaattccagtggtcgaccggtcaaggtcgtgacgaacgggagagcgttgtcagtcaatcggaagatcccatcactcactcgttccaggatgctgagatcgcctccagaagatcaagatggggcgagtgctggcgctgatgtagcgtcgtggagtccagtggctgtcttcgatcgaccagtggcagaaggctggcggctcatttgccagggtgggagcctagaaagggtcgatcatctgctgtcccctctgctagattgtcgccctatgtatcgtcgatgcggtgttgaaccgatgatgaagtattgagcaaaaggctcaagactcgtccaggaatggctacctgtgagccaacaattgcttaggcacccctgtggccaaggttcatccaatggaccactttggcgtattcgtgcgacaggacttcattgacacgagtccagatgccttcacatgtcaaccctaaaagaagtgttggttgggccccttccggggaaaactgtgggggtgaaaaagggccgccgggggtctcccaaggaaaagttttctccctgggtgctacacgggggcacggcacaaggtctgaggggggaccagggggcaaacctcggaagatacggaacgggggaaagacacccaatgggcgatagtgcactaccacgtgggaccccccaggggcgccacttcgcaacaatgtggggcaccacgaagaccgcggttttaagaaaaacacgcgcgcgcttattatatgagactcacaccatcaatggtgaagacgtacataatagaacagaccacaggagagtctaatacagacaaagaacaacgaggatattaatcataataagaaagacgagctacctncccaggcagggaggggagggacggccacaacacgactcgatctcagtgataagcgcacagaagaaacgagggagatcgctgcagtcagacgtaaggcagcccactcaggcaatcgagatgcgggatgcctcctccttctcgtgtcgtttcagtgggggctcagccgtgctgtaagaggcgctagcgagcgcagatacaactaaggcaaacagagaaaagacagctacgtaggactgagctgacacgtgagcagcatgagcaacagaatacggcctacacagaagagacagtagcacgactgcaagtaggcgcacgactagccaatgacagtgacgagtgagtaccagcacagaaagacgtggaggacgactgcgaaacaaaacgcagcaaaggacgtacacgcagcacgan

SEQ ID NO: 537381 - DNA, 866 bp, Homo sapiens
  misc_feature (194)..(194): n is a, c, g, or t
  misc_feature (201)..(201): n is a, c, g, or t
  misc_feature (675)..(675): n is a, c, g, or t
gggtcccagtgccccccgagtgggctctcccaggcccgagacctttcccgtcggcgttttacgccccctccctcctttttcgcctctttagggccctgtgccagaaaccgggtccgctaacttggccctcgggttctttttgccccccccctttttgtggtgttcttcatgccctccccgccctagacagcctngagaggncggcgatgaagaagataaagaaaatcaaggagagtgagacccaaggtcagcagaccacctcaacgtcggtaccgccgcgaacttcaagttaccgagcgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatcctaacaagaagaaatatgaaattccagcaataagaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttntaaattgtttcatatctggtcaagttgagatttttaagaacttcatttttaatttgtaataaaagtttacaacttgattttttcaaaaaagtcaacaaactgcaagcacctgttaataaaggtcttaaataatagtcttgtgtacaacgaaaaaaaagaaaacacagaaaaaagacacgcaaaagccaaag

SEQ ID NO: 537382 - DNA, 950 bp, Homo sapiens
  misc_feature (194)..(194): n is a, c, g, or t
  misc_feature (201)..(201): n is a, c, g, or t
  misc_feature (675)..(675): n is a, c, g, or t
  misc_feature (761)..(761): n is a, c, g, or t
gggtcccagtgccccccgagtgggctctcccaggcccgagacctttcccgtcggcgttttacgccccctccctcctttttcgcctctttagggccctgtgccagaaaccgggtccgctaacttggccctcgggttctttttgccccccccctttttgtggtgttcttcatgccctccccgccctagacagcctngagaggncggcgatgaagaagataaagaaaatcaaggagagtgagacccaaggtcagcagaccacctcaacgtcggtaccgccgcgaacttcaagttaccgagcgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatcctaacaagaagaaatatgaaattccagcaataagaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttntaaattgtttcatatctggtcaagttggggggggggcccgggggggaaaaaggggggcaaaaaaaaattttttttttgtttttttngttgaagaaggagagagccttccacagatttttaagaacttcatttttaatttgtaataaaagtttacaacttgattttttcaaaaaagtcaacaaactgcaagcacctgttaataaaggtcttaaataatagtcttgtgtacaacgaaaaaaaagaaaacacagaaaaaagacacgcaaaagccaaag

SEQ ID NO: 537383 - DNA, 117 bp, Homo sapiens
gcgtggcctggctgtatttcactcgccaggtgcttattaggccgtgctccaagtcatcgtccggtttctcactgtgatgatgaagcatggttacattggcgagtgaaattacggcca

SEQ ID NO: 537384 - DNA, 173 bp, Homo sapiens
ccgagagccgctagaggccacctactcatgcacctaagatggaagcgccaccctattaatatcaaccattaaccttccctctacactgatcacctgcacaatgctaatgctactgacgatccgaagcagcgctggcgcattaatccaagcgtacgtattcacacttctagtac

SEQ ID NO: 537385 - DNA, 820 bp, Homo sapiens
  misc_feature (194)..(194): n is a, c, g, or t
  misc_feature (201)..(201): n is a, c, g, or t
  misc_feature (675)..(675): n is a, c, g, or t
gggtcccagtgccccccgagtgggctctcccaggcccgagacctttcccgtcggcgttttacgccccctccctcctttttcgcctctttagggccctgtgccagaaaccgggtccgctaacttggccctcgggttctttttgccccccccctttttgtggtgttcttcatgccctccccgccctagacagcctngagaggncggcgatgaagaagataaagaaaatcaaggagagtgagacccaaggtcagcagaccacctcaacgtcggtaccgccgcgaacttcaagttaccgagcgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatcctaacaagaagaaatatgaaattccagcaataagaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttntaaattgtttcatatctggtcaagttgagatgcttaagagcttcagtcatgataagtaattaaagtttgcagcttgagttttcagtgaaagtcgaccgagcccctgcacctgataatgggcgtcataaataattgtctgtgtgta

SEQ ID NO: 537386 - DNA, 242 bp, Homo sapiens
tgttgtggacgagctacgctatcggcgccgaccccttgcgagcacttgggcaggtgcgttgaacacgctgggctccttcctggtgccagctgcggtcgtggctgggatgcaccctcgcgtgtgtgaccgtatgtcgatcgaggtgctcttgtcggcggcccctggccgaagatccaggcccacaggtgccctttcgaaccccgcgatacgtgtgccagtatcaccctgctgatctagctact

SEQ ID NO: 537387 - DNA, 234 bp, Homo sapiens
aaaaggggggataaaaaagggggggaaaacccccaaagggaaaaaaaacggccaaaataaaggggggaaacccaaaatagttaaaaaaggggggggggccccccccccaataagttgggggttgatgggaaaaggaggggggttttaaagaattaatttgggccttaaaccccaaatttaaaattggtttttttaaatgggactcagggggaggaaaattccccctttttttta

SEQ ID NO: 537388 - DNA, 272 bp, Homo sapiens
tttccccaaaattaaattttgtttttcccctaaaatggtgatacaagttgaagacccctccctctgaaattggaagacccccccccttaaggctccccagtggcttactcagctgaactctaggttactactctttacttttttcccccattggggggggcagtttttttaaaatgttggggggtggcccttctaactactgttgaatgtctcttttttggggaggtttaacaagaaataaaaaagaatttttttgaagggggggactggta

SEQ ID NO: 537389 - DNA, 109 bp, Homo sapiens
agggttaactttttttttattggggggtttgattttttcccccaaaaatgggttttttttgagggacccaagttttaggtttcccaaaaaaaaaaaaaattttccctta

SEQ ID NO: 537390 - DNA, 522 bp, Homo sapiens
aacacgttccaccaccaggaccccggtgtgagaaaaacaccccgcccacccgcgtctttttggaaactctaacatggtcgtacacgcgccttattcggagttttctcttggggtctttctctcgtgaaatcttacatgttgtcgtgtgtgcgtgtgtgggagacacgcgtgagtcccccgcgcgtgtgtaactcacaccgcgcccgcgctggggggggagtgccacccacacaggcgcgcgaatcccctcgccacacataatatctcggcacccgggaaccagagcgcgcggggatcccccccacaaaaacccacgagagcggcggggggtctcacccactatggattttggggacgatttttgtgggttattgtgggccctctttatcctaggggcctcccctccatctctctctacagaaactttccacccttttgtggcaactccctctagtaaaacacccaggtgcggcgtgcgcacaacaaataacaaaacaaaatatacaagaacaataaaaaaaa

SEQ ID NO: 537391 - DNA, 619 bp, Homo sapiens
caggaaggagctatttcagcaaagtgacaggaacagaagcttcataaagccaaggaattgacagtggtgaccttactagttgggctgccgttatcagaatgcaacttattgcagttaacttgagcctggttgagtggatttatattatctgcatttaattacattaatcttcacaaaatgaacaagtggcttagagatttgctcaaagaaatagtagattagagataactgtaacactgcaaacaataacaagaaggtagaactgacatttctcctcctggtgggagctctttgtcacatttcaaggtaattacatctgtcaaggagtcagcctaaaaaatgaaattgtcaagaagactatttgaaatatggatatatatacacattatcatcgataatgaatttcaccttaagaatgtattgtactttgagtcatatagtagctaatgatataatgacttcatctgggttatgtttatatcttatatattttgctgtatctcagtctttcttgggttctgtatttcatatatgggttatagtatatatgcgttaataaatattcatagagtgagggacatatactcacatttttactgatgtacatgtgctctgaaaa

SEQ ID NO: 537392 - DNA, 148 bp, Homo sapiens
tgtgtgtgtgtgtgtgtgtgtgtgtgtgtgtgtgtgtgtgtgtgtgtgtgtgtgtgtgtgtgtgtgtgtgtgtatgtgagtgtatatgtgtgtatgtgtatatgtgattcaccagagcttgcaaacagcatattatagagctcttcag

SEQ ID NO: 537393 - DNA, 662 bp, Homo sapiens
  misc_feature (577)..(577): n is a, c, g, or t
tgctgaggccctcacctgtgatcttagcacttagggtggccaaggcgggcagatcgcttgagctgaggagtatgagatcagtctgggcagcattgtgaaaccccgtctctgcaaaaaatacaaacattagccaggtgtggtggagggtgcctatagtcctagctacccaagaggctgaggtggtaggatggcttgagcccggaaggtggaggttgcagtaggctgagattgcgccattgcactaagcctggatgacagagtcagaccctgtctcaaggaataaatagatacgagaaaagcttaatggcttgtgtatattcactcttgtgcgtgtcacttatttacactgtgaagccaagtctccaactctccaactgtcacccaggctggagtgcaatggtgcgatcatggcttgctacagcctccaccttccgggttccagtgattctcctgcctcagtgtcccgagtagctgggattacaggcacacgccaccccatcgctcctaggagacagaggttgcagtgagccaagatcgcaccactgcactccagagcgagactgtcacaaaaaaaganattttacaattatgcatgcggccggaattcgggctacttggccattcgccctatagggagtcgattacaaatcatggccgagttt

SEQ ID NO: 537394 - DNA, 920 bp, Homo sapiens
  misc_feature (36)..(36): n is a, c, g, or t
  misc_feature (66)..(66): n is a, c, g, or t
  misc_feature (97)..(97): n is a, c, g, or t
  misc_feature (101)..(101): n is a, c, g, or t
  misc_feature (106)..(106): n is a, c, g, or t
  misc_feature (127)..(127): n is a, c, g, or t
  misc_feature (142)..(142): n is a, c, g, or t
  misc_feature (197)..(197): n is a, c, g, or t
  misc_feature (212)..(212): n is a, c, g, or t
  misc_feature (254)..(254): n is a, c, g, or t
  misc_feature (276)..(276): n is a, c, g, or t
  misc_feature (310)..(310): n is a, c, g, or t
  misc_feature (332)..(332): n is a, c, g, or t
  misc_feature (353)..(353): n is a, c, g, or t
  misc_feature (671)..(671): n is a, c, g, or t
  misc_feature (795)..(795): n is a, c, g, or t
  misc_feature (846)..(846): n is a, c, g, or t
  misc_feature (848)..(848): n is a, c, g, or t
  misc_feature (894)..(894): n is a, c, g, or t
ggggggggcagttattgaacaagaaggagttccacntttacaaatggacaaaaaatgttgtaatgnttttcaaggaccaattgaacaattcaaagtngttnttcanttttcttttgaccaccaacanttgcgtgtaatgaanagggcgagttaaggacgcaaaaggtacggaggaagtaccttgcgctttacgcacntgattgaaaacaaantaaaaaaaggaggaacaaatcaaaaatggttggattgccgantaagaggaaaggcgagagggcnacaaaaaagggaaggccgtaggggaccaaaaaangatatttcaaggagttcctaantcacaaaagtacacttcaggncatggaaaaagatttcagtaccaaaaggcgacctcagtctcacatccacacattcaaaaataattaaaattttacatgaaaagttggaaacacaaaatgaactagaaaaacaatatataaattaggacaaacactgctttgcaatgggaggacctttgtaaatctgacagtgaaagtgaagaaggagtttactagggatctgtttgacattacagaagcattcatattcatacaccataaaacctcatatacaacattataagacaaacaacagatttgggggaaaaacactccaccatctgtgaaagactgtatgtnaatagtcaaaaagacttaatcagaaaatgatagcacccaacagaagaaagaccttaatgggcttggccagttaaaaaataccaatcgatgcctaagatacctataaaaatatgtgcaaactggntaactaaaataatgcaaattaaagcaatttaatgccattatttttcctgtntntgaaaggcaaagatttaaaagaaccataatccctggtgcagggccnaggcatagatcagcagcccctcatct

SEQ ID NO: 537395 - DNA, 392 bp, Homo sapiens
agacccagacatcttcaatatgtggacgagacaactacatagcagaccagactataaaagaatctcaaaatcacacggacacagctactcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggacaaaggccctcccaatgaacccctaaacccctcacataacatactccc

SEQ ID NO: 537396 - DNA, 177 bp, Homo sapiens
tctatttgcagtagatcgtagcttctcttagaagccatcttatccgctgacctgtgtgagattttttcccacaataatagctatgataaagaaatcagtgtactacatgttcttagctctcacaatttagcctaaatatttgccctggcatgcttatagtggtccaagaaagcatta

SEQ ID NO: 537397 - DNA, 201 bp, Homo sapiens
atgatgtaactgttttgttcaagtctttatgggtcaaggttgagggctcgttgagaagagggctcagaaaagcctggctagtttggctgggtagagaatctttgtcaggagtgttgagtctggctagtagtgtctccttttataaggacttggcttattcatcactgttgaacatactcctaaacccttgtactcttcaca

SEQ ID NO: 537398 - DNA, 297 bp, Homo sapiens
ctctacaggagctatgtgcatagtgtactattcacaatagtaagactggaccaacccaaatgtccatcaatgatagactggattaagaaaatgcagcacatatacaccatggaatactaagcagccataaaaaatgatgtgttcatttcctttgcagggacatggatgaagctggaaaccatcattcccagcaaactatcgcaaggacaaaaaaccaaacaccacatgttctcactcataggtgggagctaaatggtgagaacacaatggcacgtggatccacaatggcacgtggat

SEQ ID NO: 537399 - DNA, 137 bp, Homo sapiens
cctttactaccagacaacctttagccaaaccattttacccaaattaaagtattaggccgattagaaatttgaaaccttggcggcaattaggattattagttaccttcttgcattaattgaatttaacttaggaatta

SEQ ID NO: 537400 - DNA, 223 bp, Homo sapiens
acagtcaccaggatgattaaatttaaatcccaataacaaggctgatttcagatgtctcaccccaaagaaggaggataagggagcgaggtgatggatatgttaattagcttgatttaatccttccacattgtatacatgtatcagaacatcacattggactccatcaatataatacaattattatttgtcaatcaaatattaataaaatcaaagatgagcagga

SEQ ID NO: 537401 - DNA, 785 bp, Homo sapiens
gtatcgaaaacggggaaggaaggcaggaaggaggcggaataaataaagaataaaaatagagaagtaagacagaataagatagagtacattttaagagcatgtcaagatggataatacaagtgaagatttaccagtaagaaagtatcatatcgtaagccaagatatgcaaaaggagtgcattcagtaagctgtaagcgtctgagaaatgtaactgtgaaagtcaggctcaccagttcaagtcactaggttagccacttggaccggtcttggtttcagcgagcatagcgagtggctgtaagaaagtgtccatgccagccaatatccacgtgcgtacttgcccaggtagtgatcagtgagagtgagaagcaatgttttctctaagccgatgaggcagaagaaaagttaagcagtatttgaagagcagcgattttctctcttaacgttcctgggagactccaacaaatggagaccagaaacaaggcaaccacgaccttgctaggttctctgaggaggggactttctatgtacacgtcccaccttcttcgaggacatgaccaagggacaggatcatacagatgaggtgaggggattcgttagcagcgataaacattctcagagcctggagagaaaccgtctgctagcgtagctgggtcccgaaagatggcaacattgggctgctacagaaaggatagaaccgttacaggggggagggtggcgacgggagcatcttataggtgcccagaagcagctcatgtatgctccggacgtgggctaacagaacaaga

SEQ ID NO: 537402 - DNA, 533 bp, Homo sapiens
gagaggtagtatgataccgaagtagtgaagataatgatttggagagtgagctatcagtgagagagaacaagacattctgcaggttatatgtaggaaacagcacagaagactaggaggtataacctctggaaaaattttcttccactcttctatttttacttctctactcttccctattcctatattattccctagcattccctttttctcatcctagcttttcctctccaccgtgctgcgctatttcagtatctttctatgcagaacgttactttttgttgtattatgcaactacagtgtaatctttttgaatactttaattagtaatttaaactcaacatagtcttagcaacagtgcacgttacttagctggcatgaccatagtctgagcggtgtggccagtgtgaagcatgagtgtgcagtgagcaccgcatcacagcagccacttgccggcagcagctgtaaggttgtatctaagccgtgtcttgattttagctatggtcaaatgagaattcatgaatgtttaaatttct

SEQ ID NO: 537403 - DNA, 1322 bp, Homo sapiens
aatcgcaatggcattccgtaagtgcttacctgaatgacaaaattctagtgctatatacaactacttcaaaggccccaacgttgtaggcccctacgtgctactacaatccttcgcatgacgccataaaactcttcaccaaagagcccctaaaacccgatcacatctactcatcactccatctacatcgaccgcacccgaccttagcgtcatgaccgatcgactcattcatactatgaagcaccccgctcccgcgatagcgccgacatctcccttggcttccggaactagaaactgaggcccttgctcataatacttctagaccgaacggctaatgcgatgacaccgactgaaggcagaagcatctgacatcacgagctgacactaatctaaagaaaaacagtgaaagccaccctggactcggcacgcacagtggctacagacaggacatgcccaaccagggactccgtcgctcatccgcagtttggagcccaaagtgcactacgaccttgcctcatctactgcaacatgttgcgacagtaaagatagaccgacccattgaaacgtcattcaccctggctctaaaatggcaaacaaacaaacagcaatcgacacatcctcacgataacaccactaatacatgaactcacctcaagccgatcgagccgcaacacttatggcaataaatcacagtccaaaacctaagacagcaagacaaccagccacagacacaaccgtacaaagctctggaccgaaagggcaacgaaccggaaaaacaagatacacacgggacagcaacacaaaccaaggaaacagccagcacgggacgccagaacaagaccacaaacaacatcacagtagaaccgacacgccacacacaaacaatacacgcaggacacaaaaagagacagaacccaagaagaaagagcgcacaaggcaacaaagaatgaaaccaacccagactgggaggactaaacgcaaccaaggaggccgaccaagaggccacgaaggaggaacacggggaagagagacagaccaagaggcaacacacaaacagagccacacgacaaaacacgaccagcagaatacacaaacaaacagcaacagaaaagagtagccagcacgtaaaccccagatagcacacgccagcccaaccacgccaggaagccaaacaaagcagacggagacagcaacccaggcacccaccccacgaaagaacagagacaactaacggaaagcgcaacgccggcgcagcgccaacacagacagcacaccacacacagagcccagcgcccgaagccaaagaaaaaaaggaagaacggaga

SEQ ID NO: 537404 - DNA, 517 bp, Homo sapiens
ccgggcaagagagaggcatgtctctcactataaatcaaaagctagatatgattaagcatagtgaggaagacatattgagggcggattaaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatatgctcttaagcgaaaacctaatccagagctaggtcttaactctctgcaattctatgaagggcaagaaagttgaggaaactgtagaagaaagtttgaagctagcagaggttggtttataaaggttaaggaaagaagccatttctataacatacaagttcaggtgaagcaaaaagtgcagatgtagaagctgcagcaagttatccagaagatctagctaagattatggatgaaggtggctacactaaaca

SEQ ID NO: 537405 - DNA, 211 bp, Homo sapiens
acatgatacaacttcgagcttggtacctgaacattcgtgtccagagccttagactttgagaggactctatcctccttcagtttctggggttacatgagggaaacaggggtttttcctagaatggggtctgtgacgcctcctctgtttttccccaggagtcccaggctgttagtaattatcttaggttctctcatgtggacacgaatgttca

SEQ ID NO: 537406 - DNA, 530 bp, Homo sapiens
cacaccacctgagtcatattcatattacgaagagacatgctggagtcctgggggaggcgctatccatgcggccatgagacgaggtgtgcccgccttatcggccatgcgactaaagtcttaagggggcgcgcgcttttgtcgcatcggaccaggggttgggtgagttcaggaaccagatcgggtaaatgcagtcactaaggctcgaaagtgcggcccggccttgcatcatcggtctgcgcggccagggataaccctggcatccgaggtgaattttctttatcgtcaccgccctttttaaaagcccgagaaatcaaaatgttagaagcatccctcagccaattggaacaactggtcagcgacctcgtacagcagaatcaagaattgctgggcagcaacgaatccctcaaggccgagctggcccgcgccaaggacgaaaacgacagcctgcaactgaacctgatggaacaggaagaaaagcacggcgccaccgccgcccgcatccaggcgctgggactcaggtggtgtggggg

SEQ ID NO: 537407 - DNA, 646 bp, Homo sapiens
gcaggtccgtaggcatgcattgtgcccagcggaatggcattgtcttgaatgccccacttccacaatggactggcagcggcgctgtggccacgtggttcaaccagccggccgtaagatccgcagacgtaaggcccggaagccaaggcgcgcctgatcgccccgtgcccgcgtcgggtcccatcctggcccatcgtgcgctgccccacggttcgggtaccacacgaagtgtgcgcgccggccgctggcttcagcctggaggagctcagggtggccggcattcacaagaaggtggcccggaccatcggcatttcttgtggatcctgatggatgtgcggaacaagtccactgggatggtccctgcatggccaactgtgcatgctggcttgaatggaggtaccggatccgaaactcattcctcttcgcccagtgaattgccctccgtggccccaatgaaagggagcacatgttcctgcttgaatgagacctgagaacttgtgccaatcctcagtcttgacccgggacccgggtcatttgccccggtccgggaaacggtcgtagtagaggacacggaggacaagggctcgagttcagtcactgtgatgcgacacgcacgaacggaaattttccgaagagcgcctttcgcctt

SEQ ID NO: 537408 - DNA, 208 bp, Homo sapiens
ctacctacagccactttgccagagaagagcgatgattcatgctgaatcatgcctctagcttatttgttcggtcataacagagatcctgccagctgttggaatgaaagtagcgcttctctttagagagtgacaagcctgaggcaagggacacagcgcgatgagagatcccactcagaagcggagatgctccttggagtctgacacactc

SEQ ID NO: 537409 - DNA, 385 bp, Homo sapiens
agacctgatgatccgtcctcctatagcctcccacatcctctctttacacacagtagataactcagaaatatttagtaaaagcaagagatctatcaatttacattttggctctagtcataaacagaggcaaagaagttaggacagtaaagtagagtgctaagagctcttaacgcccctccccttcttacccaagctataccaacttcctagcccttttatacaactcctagaatagttaaagagaggacacatctaaaataggaataagaggtgccccctaaagcaggaaaaagtgaagaaaaggctagaggcatgggccagggcacacattgagcctaaacgtgaaagactgtgctgtcgttaagagctttcgaggcaggagtac

SEQ ID NO: 537410 - DNA, 199 bp, Homo sapiens
ttattggtacctgccttttaaactttgtttacccccctaaaatctgcttatggccccatttgccccaaaatcccttcccagttggatatttgttttcccataaaaaaaattccatttaccccatgggtgctctgcctttgagtccttttactgttgaagtttaataatttttaaaataaaatatggccttgggttttta

SEQ ID NO: 537411 - DNA, 187 bp, Homo sapiens
gccagaatgtttggcattcaatcgttggcagattatcttctgatgacacaaagttcagagaggctgagatgccttcatctgtgttgaagataatctggaggatggatgccatgcggttctaccctctgttggggcggccgcggggggtctggggtgtgtggggcccgtgtgggtgcttggcgcgggc

SEQ ID NO: 537412 - DNA, 172 bp, Homo sapiens
gtgatctgaggatcccatgcccattcgagtgcataaatacgtagagaactgcctggtcaccggcgccgcccccggagcccacgcaggcgccgcctgagaaccagttctgcgtctcctcgtcgtacagctttgtggagctccgactgcaaggccatcagcatggccaggcagg

SEQ ID NO: 537413 - DNA, 629 bp, Homo sapiens
ttttgcagtagaaaaggaagtttaatcataagggtggcgaataaggagacagggggaaacctcaaatctgcctgtctgagccgtttaggtctaggtattttaagggagttggagtgaccgaggtgggggatcactggttgaagaatacaggatggtgagatgaaaaaactgcattttcatgctgattcatttcctcttggggagaggcgggggggcggtcttcaaactggttggcaatagcttttttgctggaattcaggatctgaaaaacatctgtttcactgaaagtagacccgcagagctgcggcttttgctgccatttcctcctctgatctccaagaggcaggaaagtcctccttgttatgtttctggagctcctcatagatgctgtcattcttgtgaaagtctccagcctctctgtgaagaacatggacgtgaacgtgctttacagtctgtccggctttcgggccatcctgtatggaagatgtgagataggtcccatggtaatgtcttttcaccactgtctcgattctgtgtgtctgctgatacaaatcgctcacgttatgaggacgtaggtcattgatactctgcactgtccatagctggcacactatgtcatgttctggtac

SEQ ID NO: 537414 - DNA, 118 bp, Homo sapiens
ctgcgggcttatgatcctcgcacgttacgtgggaattcctcgttcatgtggtgaataattgcaactccccgtgtggtatcctctagatgtctgaccttgcatgtgcatgcaatgcttg

SEQ ID NO: 537415 - DNA, 250 bp, Homo sapiens
gtgctcacttcatcgcgttatttggaaacaaacaagaacatagggcaggctgggtgaggtggctcacgcctgtaatcctagcattttgggaggccaaggtgggaggatcatttgaggtcaggagttcgagaccagcctagccatcatggtgaaaccccgtctctactaaaattataaaaaattggccgggtgtggtggtacacgcctgtagtcccagttacttgggaggctgaggcatgagaattgcttg

SEQ ID NO: 537416 - DNA, 227 bp, Homo sapiens
gagttacccataccctaaattgattatgcttcaaagactaagacgatagtggaagacaaagagaaaacataaatgggatcttccacaaaatgaaaaatcttttgtgcagcaaaggacgttattaatgaaagtaggcccatgcgcagtggctcatgcctgtaatcccagctactcaggaggttgagtcaggagatgtcacttgatcccggaggcagaggttgcatgca

SEQ ID NO: 537417 - DNA, 370 bp, Homo sapiens
  misc_feature (33)..(33): n is a, c, g, or t
cttacgtccccatcccggagtcccctcctcccnacagtccccactgacccaaagtcaaatcaggagctgtatcatttctttgctgatttcctcgctctgcagttctattttaattcaacttcagcaatcttcaaggagaggggtactttgttttgtcctggaaacattcgtaagacataaccgcggccgcggttatgtcttacggagttcccattgtggtgcagcggaaacgaatctgactaggaaccatgaagttgcaggttcaatcctgacctcactcagtgggttaaggatccagtgttgccatgagctgtggtgtagatcacagacggggctcggatcctgcgtaagacataaccgcgggtccagg

SEQ ID NO: 537418 - DNA, 560 bp, Homo sapiens
atcaatgaaagcaagagtttattcttgaaaaatagactgctagctaaattaacaaaaaaaatgaaggagaagatcctaacgagcacaatcagaaacaacaaatgatattacagctgatcccacagatatgcaaaagatcctcagagacttatgaatttatgaacaactctatgcacacaaattcgaaaatctagaaggaacagataaattcctggaagcacacaatctcccaagattgaatccggaagagattaaaaccctgaatagactaatatcaacttctgaaattggaatcagtaataaagatcctaacaacaacaacaacaaaaaagctctggaccagatagattcacagctgaattctaccaggcatacaaagaactgatactgatggtactgaaactattccagaaaattgaggaggagggactattccctaactcattctggtgaagccagcatcagcctgatacaaaaatctggcaaagacacaatgaaaaaagaaaactccaggccaatattcctcatgaacatagatgcaaaatcctcacaaaatattg

SEQ ID NO: 537419 - DNA, 926 bp, Homo sapiens
gctctcggtttcggctcggaggaggcaaggtgcaattccttcggtcgtcccgaatccgggttcatccgacaccagccgctccaccatgccgccgaagttcgaccccaagagatcatatgtcgtatacctgaggtgcacctggaggtgcaagtcggttgccacttctgccctggccccaagaatcggacccctgggtctggtctccaaaaaaagtgggtgatgacatgccaaggaaagggggtggcctggaagggcctgaggattacagtgaaattgaccattcagaacagacaggccaagattgaggtggtgcttctgctctgccctgatccatcaaaagcccctcaaaggaacccaaccaaacgagaacgagacagagaaccggaacaaatatttaccacccaggctgtgaccttcttcactttgggatgagaatgtgtcaacacattgtgctacggacaagatgcggacccgattctgttaaggcagagaactctctggaccccactttacacgaagatgcctggggacttgcccagccagccgggtttgcactgttgattggcggacactccttactgacactccattggatgaccgctcaaccagtgggtgcttggggaactggcccagaccaggtaagccacagggaagacccttcactaacgcgctatgttgaacagtggggcacccgccacaagaacgccacgacacaaccggtgggcaccagcgccgagcaaagctccaaccaaccggagggacgcgccaagaaaaagaaggagcactggcgccgacagaactgccactaggtgaggcctccaacaaacaccgggcacgggccacacccaggccagcaccggacaacgaggacgcgaacgcgcggagacagagacgaccaagacggcagaccacggcaccagccacac

SEQ ID NO: 537420 - DNA, 269 bp, Homo sapiens
  misc_feature (2)..(2): n is a, c, g, or t
  misc_feature (7)..(7): n is a, c, g, or t
  misc_feature (12)..(12): n is a, c, g, or t
  misc_feature (39)..(40): n is a, c, g, or t
  misc_feature (56)..(57): n is a, c, g, or t
  misc_feature (60)..(60): n is a, c, g, or t
  misc_feature (74)..(74): n is a, c, g, or t
  misc_feature (93)..(93): n is a, c, g, or t
  misc_feature (95)..(96): n is a, c, g, or t
  misc_feature (101)..(101): n is a, c, g, or t
  misc_feature (121)..(121): n is a, c, g, or t
  misc_feature (124)..(124): n is a, c, g, or t
  misc_feature (160)..(160): n is a, c, g, or t
  misc_feature (164)..(165): n is a, c, g, or t
  misc_feature (177)..(177): n is a, c, g, or t
  misc_feature (179)..(179): n is a, c, g, or t
  misc_feature (185)..(185): n is a, c, g, or t
  misc_feature (205)..(205): n is a, c, g, or t
  misc_feature (234)..(234): n is a, c, g, or t
  misc_feature (237)..(238): n is a, c, g, or t
  misc_feature (242)..(242): n is a, c, g, or t
  misc_feature (251)..(251): n is a, c, g, or t
  misc_feature (265)..(265): n is a, c, g, or t
tncgtgnccgtncgccaaatccccccaggaccttaaggnncccccccccatgcctnnccnccttcccggaaacngggtaggactgtaggaccntnnaaggntccatggttcgccccagtcntcngataaaaggcccatgcctcaggcctgccccttgtcngctnnccctcttcgacntncctttnctttgaaagatgtcaagccntcattgcccctaaacaattctcactaacnganncccnccaacctcntcgatcatagacgncgcc

SEQ ID NO: 537421 - DNA, 112 bp, Homo sapiens
tgatgctgcgcagcgtcagcgattgtccacgtctagctcagcatcttctacagcaggtccgcagcctgggggctggcccgtggaaacagctgagtgaaatccttcctggggg

SEQ ID NO: 537422 - DNA, 146 bp, Homo sapiens
gtcaatcgcaagggtgccatcgtcatcgccaggcatgcgcacgagcaacccgaacaatgttcaggcgctttcgttgaggtttgccgcgttgcgtatgtctctttgacctaatgccggaaaattggtcgcgattgtagatgttattg

SEQ ID NO: 537423 - DNA, 726 bp, Homo sapiens
atggtagccaaggaagcccgctatgttaccatggaaaactgagtgagtggttgagaaatgaagacttgtcagtgtacttagaagaagtaaatatcttttgaattagagaaagtgtcgggacagaaagtactttatgtagctaagtgggctggttgcagaaaagcttagaggtcattatgtcggtaattgttctgttttgaagtgtactttaggagagacgtagggatgcaaactgtttctcagttagaaagcctttatttgatcttttggaaattgaactagatgaaatgctgtctgtcttagaaactggagatgattctgatgtgtaggtaaaatatgtgaatgtttcttctggggaaattttgtatcagtgtaattcgaaaattgagaatacttaggaaggaagcaagtgtcgtatcttataatagtttatgttcatcttttctgttaaaagaagattaaatgtaactcattttggtcagaatccagttattgtggagcataaaagtatgactgtgtgtgatccaataatatataaacactattggtaaattggatattaacttgccaacagcatagtatgcttcgtgtagtactatatctgtggtgactctaattatgtatagcagagtagtctcaactcatatctggactggtaattgtgatgaaacaagtagtgttgtggcttatgtccgggatgtaatgctagggtgtcaatattaaggg

SEQ ID NO: 537424 - DNA, 181 bp, Homo sapiens
  misc_feature (169)..(169): n is a, c, g, or t
  misc_feature (173)..(173): n is a, c, g, or t
tcgcagagaaggaacaatcagggccatgacaggaaccgcaaagaaccagagggtataggcagcaaagaagggcacataaaaaggctgcttctcaggaaagtgtcgcagtgagacaaacacacatacagaccacacacagaccaccacctcaatcatgggccctagccgncctngtaatacg

SEQ ID NO: 537425 - DNA, 608 bp, Homo sapiens
tgtgggaaatcctttacttataactcactacttcttcaacacagaactattcataccggagagagaccttatgtatgtgatgtgtgtgggaaaacgttcagaaacaatgcaggcctcaaagtcccacaggaggctcccatactggggaaaaaccatataagtgtgatgtgtgtgggaaagcctatatctcacgctctagccttaaaaatcacaaaggaatccaccttggcgcagaagccctataaatgtagctattcgtgagaaatccttcaactacagctctgccccttgaacagcactaaacaggcacttcataccagggcaaaaacccctttggcgtgtgactgagtgatggtaaacgctctctcagcaacataattctggcctctaaagctacactaaacgcaatccacactggggaacgacccttacaaactgtgaagaactgtgggcaaagcatacatctctctctcgagccttataaatcactaaaagtgctacaccctggggcagaagcccctttcaactgtgacgagatgtgacaaggccttcatcacataccgaaaccttacaaaccacaaaacaagttcatcttggggagaagccct

SEQ ID NO: 537426 - DNA, 1427 bp, Homo sapiens
  misc_feature (722)..(722): n is a, c, g, or t
gagcggagagtcgctgcagctgcgtgtggcggtggcggcactgcagctcagagcggcgcacgcggctggccggggcgggacgcggggccgggcgcggagaagtctggggcgggctggcagagaggcctgggactgcggaccgggcctggggcgcccaacaaaccagccctgactggcggccctacagaagcgctgcgccccctggagccccggcgcctagcccggccagggcaattggggctgcgcgggaagccggcctgaaagcccccccggcactgtgggcccccgggcacggcaatcaccgggcacggaagtgcggagaaggggcaagaaatacggcagcatgcgccgaatattggcgcccggggggcacccaaaattcgggaggcctgcgggacgttggccggggaaggtggaccccaaaaaggccagggaagcttgggaaaaaatttggttccttttggacgccacgcatggacaggagcagcattcccatgtggacaccaaaggacatttaccccgttgtgttttccccccgaggggcaccccattcaccttggggcttttacaaaccgagtggaacccttgaggggagaagcaacgggggcattaaccgttgggcgccccgttcagctgatgttacgagactcccagcaaaagaacccgatgcgcacaaggggcaccatacaaagttcacaccgataaagagggatctccccccntttttagagaagggaaaaaaaggatgtgttgccacctttggggtcagagggagcgaacattatgcctatacaaggggagcaacggaatacacacaaagttgttggccaccagaatatcagaaaccaagtttgtggccgttccaaagaaaacagcaatgtcttaccacaagcacaacaaatgtggcgattgtgcacaaacaaggggggaacattccacagcgaagaaggtgtgtgccacaaggagaatgttgtgccgacgcaagatcgccgatttatagaccggacgacacttccacgggaatggtgcgtggagacccacacaacgatttgtgagggggagttacaattaccccagacaacagaggagcgggcccttttgggtgtgaaacaaacggcgttataagacaggcggatgaactacgaaagcgggagccccccaccagaatgaagatggtattataccaatcttgccaccgagaacgggggagcttcccccattattaacacggacgaagattttatccctatataggccgccaacacaaagtttaaacagagcgacgccctgttttcacatacaggtggagcaccttgtacaacaccaagaggttatgagtagaaatttataaatattggcggaccacaggagaccaaacaccccccggagtgttgtggccacacaacagaaacaatttctccccgaca

SEQ ID NO: 537427 - DNA, 106 bp, Homo sapiens
  misc_feature (79)..(79): n is a, c, g, or t
  misc_feature (100)..(100): n is a, c, g, or t
cgctaagcttcaggcttcagtgccatagatcactaaatgcctatcggtctgaagggggtactttatgtttccagattcnttaatgggtaccggagctcgnaattcg

SEQ ID NO: 537428 - DNA, 229 bp, Homo sapiens
ccccaatggaatccgtcttaaaaaaaaaaaaaaaaagaaagcaaaagaaaaagaaaaacagctcaggggtgaaaacaggattttgggcaacaaaacaacacaggaaaggaaaacagcaagaaggaaaagggaaaggaaaaaagaatgctctccacaaaactggtttagagtttcaaggaaattgggaaaggaaaaaaaaaagggtggaagggaaggggtagacaccagg

SEQ ID NO: 537429 - DNA, 962 bp, Homo sapiens
gcccaggagcccggtgggtccgggactcccgtccgtgccggtgcgggcgccggcatgtgtgcttgtgtggaggaccagggcggccgtcctgggccctttctccgttcctgcatgctatgtgctgctgctggctgatcgcggagcctcggtcaattgcctgcctcctcaccggcaggcctcttcgttctactgcgcgtcttcagctttgagccggtgccctcttgcaggggcctggtaggtgctcaagccccgggacccgcagtttctgccagtcgtcccaccgtagtgcggggagccgacgacagcgcccgagaatcatcgcctggatggccacttcggcagactaaggaactggacgcaacaggcgtggatgttgggaccatttgaagtgtacttactgacgggattccctgtcttaagtgcccgataacaacagtacataggacgagctgatgggactgggacgatatgagtgattgtgacagttggaccaaattcaggaagctgaatcctgcagcaaaccatcagacctcaggcaatagagtttgccctgattgcactagagattcccgtacccgtaagggagagcctggttgcagagtgcctaagagcatagacctcagaggtcttcttagatagtcaaagggccatgcacagcaaggctactgtaggctcgtagcagaagactgtactatgcgaagatgcccgtcaaccggtagtactaataggtgggggctggtccttccttggcagaagttatctacaaagactcagacaaacacagatcggcggatgtacaacagcgttaaccttacacaaacccttggaagcctaaaacaatacaggacagtggaaaacacctaatatagatgcatggaaacattaaatatggaaaaatggagcctttgccccaagggccaactaagaatatgtgacaggttcgaaaatgcccaccaggaaag

SEQ ID NO: 537430 - DNA, 143 bp, Homo sapiens
cgcagataaggccaatgaaggaggagatcatcaagactttataccaaggaggaagagaccaatgaaataaaacctcccactttgtcttgtacatactgggcctactgtagattacataagatacagccatataaaataaaact

SEQ ID NO: 537431 - DNA, 155 bp, Homo sapiens
aatgcagatatgcagagagaaatgagtggcagttcgcctacaccaggccatctgcggggtcagtgggggctgctgtatagtctatggctagccgaacggtgaacggtgacatactgcgtccatagccaaagcaggcacgtagcgaattaggccca

SEQ ID NO: 537432 - DNA, 393 bp, Homo sapiens
gtgactggacgcgagtatcccatactgatacaagagttctaatcagaataggatggaagagtgttggtgctgctacaatgctgaaacatataccagagtgctacgataaaagggaacggaagaaacacagtctccatgaaaatccatcaaagatgcccttcccctataaagtgctcaaagacctggatcctagaaatctatcgtaatgtagaatcctgatgtttgcttggacagcagaataagaacttcaaaaatctgattacatggagtatgctgggatacagtactatttgggatacaagtgtcgggtttgctaggcatctgaaggaagatgttataatgctcatatacaggaagtaggaaatgagaacaattcactaacatgttaccttt

SEQ ID NO: 537433 - DNA, 219 bp, Homo sapiens
cgaggatcctgggggaggtggatggttacagcgtccaaaatagagcagactagttgcccggatatggctaccgtaatcggtgagctactgggcatacacagatgactcgtgtgggctccaggtgctgcctgggcccaggaggggtgggtggggcatgcttgggccccacacacagcctggaaccctcgaaggaacagcagataatggacactgcagaga

SEQ ID NO: 537434 - DNA, 212 bp, Homo sapiens
gaagattaacctcaagacccaggtaattgcagtttctgtttgctcctcagtcctgagagagtcctatgcccctggggggaagctcccctgggatggaagaggagtaacgggtaaatttccagccacttactacttatcaagggctcatcctgtgacagcaggatactcattagtttttatttttatttttatttttttgagactctgtttca

SEQ ID NO: 537435 - DNA, 146 bp, Homo sapiens
tggcatagatttctcactctcgccatctggcagatcgtggaccctctgcaccgggacattgagacatttgccaaggagggacctaaggaagatattgacgtatctattctgccccagctggagcattgccgctccagtaagatgaa

SEQ ID NO: 537436 - DNA, 258 bp, Homo sapiens
ctgctccctcttcacttcttcttctgatcttggacccaaactggggctccatactctcttcggctcctccaggtgggcatgggaggctccagctcatttgggcggccccccggtctggaacgtttgccataaagcacttgttgatggcaccagcaggtccctctgcggacagccacgctgggtggctgggaccgagacaaggaccagggtcggctacgggcaagccagaaacgtgttgcaattggagactgttccgat

SEQ ID NO: 537437 - DNA, 735 bp, Homo sapiens
ggaccgaacctcaacaccacttcttcgaacccgccggaggaggagaccccattctataccaacacctattctgattatcggtcaccctgaagtttatattctatatcctaccaggcttcggaatactctcccatatgtaacttactactccggcaaaaaaagaaccatttggatacataggtatggacatgagctcatgatatcacttgggattccctagggtttcatcgtgtgagcaccaccatcatatttacagtaggaatagcgtagacacaacgagcatatttcaactccgtaccataatcatcgctatccccacctgtgcgtcaaagtatttagctgatcgccacaattccaggaagcaatatgaaaatgatctggctgcagttgctcttgagccctaggattcatcatttctttacaacgtagtgtggcctgacttgaacatggtattagcaaaatcatcactagaaatcgtataacacgagcaggtcctacggtgtttagctcatttccataatgtcctatccaattaggacgctgtattggccaccatagcgaggctccattcacgggatttcccctattctcaggctacccatagaccaaactaggccaaaatcattacaaatcatcatcatggggtaatctaaattatacccacaattttcggcaacggaatgccgagtactcgacaccgagctaacattgattcttatgggtcatcttttaagg

SEQ ID NO: 537438 - DNA, 226 bp, Homo sapiens
gaccggcttaggctagatcagatggcttcgcaggtgaattataccaaacatttaaaggcgtgataaccagtgcttcacaaactcttcccaaaaacggaagagggaaatacacttcccaactcattctacgaagccagtattacctttgcaccaaatacacaaagatagcacacagaaaacgacaggcacttgcctgtagtcccagctactcaggaggctgaagtag

SEQ ID NO: 537439 - DNA, 158 bp, Homo sapiens
  misc_feature (87)..(87): n is a, c, g, or t
  misc_feature (105)..(105): n is a, c, g, or t
  misc_feature (121)..(121): n is a, c, g, or t
  misc_feature (158)..(158): n is a, c, g, or t
tcttgctcgtagtcccagctggagtgaatggacacccttggctcatgtacctccactcttggtctcaagtgatcttcccagctcagnctcccaagtagctgggancacaggtgtgtactgncatgcccagcaaattttttattttttctatggaggtn

SEQ ID NO: 537440 - DNA, 760 bp, Homo sapiens
cttggccaggggcgaaggcggataggaaacctactccctggcctctcactccgggagctaaggctccaagtcgggaggtgacaagatgttctacctcaagaagtggagcgcggtggtcatgtggatctggcacgtggagtgcgatacgtgcgctatctgcagtttccaggggatggatgcctgtcttagatgacaagctgaaaacaaacaaaaggactgtgtctgggtctggggagaatgtaatcattccttccacaactggtgcatgtccctgtgggtgaaacagaacaatcgctgccctctttgtcagcacgactatgtcggccaaagaattcggcaatgagagcggttagaaggctctttaacagatttgttcagagacctgcaggttcttgtaatccattgccctacacaggctagaacactacaggggatgaattcttcacatatgaccccacggatctgaggtcctgtgggactcatcaaaacctatgtttagcagtatggcagaaatatcttcagaaattctttgcaattaagaatatcttttatttaacggggggctttctacccttgtggcgtgtgttgggcacacagcttacacctgctttaaaaaagaaagagttcaaaaagattaactttttttttaccctttgcttacacaagctaaggacgcgcttagaaaaattatgaatgttatggttgagcattaaaaagaatggtgagcgcaaaaatttcagttaggatctaagaaggaaaa

SEQ ID NO: 537441 - DNA, 396 bp, Homo sapiens
cgtacccggtcccatcacagacccatgatgtactgtggcattctaagcttagcctggcacctaagtgcccttctgctcctcaggtaaaggtgggatggatctcattcacaagcctggcaacagccaccaacccctgagtcaagccagctgactatctcccagccaggaacacagtgtgccagtctcttctaaggacagcatccccagcaggccccattctccctcattctaccgcctaccccttcaggctctgttgctcatgccggtgcccgtgctcagggtcacaagatcctggctgagatagggagggagcctctgcttctgcctaccagtgagagttgaggcgagtagaaggatgaggaagttgtcttttgcttctcctcattccaggtgggc

SEQ ID NO: 537442 - DNA, 647 bp, Homo sapiens
ccgccgtcgggccttctccctccagtgtgcccaagagccactggtactcagtgtctgggtggcgggcatgggtggtgatttttggttctcccagcacctgcgggcttgttgatgaccatgatgaaagctgtgtgtgtctgagccagcagcctggggtattatgttcaccccctagcttctcctccatgctgagaggcccagtggcccgttgtggcacacggtgacttaatgcctcttatctcgctctacggttgcagagcagtgcaacgacaatatggccacatgcagaggccaacatgctgcgctgcgagctcattgcatgctccaccacacgcacacacatcttgccgccttgttgcgcaggctgggccacagggttcgcgtgcgcgtctcacagcttgcagctggtcctgctcacgagcccaccaacgtgatacccacacccccatttcgccccgcactacacgcgcactaacccactgcaaccctacgtcgcgtcgcacccaccgctaacgcggcccaaccagcgtccccagcaacgttcgcaccccctggccaaccttcccccccaatggccatggccctctcctctgagaccccacgcctcccaccgaccgcgtggattccaccacgcgcacaacgcgtta

SEQ ID NO: 537443 - DNA, 298 bp, Homo sapiens
gctcagagatcccccacgatgaggaattgttaggtcagcaagctctgatattcttgtttagtacatctgtgacaaaggtaaagacactgtcttaaaattttaagaaagtcattcatgatttatttgacttcctctcatggtttggagaaactttcatttttaagttgaacatgtagaacaagcagtggtatgagttttccttccatagttctttgctatgtttttcttcaagaagaccaagagaagtactagaaaatggacatcctgttaaaaaaacaacttctccatttgtcagttc

SEQ ID NO: 537444 - DNA, 362 bp, Homo sapiens
gggtaagcatcaggttcacggcacattattcagtccaccagccgcgtgctgaaggagttcgccacctttgacggcgcgggcaccacctcgctcgaatggggcggctatccgatcctgcgctttgacgagttgccgcaggtggatattcaactgctggactaccccgacgagccgccaatgggcgcgggggagtcggcgtcggtaccaagcgcagcggcggtcggcaatgcgctgtttgacgcactgggtgtgcgaatgcgcgaagtaccctttacgccggaacgcgtgctaaaagcactggaatccgcagcacaggttaaggaagacaaagcatgagtcagataaagacagtcgccggatgg

SEQ ID NO: 537445 - DNA, 143 bp, Homo sapiens
  misc_feature (84)..(84): n is a, c, g, or t
cagggaacctcttttaccaggtcaactcccagacagtgagagagtggctcaactgtggccatcacccgtgaccctgcaccaggncgatggagagccttttatgagctgactgaaacatgatcttgctctgtggtaccgatgct

SEQ ID NO: 537446 - DNA, 87 bp, Homo sapiens
gcggccgcctactactactactgctcgaattcaagcttctaacgatgtacggggacatgtcaataaagaacagctaaattctcctat

SEQ ID NO: 537447 - DNA, 472 bp, Homo sapiens
  misc_feature (447)..(447): n is a, c, g, or t
ctgcctctacaacccattattctgttctggatctcaaacatgccttctttactattcctttgcacccttaatcccagcctctcttcgctttcacttggactgaccctgacacccatcaagctcagcaaattacctaggctgtactgccacaaagcttcacagacagcccccattacttcaatcaagcccaaatttcttcctcatctgttacctatctcggcataattctcataaaaacatacgtgctctccctgccaatcgtgtccgactgatctctcaaaccccagcaccttctacaaaacaacaactcctttccttcctaggcatggttagcgtggtcagaattcttacacaagagccaggaccgcaccctgtagcctttctgtccaaacaacttgaccttactgttttagcctagccctcatgtctgcgtgcagggctgccgtnttttaatacttttagagggcctcaa

SEQ ID NO: 537448 - DNA, 622 bp, Homo sapiens
cttgtggaagacagatccgtgcatgttgccccttccatacttcgctgacgctccccacggaagccgatccgagcggtatgcctacataccgacacgcgaatgtgctgaccaagctgcgtcaggagggcttcgagcccttcatggtgtgccagacccgtgtccgcaacgaggaccggcgcgagttcaccaagcacatgatccgcatgcgccatgcgagccagatcaatggctcggaagccaacgagatcatcttgctcaatagccatgacggcaccagcagctatcagatgctggctggcatgttccgcttcgtctgccacaacggcctggtctgcggtgaaaccactgccgacatccgtgtcccccacaagggcgacgtggcgggtgaggtgatcgaaggcgcctacgaggtcctccagggcttcgagcaggtgcaggcgtcgcgagacgccatgcgcgtcatcaccctggaaacaggggaagaggaaatcctcgcgcgctccgcactggcgctcaagtacgacgatccgaccaggcctgcgcctgtctcggagactcaagtgcttgcggcccggcgcttcgacgatcgacgagcggaactctggtcggtgtacaccgcatc

SEQ ID NO: 537449 - DNA, 127 bp, Homo sapiens
tggaaagggatttccactcttgttggcccaggcttgaagtgcaatgggcacaatctcggctcaccacaacctcggctttccaggtacaagcaatctctccgtgcctcagcctcccgaagtatttgga

SEQ ID NO: 537450 - DNA, 183 bp, Homo sapiens
ttagtttttaaggctgcccagggaagggaaagactgggctttggccaatttaaaggtaatttatatccgcccccaggtggagcaacatgggattttggaggcccgggggtaactgaaagtgagtacaaatagtttttttggtttttggagataacccatcaataaaaggtgcttcctttggta

SEQ ID NO: 537451 - DNA, 724 bp, Homo sapiens
ctgagtgttgccgcgaacggtggggtgtggtacgagcgaggggtgccgttgcggccgatgtgttcgtcagatgtgtaagtgtggtgttgcgacggcaacatgacgttgtgtgggggcaaacgacgcaccctttgtttgcatgtgtggtctcgggcccggtggagttgcgtgtgtgtgtggcgcagttgcggggacagtgtgggagttgcaacgtgtgctggtgggcacttccagagtgaagggttgctgcattcgtttgatttttcttggtccagcgggggcatccgtgagctcgtggtaattgcatggcgcagaggtggggccaatcaccaaaaggtgcaggtgctgtgcacgttgataaaaggttctgcgtaggacatgcagcaaagtttgtatggaccaggcgtgtgctttctgtgaaagcaggtccgcattgaggtgacactcccgacctatgttcccaggaagctggcacctcttgatcttgaggtcccaaagggtccccatagttgtcattcagtgccacacgtgttgcgagagcgagatactctgggacgcctcgcagcagcgagagggagacttcatcccgaaccctcgatggatccgcaaggcggaaaggcctcttcgggattgacaacccgggggcaactcgcagcagccatatcctgggagatcaggcaacccaactccaacgcatcctcgcttacggaagcaacaaaagaca

SEQ ID NO: 537452 - DNA, 325 bp, Homo sapiens
gttgtttataggacatccatagacatattaaccattatttacagactttccacacatacagattgatttacatagaactcagagactggttgttagcaaagaactgaggaaactgaatactttttgcatcagttggtgcaggtttgccaaatagttgataagctccaagggctccatgaccttagaaaagcatggtttagcagaaagggcatgggctttgaagtgaaacacctgagtttgtatccaagctctgtcgcttgctagctgtgtgacataaaggaagggtaacctttctgcagtatgatttgattatatgtaaaataaa

SEQ ID NO: 537453 - DNA, 1089 bp, Homo sapiens
agcgggagttccagatggcgccagtggaagctgcggcggcggtgtctcgcgttcggcgggatttctcttcgctccggctcgaccgtaggatctacgatccccagcatccagccgccggctcgaagactcggtctctgaccacccaacttcggtcccctagatccggcccccggctccgggtcccacggatacccgtcggtccgtagccccgtatgatgacccatagaaccgtgtcacggggtgaccacatgagacccgcggttcccagcgcgatgccccaggggacacaggaggactcgacagggcctctggcggaaccagcgagcaccactcgtaccgcccgagaggcccgcgggccacccaaccgcacgggctaggcgactcggcggccgcgcggccgcaggagtggcagccactgcaggacggacgccgcgagctccccggggcagaaccagcgctggaggtgaccatggagcacacccaggcggaacacaccagtctgggtgaccgaccagccggcagtcagtcaccaccccgggcccgaagccatggcagcccccacaaaagaggcacgccctggaactagcacccccgcacacgtacaggaacagcttgcgtgacgagcaccacgggcaccccgaacggcacttcccccggccatcttggggcaccacggacggtcacccacgagagcggtacaggcagctgcgacggcggtaacacgaccgagacagaccacgacacgaacgcaccagagctacacggacatgcacacccgaacggtccaccaccccaaaccgacagtcagcgatcaggaagccataccacactcagtcatgcaccgcctgcagaccaaccgagcaaacgacgggcaggccgggtgagccatccaaacagcgggctggtccggcgtgcggtcttcttcgcaccgactcccacgtcgcacgcactgcaagggcgccgtagtctaatcagggtgagcaccccacctgtacgaagcggcgcttccaacgactcatgacctagtaagaaacagcaaagaacaaacaccaccagcgacactaccccacacagaaaggcagcgcagac

SEQ ID NO: 537454 - DNA, 729 bp, Homo sapiens
  misc_feature (277)..(277): n is a, c, g, or t
  misc_feature (290)..(291): n is a, c, g, or t
  misc_feature (293)..(293): n is a, c, g, or t
  misc_feature (296)..(297): n is a, c, g, or t
  misc_feature (326)..(326): n is a, c, g, or t
  misc_feature (359)..(359): n is a, c, g, or t
  misc_feature (363)..(363): n is a, c, g, or t
  misc_feature (365)..(365): n is a, c, g, or t
  misc_feature (370)..(370): n is a, c, g, or t
  misc_feature (397)..(397): n is a, c, g, or t
  misc_feature (416)..(417): n is a, c, g, or t
  misc_feature (474)..(474): n is a, c, g, or t
  misc_feature (484)..(484): n is a, c, g, or t
  misc_feature (490)..(490): n is a, c, g, or t
  misc_feature (528)..(528): n is a, c, g, or t
  misc_feature (681)..(681): n is a, c, g, or t
aggaattcggcacgagctcaggctgcagctggacagaggggactctgggctatggacacagggtgacggtgacacagatggctcagagggggactgctgctgcctggccactgctccctaagccagcctggtccatgcagggggctcctgagggtggggaggtgtcacatggtgcccctagctttatatatggacatggcaggccgatttgggaaccaagctattcctttcccttcctcttcggccctcagatgtcccttgatgcacagagaagctntggaggagctttnntntgnnggtcaggcagccagtgagatgagggatgngcctggcattcttgtacagtgtatattgaaatntatntnatgtnagttggtctggactgacagcatgtgcnctcctgagggaggacctgnngcacagtccaggaacaagctaattgggagccaggcacaggatgctgtgttgcaacanaccaagcatnaggggnagaagcagagagatgcggccaagataggccttggccanatccgctccttcctgcctctctatctctgtcttcctatactgtcgcttgctattccctctcttcttacttcttcctctatctctccccaactctcattctcatctgcacgcttcctatctcatgtgtatgcatatacattcctctaacttctntctaatttacttgtggttgaattaacaatggctcatatgaactcccaa

SEQ ID NO: 537455 - DNA, 1044 bp, Homo sapiens
ggcaggagaatcacttgaacctgggaggcagaggttgcagtgagccgagatcgtgtcactgcactccagcctggcgacagagcgagactccatcttgcataataaaaaaaagataaataaaaaagatcttaaggcagccaaggggaaataccaagtttggggcttgaccatttggttttggggcgggttatttggagagcaaaataaacggggcacccaagttccgtctaaatatggcggtgtgaaaaacgttactactgctagaatttcctaggacctagccgaaatttttttgtcacaaggggcccagtgtgattgacacatttgggcggcccagtagcggagtgtacagtctattaaggtgcgtccctatagcgaatagaatagcacaatatgtgtattgcccggatttggtaacatgtgctcatgatctcacttaagcgggcatgtgaaatagggccctcccaaaaggtggctcaactttgtgttgggggccatgcttttgttagggcattttttttcaaaaaacgcctctgttaagaggttttatatgcaagcagcaccatttattgtggcattatacgtccccccatacattgagtaccccacgtggtagggtgttacaacgtttgctactagaccagccctgttcgttgcacacaaagtgagaaattttctctagtgaaacagtctggggccctgaataagaggttcaccacggaacaggcaagcgccagaagtgtgttctatacaacagggttccctacgaggtggttttcaatacccggggaaggggtatctcgtagacaatgtgaccccccttttgaacaggtgttggtaccggtggcaactcgtttaccacacttggtgtgctataaagacctgtgctaattgagcacacttatttagcgcagaattctcccgagcctttacagggctctaatgtaaaggttacaacacaacaatggggcgtttggtttacaacaggtttcctcccgctgacgcttcacagacgcaaacggcgccagaacgccgagtgggaaa

SEQ ID NO: 537456 - DNA, 180 bp, Homo sapiens
acatctacaccttaagcacagttcttgacgacaacgattcatcccacctgaggaaaaaaagccaacagaacgtctgaaaatggtgggatcaggagaccagaatactacatgcactgcaaggcttaagtcagttcacacagacaagatggctcaacatggtggatcattctgattgcagca

SEQ ID NO: 537457 - DNA, 328 bp, Homo sapiens
cgcaacaaaaaagacaaagcggggcaaaaagaggccagggccccccaaggaccacaaacgaaaaaaaacgaacacaaacacacaaacaaggcaagcaagacgccagaagagacacgcgcggactcacccacacaccccacgcacacaaaagaccaggcaacagacagaccacgcacaaccagacaggcagaacaagacaggacgagaagagacacacacaggaaaaacacacagcagcccaaaagatcaccacaacgaaaccacaagaaaacacacacaaaaacacgacgcaagacccgcacaaaaaacccgaaacacccacgcaaac

SEQ ID NO: 537458 - DNA, 532 bp, Homo sapiens
ggcgggcttcatcactacgatgagttcggcgtcctcatagacaatgtcgagcgggatcgactgcgcttgcggccgggcctccgtcggcgcgggcacatcgatgagaaagtgctcgccttccttcacgcggtaggacgcgtcgaccagaaccttgggcgcgccgtctccggtgcgcgagacgcggccctgatcgatcagggtcttcagtctggcgcgggacagcggctcttcagccgccttgcccccaagggcctcggtgagatacttgtcgaggcgcgtgcccgccgcttccggttcaacggtcacggtgtggcgttggccgcccatttctacttccagcgaggacatcatgcctgaagatacagtccagacggccgagatggaaatggtgccttcgctgcgcacacgccgcatgcttgtggcggtggttatcgtcacggcgatcgtgctggttgcgggtttcgcgtttgtcatcgcgacgctcgtcaagcgaacctctcatccgcaaaccagcaccgcgctggtcggcccc

SEQ ID NO: 537459 - DNA, 151 bp, Homo sapiens
gcagatagatgtggagacttccaagaaatgggctgctggccagaacgaacaacattctattaccaagaacacggccaatgctggacctgggagacagagcgagctgcacctatgacagggtgaccctggcaggtgggcaaggctgatccag

SEQ ID NO: 537460 - DNA, 498 bp, Homo sapiens
ccctctggtggagactcctccacacatgagctcaccagagcatacaagacagagtggacagagacctggggaaggaagctgaactatgcagagatgaggacaggtgcaggctagggtacagggatggtggtagaggagacaagaataatctccaggaaccacagactctgcccaacaacaccccaagacttccagagggagttaggggtgcccccgtgaccaggcctctccagcttcacactcttggccagcatatctccaaatcagctcccagaaactcctgaactccagattagagatcattgcagctgccacaggttggcaatatactcttacaggccacagttgctcggcctgagctggggcacgctgctgggtgaccagttcccgtagctcagcaggggtcagcgtctccttcccaccctccacggagtactggtgcaagtacttgatgagggtctcaatggacctctccagatcactgaattcctgagcatc

SEQ ID NO: 537461 - DNA, 305 bp, Homo sapiens
gtgggaggttagtgtggccccgggcgtccgctccctcagcggatgtggcagcccccgagccatggctctcgccgtccgagtcgttttattgtggcgcttgaggctacaagtccaagtatcttcagctcaagagaagttagaagatgagttccccggccgcctggacatctgcggcgagggaactcccaggccaccgggttctttgaagtgatggtagccggaagttgattcactctaagaagaaaggcgatggctacgtggacacagaagcagttctgagttggtgccgccatcaagccgcttgc

SEQ ID NO: 537462 - DNA, 389 bp, Homo sapiens
  misc_feature (263)..(263): n is a, c, g, or t
  misc_feature (292)..(292): n is a, c, g, or t
  misc_feature (322)..(322): n is a, c, g, or t
aggtgtgctgccctcagcagcgattctgtaaagcagagggaggctttgggccaggtgctcttgagaggatttctgggagcgaggatggaggaacgggcacctgggggctgtagggagggggctggaccagcgccaggctgctgagcccgaggcctgggaggtgggactgcgtgcactctgccctcacacactcagagcatcggaatgggagttggctgcagtctctctcctcattgccgcatccaggttcgttctgactggtnaacagaacctcaaggaaaaggtgccaggncccaagggctgggctttggcttgtttgggnccaaggaccttgtggggaatccttaaaagcgacttgaagcatcaacttggccttgccgcgtttacaa

SEQ ID NO: 537463 - DNA, 1444 bp, Homo sapiens
cccacgcgctcgatcgaccccaacatgcaacgtctctgaggtggtcaaagtatgcctacgtacagtggctaagctccgtgtgtgacaagttattacatggcctcacctgacctggagatccaggagatcaatgcagccaacatccaaacagccgattcacagtggtctacgtcccctcaccaccatactaacacatgctctttgagctcttcaagaatgccatgagggcgacatttggaaaagccatgaggtccagcactcatatctcccacccatcacaggtcacaggtaggcctagacgtgagcgaagcaactggaccatcaagattgaagtgaccagacagaaggagagggatgtaccacatatagagcgaaagaataagaaccagaccacaatacaaactaacaagacaatcccacacgcaaacaaaaccaacccaagacctggaacacagcagggaaccagaccgcaagagacagtaccaaaagagaaaaatgggacataccacaaacacaccgaccactaacagcaaaagtaaaaaaccaaacgaacgaaaaagaaaaacaacaatacacccaacaggaaaccgccacacaaggaaaccacaaaaaagcaacaaacaaaccacaaaaggacacctagtaacaacaggaacaatcagagcgagaagaccgcacacgaacatggaaaaaacaaccaaagacaacaacacagaagacgcacaacaacacacacaaaaaaagaaacaaaaggaacgacgcgaagacacaggcagcagacacccacaagaaaagagaaaaacaaaaacaacaagaaaccacccacaacacgagcatcaaaaaaaggggcaagagcgaagacaccacagaacaccagcaaaacaaaaaaaaccggcacagaccgcacggacaaacacacacacaagacagagacgcccaaccacacgcacccccgacagcagccaagagcagcgatagcgaagacacgaggaggaacaagcgaaaaagaacgaaacaaaaaaacgaagacagaaaacagcaacgaaacagaaacaaaacgaacagtaaaacagacagacacgaaagacgcaagcagagcagacgaaagaaaacagagcgacaagaaggcagacacaggcacgcacaccggaaagacaggaaggaacacacacaggcgcgcccaaacgagcaacgaggaaggaaacagggaggagggagggaagacgcgaaagcaagacgaaaaaacaagagacgacgaaaacagacactcgaacaacaaccatacaaaaagaggacaacacggaacgaaaacaaccacacacagaacaacaccgaagagcacggaagacgcgacagaggcgagcgaaacagaacagaaggcgcacagcacggcagaaacgcaggagaaagcggaagacaaggcgaacaggcacaacagagaaca

SEQ ID NO: 537464 - DNA, 881 bp, Homo sapiens
  misc_feature (332)..(332): n is a, c, g, or t
caacggaaggagctgaacaagagcatcaaccccgacgaggcggtggcctatggcgccgcggtgcaggcggtcatcctcatcggcgacaaatcagagaatgtgcaggacctgctgcttactcgacgtgaccccgttgtcgctgggcatcgaggacagctggcggtgtcatgaccccactcatcaagaggaacaccacgatccccaccaagcaagacgcagaccttcaccacctactcggacaaccagagcagcgtactggtgcaggtatcgagggcgaacgggccatgaccaaggacaataacctgctgggcaagttcgacctgaccgggatncccccttgcgctcgcgggggtcccccaaaattcgaggtttacttttcgacgtgtgatcgccatatggcatcctttatcgttaccgcccgccgataaggacgcaccggtaggaaaacaatatcaccattcaccaggacaaaaggtcgtctgagcaaggacgagattgaccggatgttgcagtgaggccggacgcgtaccaagtcgcaagatgaggcgaatcgcgaccgagtcgcgccaaaaaggcctgagtcctatacctagcaaattaaagcagacggtggaagacgagaactgaggggcagattagcgagcggacaaaacagatctcaagtgtcggagtgtcactggtcgaccgaaccgtgcgaaagtgttgaccagcgagagccgaagttgcaccctctggattcagtggcgggcgacagagggtcagccggcccgaagggatgccagcgaccgctcccctgggtaagatgacgaactgggtgaaggcctacacgatatctcctgtggtctaccatggataaaaaaacacccggcgccggaaaaaag

SEQ ID NO: 537465 - DNA, 479 bp, Homo sapiens
ttgggcgcctccctaggcgttcggcctttaaagggggcccgccccattgtgtgagccactcgtgcgtacccccttatgttggggccccccggacctacacccccccccgatggtgttcccccaggagctctcactaattattggtcgttgtcttcccttcccccagtggggggcccctactttttttttttagctcgcacacgcggggttccccttttccggcatagtttaccaccaggggctccccttgtatgttacccgcccgggtccctggggctcgggcacgcagtcctctacctcgtggattttcctttttcctcggtgttaaccacactcgcggcgagttttgtagagggggggcacggccacaatccaaagggaaggcccttgctcccccccccttttttttgtccccggggtggtaaaaccctacgcccggtttatagaaacctttttttccaaaaaaactttaaaagtga

SEQ ID NO: 537466 - DNA, 107 bp, Homo sapiens
aggaggacaaaaataaggtggcattcccccccaggttttgactttcagcatcatgcaggggcttatttgtttggaggcagttccctcataataaactataaaatata

SEQ ID NO: 537467 - DNA, 566 bp, Homo sapiens
  misc_feature (97)..(97): n is a, c, g, or t
  misc_feature (102)..(102): n is a, c, g, or t
  misc_feature (105)..(105): n is a, c, g, or t
  misc_feature (150)..(150): n is a, c, g, or t
  misc_feature (158)..(158): n is a, c, g, or t
  misc_feature (162)..(162): n is a, c, g, or t
  misc_feature (165)..(165): n is a, c, g, or t
  misc_feature (180)..(180): n is a, c, g, or t
  misc_feature (190)..(190): n is a, c, g, or t
  misc_feature (192)..(192): n is a, c, g, or t
  misc_feature (250)..(250): n is a, c, g, or t
  misc_feature (275)..(275): n is a, c, g, or t
  misc_feature (285)..(285): n is a, c, g, or t
  misc_feature (291)..(291): n is a, c, g, or t
  misc_feature (298)..(298): n is a, c, g, or t
  misc_feature (327)..(327): n is a, c, g, or t
  misc_feature (339)..(339): n is a, c, g, or t
  misc_feature (341)..(342): n is a, c, g, or t
  misc_feature (352)..(352): n is a, c, g, or t
  misc_feature (387)..(387): n is a, c, g, or t
  misc_feature (416)..(416): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (427)..(427): n is a, c, g, or t
  misc_feature (429)..(429): n is a, c, g, or t
  misc_feature (434)..(435): n is a, c, g, or t
  misc_feature (480)..(480): n is a, c, g, or t
  misc_feature (504)..(504): n is a, c, g, or t
  misc_feature (534)..(534): n is a, c, g, or t
aagtcggcggtggaggctagccgcctggtggctggcaagctcaaaaaaaacacggcatttgagaattagaagctcatctcaggaaagcgccaggagntggtnccnagattgccacattctggatgccctgtagcccctggccgcatcctncagggggnccanggngcctgcccttttctntggcaggcanantgtggtagtgggaggttgtgcatggaggccagttaaaacttacctctgttaaaggccntcaaggaaaaaaaacccggccctgngtcaggcagngtgagnttgccgnttggccctaaccttctttttttttttttnaaaaaaaaaaancnnttaaaaaacnccccttaaaaaccaaacctctttgtgttttgaacnaaggaattttccaaatttgattgggattntgntntnaagntnagganntttttcagcccataaagccccccgttttatgcccctctaattttnatgtttggggattgggggagggcntgtgtttttttttttttttttaaagggggngtgaacaaatggaaataaagcaggggctgtga

SEQ ID NO: 537468 - DNA, 338 bp, Homo sapiens
catggcgaaacgcagaagctgctcgttcatcttcatcggcgcaggtcttccatgctcattctgactatcgctgatcagttgtttccaacacgcgccgcgatctggttgatgctgcctatacactcggcgccaacggatcgcggtgttattcgccgtgtgcttttgccgtcaagcgctcccgatattgctgaaacgctgcgcctcgtgcttggctgggcatggacctatgtaatcgtcgctgagctgatcggcgcatcatcgggcatcggctatatgatcatcaattcgcaggcgcttatggcgaccggacagatcattttcggcatcattgtgatcgg

SEQ ID NO: 537469 - DNA, 927 bp, Homo sapiens
ggagcgccaccgggagggctacgcggcggcgaagccatgggtggctggcctgcgggggcgcggtgggtgcgcgagacctgcgggcgggcggacagaaggctgccggacggccctagaacatgagccgggtggatccccaacccgctcttgagaggggcttgggagcggcaggaaggcgcccacagatgggaagcgagggaaaggcggcgggcccactttcaggggggggccccggcttcgacgggccggggggggcagaagagaatcttggcgggccacattctccgggggtggcgcgggtgacccggccggggggatttccggggggccgggcggccgcaattttcgccagggggcaccttcttggaggcccggccttggctttcctgggcgcgggcccccgtggtgatacccccttgggattgggtgtgggcgtggttgcccctcgccggacatgcctgggcgacccgggagggggcttagagtttccggcgggaattcgccggggcgggccgcctttttgccaccgcggtagattgtcgcgggcccagggtcggggggcccatctgtggatggcacttgggcccccttgggtcccttattgtgcgggcggcctgtttgtcgccctctaagtgtacacgggggcaccggggcacccgacaatggtgctgatccgtggaaagaaggcctccctcaagtgggaacttcggcccacaggtggggctggtttccgtgcccgggaaatgaccaagggccccgggaccttggggggcgccgaacgcgggtgggctttacgaggcgaccggacacgacggttgagggcactggaagggctgatggggccctttccaaagacggacattctgacaggcagaattcggatgtgggccactggggggcccagaagacccctggaccgccacatgg

SEQ ID NO: 537470 - DNA, 329 bp, Homo sapiens
cggtacgtgactagagagctgtctctcgtgaaactcatctttattgagaatatactatattccaggtacataaagatgctctatagatcacaacagccttgtggttgacatgtcagtatccctcttttaacagtgtagagtacttgtggacaaggatttgagctggtatgtctagttctgaaacctgtgttctttccattatggcacatgtgtgtttttcttttcagtacaggtaaaacagtttctgtacagtcaggggaaggttcatctaggacatatgtcagtcaggcatttcgccctttgacaccccaaggatagtagtgaaaatt

SEQ ID NO: 537471 - DNA, 125 bp, Homo sapiens
  misc_feature (28)..(28): n is a, c, g, or t
  misc_feature (73)..(73): n is a, c, g, or t
  misc_feature (84)..(84): n is a, c, g, or t
ggctaacctcgagcggccccgggtccgngaccccatcccacctcttcctctgagccgttcagagcaccttgtngtgtagtcggngctgggtggggtggctccgccaggaggcgcatgcacggttc

SEQ ID NO: 537472 - DNA, 662 bp, Homo sapiens
cggctcaggagccagtggttggggctctgagaagaactcaccaccttgaagaagttcttcggctttgggagccgcaggggccggcggtccggggctccctaggccacgtctacaggggttcggggtaccgaatcggaagatccacagggcgctgtcaagggcgaagccgcggaagtggagcgctgcctggcgcgcaggagcggagacctggaagccggggacaggcagcacaggcagtggggtgggggctcagcccaggtgggagggggtccccaggcccggcttccccgcagcccctgggatggggcctcggagggcaccctcagaggggtggtgccaaacggagcctcagctgctctgcatcccccataattccccagctggagcgcttggtggagaatgtgagtgatttaactcaccaagctaagcatacacagtgttatttttaacctacacgtttaaaacatggtgttatatacattataggaggtgcctaatgagagaactcattcctctatcaaaaaataccgtgagtcggccgggcgcggtggctcaggcctgtaatcccagcactttgggaggccgaggcgggcggatcacgaggtcaagagatcgagaccatcctggctaacacggtgaaaccccgtctctactaaaaatcc

SEQ ID NO: 537473 - DNA, 124 bp, Homo sapiens
tgaacaaaagcgtataccaaacggtacgacagcagcatatagcaccctactacatagctgtagaagcgcaggtagacccttgagggttgtcagccccttgatactagtgctatcttggtccggc

SEQ ID NO: 537474 - DNA, 128 bp, Homo sapiens
  misc_feature (68)..(68): n is a, c, g, or t
  misc_feature (107)..(107): n is a, c, g, or t
  misc_feature (123)..(123): n is a, c, g, or t
gatcccctgctggctgggggcagctcccaggatatactgccttacaactgtttctaaagcccatcctnctaacatggcgattccggaggtcaaggccttgggctctncccagggtctaacggntaagg

SEQ ID NO: 537475 - DNA, 1046 bp, Homo sapiens
agcgggtcgcgggcaggcgactcacagcgatggcggccgagcagggtccggtggcggggggctggttgctggctagcgtgccggagacggcacgctgctcggcgcgataggtgggtgggctggacaggggcgcgtggtgagccggggagactgtgcccgcgggagcgccgggcgaccatgaggcacaatggccccgcccagcagggcgacgagacatcgtgagacccgaactcaagagacggtcctgcaacagcgtaaggccggaagtatctagcgcggggtctgatgggatgagacggtctgttggccaggtcggtacattgaactcttgcgattgcgcatattaggttcaacgaatacatctgatttcatctaggatgagagggtacttgcaaaacgtcaaggagagacatcgattaaggccatgaagggaaacacaagcatgggggtgagcatcatgacggtcacacgctataatgtatcgcgttggcgactgggaagtgggacctattgggatggaaaaaggacatgtgagtgcacgctgctgttgaatgggatagaaaaaaggggtaatatacatgagtgaacatggtttcatgccgaagttctttacttcaaaaggaaaatggatagcgagagaaagatgtcagacaattccaacctagggctcggatagtgcaaccctttgggaggtaaaatgctgaaacgtgaacaaaggggaacgacgagcccatggggttgaggcaggggctagtatggggacatttcaatagcgccaagaccaaatttttttgccagttacttctgttatttaggtcccgaaaggtcactctatctaagcacacgtgggtgagaaacgggggcgatggtggcttggaactcttgaacggttggataaccgattgtttgatcgatgaattctggcacaatcgaataacgagaatggacagaagaacaggacaaagggagtcgatggtcttcgagggggcaaagtggagaggaattgggacttttggggagcgatggggcatgtgggagttggtaac

SEQ ID NO: 537476 - DNA, 592 bp, Homo sapiens
  misc_feature (34)..(34): n is a, c, g, or t
  misc_feature (180)..(180): n is a, c, g, or t
  misc_feature (367)..(367): n is a, c, g, or t
  misc_feature (383)..(383): n is a, c, g, or t
tttctccatccgaaccagactggccaactaacancaaatatacattatcaatccctacaacacaccattccacctcattcatcgcccaccacatatacttctaatacatctcatcatatccaaatcatttacacaaacctctaattcacattataacaattctattggggggggacacancaaatgcccccccccaaaaaaaaaactaccaattctaaaattaattgcccccccaccttccatatacaaccatcactcaatccacacccccaatggtccattcccctattaactaacccaacccattcccaactcaaacaaccctgtacctctttcacccttctcccccccctcacccacccccccnaccactcccccaccancccctccccccaaacaccccatactatttttctaaaaccccaaacaacttcttactcacacaccaaaaccaaatttttttcctcccacctccacccccattcctacttttctcctctcccccactcttacacttcctcacatcctactatcactcccccacctctctccttcctcctcctctcctctccatccaaccacactacacaat

SEQ ID NO: 537477 - DNA, 526 bp, Homo sapiens
ttctgtgctgggaacagatctgttttattcagttagtggttcagcagttgcaaaatcaagatggtggcataaagtgactctagccacctcagaatgtgtagagtgagacaaagcaattgtctgagcaatgaaatctgcgggcaataaccagctttaaagaacttaatggcaccagaggagacattcagcaacaacacacagaaggaagatcaagagccacaaaaggaaactcagggggatatgcggtcccagacatcaactcggtacagtgtgtccaggggagtggtcatcaaaagggatccacacagcagagcagtcccgcaagcctgttgcccctggagacctcagcaagagcaaattcactagaaggctgcaatgcgaagagaggtagatgctgccgatgtggcctcgtgaggctgatactgtgcctagccctcaccctgaaactgtgtcttcctgacatcctccctaatgacaacctgcttagtagtcatttatctttgtctcactaaggtgaactgaagca

SEQ ID NO: 537478 - DNA, 342 bp, Homo sapiens
ttatttacctttaaggttctaacttaggtataaccacttgaaattcacagcataagtaatctacgtaaccctctaaaaatttatttagccaaatgtaatggaataaatgctgtgtaaataaccttgtaatatcccttagattctgaaattagatatataaatatgtattaaatgtctggctcagttctgattttttaaaaattcacattataggaacccatttttctaaaaaatgtgctcttagtgcttgagcactgtgcgctcacacatataatcaccactctttgagagcacaaggtgcacagctcacaagctcaggggttcgagcacagtgtggacacc

SEQ ID NO: 537479 - DNA, 1028 bp, Homo sapiens
cgcgggggctcacgcctgtaatccgtggaaaagaactgagagtccaggccgggcgcagtggctcaggcctgtaatcccagcactttgggaggccgaggcgggcggatcaccaggtcaggagatcgagaccatggtgaaaccccgtctctactaaaaatacaaaaaattagctgggcatggtggcgggcgcctgtggtcccagctactccggaggctgaggcaggagaatggcgtgaacccgggaggtggagcttgcagtgagctgagattgcgccactgcactccagcctgggcgacagagcgagactccgtctcaaaaaaaacacaacacagcgcatcgcagccgtctgggaacatacacccccacgtcacagggccacccgccatctctcacaagggcgggctcaaaccccttccacgtgtggccaagcactagctccccacgacaacatggtgcttcggcacacctgggactctcccacttcgcccaaacgcaatctcagcgcccgaaaccccctcgttataccattttacccttaattcaccaccaaacattacccacaaaccttgccccacacacccctaatatgttcacgccagcctaaaaccccaaacttctttcaccaagaaaccatcggcagtcactcttcctgaacccttcgaaccaatgagggagttcccccttggggcccacacacgatacaaaacgtttgaagcaacccacccaaaactcgtatctataaacccaacgctctttcaaccaacgcttaaaacctctgtggcccctcacagcgatggcctcaggaagtgttgactggacaccctggggcaggcgcgacgaacccttggacattaaatcccgatcgagagacccgggggttgagaaataaaagggcctgaacatgggacacgacacgagacccacaacacaaacgcagcagcgcggtgcgcgcgtgcgccccgcaagcgcctgcaaaacccagcggcgcggcccacagggagggaacctggacagcggcgccagaggc

SEQ ID NO: 537480 - DNA, 1468 bp, Homo sapiens
agcggggttgttactctgggaggactgtatgctcagaagagagggaggacgtaaggggagaatgtggtgagttggtaggaaggaagtggttgatcttagtacaatctaaagtgtgtgatcggatgcgggtgagagaattgtgaagctaatgtaaatcgaactatagtgtttgacttgacgaaagggacgtgctagctgacaacgtggatcacttctttgtctattacatgcaacgaatgtgactagttctagtagacctggcagactgagatatcatgttcatctctctaaaaaaaaaatggtcctgtgcttgcattgtcaattcctgggaaggaatgagttttactcagataagcatagaagttagataccaagtcgtagaccggataaggatatcgacgggttttgggcactgcttttttggggataaaacaattactctcattgtgggtagaggaacaattgcaagcaacaagatagcaatgttccctggtgcctcactcttagagttagtcttatctatgggacaccgcaaaagcgaatcgatcttctcatttctaaccggttaaatgtgtcgaatatggctatagagacaaaaggcgcatatttttaagtttctaccatcagggctttggagattcgatttacacggaaaatgtaggagttccgaataacagggcacaaaaatttggtgagactaccggttatacaggtgaaaattaaatggggacgggaatgggctctttttaacgcattagggcgcgttggtgcgcagctgtgaagcccttcataggaatttaagcgttttcaacgggtctgaagcagttatactatggttattggccacccatattttatggtgttgtgcgggaccctcggcaacagcgagctatagcgtagcttcaaactctggtaacatgttgtttggggtggtaaacacaatcgcttgttgggccaccttcgagatgtacctaggccttggctgtaattcttgggggaacctcttcatatgtgcggcactttggcaagtccgcgaatgtacctctttgcacaccacaggccggcgtctacgccaatcccggggcatcgccattcgccacgcgctcccggcgaaaatcccctcgtgggccgggcggatcacttcaccgtctaccatactggaccccgggcgaccaatggcctggaccatcccttgcccaaccggagggacagcgctaccttcaacggtggccttggaacactccggccacgtacatcgtcgcttgaaaccggcacctcaacggccgcgctacacaccactttgcggtggcgccaaccccacgcaagtctggccaccccggcggccagcttggcacgatgtaccggggctcataccaccaaactccgtacacttcgccgcgtcacaccctcgttgggcccctcgaggcgaaccactcgcctgtgcacctctacgcatccgacgtacatc

SEQ ID NO: 537481 - DNA, 200 bp, Homo sapiens
ctagaggatcccggagtcgtgtcgccaatacggacgctcaggcgctgaccatgtgaaggcgcaggcagtgtgcagatgggcactcaggtgacccagggcctcggcgccggttcgcagcctgaatgtcggtgccgaagccgcgcaggaagtcatcgacgaaatccggggcttcagctcgctgatatcaggaacgttgagat

SEQ ID NO: 537482 - DNA, 277 bp, Homo sapiens
ttagaggatcgctgatataaaataaaaggtgtctttaagctaagcataaacttattagagaatctagttagtgttttgttttccacatacatgtaaatagcttaagatcgaataggatcaataaggatatattagttatcaaagtttagtcttcatacttaaaagaatttgtttttaaaaacttaacctaagatgcaaaaaaattagattagctagtcttgaacaaagagttgagttagccgaaaactggcgtatctgaattctagtacagataaga

SEQ ID NO: 537483 - DNA, 1059 bp, Homo sapiens
  misc_feature (926)..(926): n is a, c, g, or t
  misc_feature (1042)..(1042): n is a, c, g, or t
agtcatcctgctcaggttgggcatagtggctcatgcctgtaatctcagcacttgggaagccaaagtgggaggatgcttgagcccaggagttccaaaccatcctgggcaacagagggagacccaaaccatcctgggcaacagagggagaccctgtctctaccaagaaaaaaaaaaaaaaaaaaaaaggttaaaaaaaaaattaggggcccggggggggcccccccagttaggcggagggtggaaggattcccttaaaaccggggagacggaagctgcagggtgagccagtgattcgttgccacggcacttccagtatcggggggacaacagtgggaccctatctcaaaaaaaaaaaaaaaaaggtcctccctcccccaaactaatgggttttggcctttggggcctcaccgagtgcaaacccctccagggaaatacaggaatccccaaagggggtcttataaaaaaccggggacgagcaggggacctcttacacgaggcggcgttgttgttgtgccgttgcaacatgtggatatttatggcccattaaaccagcgggtggcccgggaacttggaacgagggtccccaatttcttttgggacgaccgggggggaaaacagagggtcgcgtgccaaggttcccactccggggcgggggtatccccttttggccccatttgggaaaggccggcatggaagggtggaccctaggggaagagcacctgttgtggcaaaaggagatcccttgttaacgtgtcggcggggcctcttcaaaagaattagaggtagccaccttttggggttgggggagatttgggggagaaaattcatgaagagctcttgtggccaagtattgcacaattcttttgtggtgatcttgaaggaacggcagggatatgcttgagaaagctcatattaatgggcatttnggcgacctcaaaggagaagtcttgaggtatagtatctctattgataggtacagagagatttctttagcgtcttaatattttagtggaccgatgtattaggttcaaagaaaattgtnggataaggtgattgaga

SEQ ID NO: 537484 - DNA, 138 bp, Homo sapiens
acatgagaccccgtactgagttgctgaagaagatactaaaccaggctgctcgtgtgttgcgtatacgccggctgaacgtgagaaggatggatcgtaaagacagtctgttgtgctgctattgaaacttctaaaactagg

SEQ ID NO: 537485 - DNA, 205 bp, Homo sapiens
gggtgctctagaggtcccatgtatccccaacactaggctacattcataaacttagcccttctccatgagatacaagcagaaaagaataaagtcattagctagacgattctaaaagtcaccacagtctattcacaggaaatcatcatgccaaaaggtgtagggagacactcatatgaggggaggtggagaattgtgttgggcgata

SEQ ID NO: 537486 - DNA, 347 bp, Homo sapiens
cgtagatactaaaagatctgtattttcctaagctaagtacaagatgctgcagggaagtgcgactgctcagaaggattctgatcctgaaccaaaagaggtagtcgatatatcatcagattccgcatcctcatcatcatcagattctgatgatgatatacccataggactcctttatcgtaaaccaataaaaatccatccaagatcaaacaagaacaaaaaaaagccctctcagtcaagctctaatgaacaagttggtcatataatcactcagaagctaggagaaatggctgagtagagagacggcattcattgatagtatcctcagccataaaaccagacaatttccg

SEQ ID NO: 537487 - DNA, 342 bp, Homo sapiens
  misc_feature (64)..(64): n is a, c, g, or t
  misc_feature (71)..(71): n is a, c, g, or t
  misc_feature (100)..(100): n is a, c, g, or t
  misc_feature (115)..(115): n is a, c, g, or t
  misc_feature (138)..(138): n is a, c, g, or t
  misc_feature (149)..(149): n is a, c, g, or t
  misc_feature (163)..(163): n is a, c, g, or t
  misc_feature (174)..(174): n is a, c, g, or t
  misc_feature (182)..(182): n is a, c, g, or t
  misc_feature (203)..(203): n is a, c, g, or t
  misc_feature (217)..(217): n is a, c, g, or t
  misc_feature (221)..(221): n is a, c, g, or t
  misc_feature (225)..(226): n is a, c, g, or t
  misc_feature (233)..(233): n is a, c, g, or t
  misc_feature (248)..(248): n is a, c, g, or t
  misc_feature (285)..(285): n is a, c, g, or t
  misc_feature (295)..(295): n is a, c, g, or t
  misc_feature (297)..(297): n is a, c, g, or t
  misc_feature (311)..(311): n is a, c, g, or t
  misc_feature (332)..(332): n is a, c, g, or t
  misc_feature (338)..(338): n is a, c, g, or t
aagcgggtggcagctccaaagcattggatgctggataaattgaccggtgtgtttgctcctcgtncatccancggtccccacaagttgaagagagtgtctncccctcatcattttnctgaggaacagacttaagtatgncctgacaggangatgaagtaaagangatttgcatgnagcggttnattaaaatcgatggcaaggtncgaactgatataanctancctnnatggatncatggatgtcatcanacattgacaagacgggagagaatttacgtctgatctntgacacaagngncgtttgttgtaaancgtattacaactgagggggcnagtacnagtt

SEQ ID NO: 537488 - DNA, 275 bp, Homo sapiens
  misc_feature (21)..(21): n is a, c, g, or t
  misc_feature (34)..(34): n is a, c, g, or t
  misc_feature (53)..(53): n is a, c, g, or t
  misc_feature (79)..(79): n is a, c, g, or t
  misc_feature (249)..(249): n is a, c, g, or t
atgacgacgcagaaaggagantctacgagcagangaacgggcctgtggaaggngcctcccgcaggagaacggcgccagngggatcctccgggacattgcgagagccaagagagaacatccagaaatccctgctggaagctcaggccccggggcctccaagcggaccagcggagaccacggggagctcgcggccggattgcaagctggaaggggagaaccagaagctgcggggcgggggacaggagctgnaagaaggccatctcaaagctggaggg

SEQ ID NO: 537489 - DNA, 341 bp, Homo sapiens
cgccagtgtttccggcagttccgttaccagaatggggggggtccccgggaggctttccggcaattgggggagttttccccccaggggttggggcttgccttccgccccaaggaccagtttgtggaaattttggtccaaaaccagttgttccccttcctgcccaagggggttggggcccgggggttccccccccgccgggttgggggcttccttggttgaccggtggagttggggggggccagggcggggcgttttgtggggattggggccatgttggggccggggggcttgagcttgggccccccccccgtgttaataaaaaatgggttttggcggcccca

SEQ ID NO: 537490 - DNA, 607 bp, Homo sapiens
ccttgctcaagaggttgtgcgcccccctgggcattgccccacaaagtacggggtgccccaagacccgcggggacataatcttctatggggccccccttttggagagggacgacattatctagctcttacaagatattctcttgtccccaatttcaccggtggtctttctttcaacaacaatacaagaagagggcccacacatgctaatgggagcacccgccgtaggaataataaccgcacttgttatttgaaacacacagcaccctcagtcacccaggagcaataccaatcatctctcattatataccagtcgtcacattagagatttctgttcatcacggcccacgcacttattaatattcaccacacactgaccactgctaccagctcataacataaagataataaaatttttctcacacatttatattttaaaccccctactttttcattgtgcgtgtaggggggcaccgagcaaacatgacgcgtctgtgcaggggcgtacacatactcatgttcgatcctctactgatactgatgggctattcttatcaaaaagaatttttgtccggggcgtcccccgggtgcaatcagaagaccacgaaga

SEQ ID NO: 537491 - DNA, 153 bp, Homo sapiens
acgacagatcccaagatgtatttccatcacgtgacggacagatcttctcggaaacatgaattgttctacaagaggtatccggccctcgcacttaaccgttggtctgtcatgtatctcgtgtcggactccgctgcccaaaccagggctatgaag

SEQ ID NO: 537492 - DNA, 209 bp, Homo sapiens
ctttcgttgctgtatagcgccatcatgggtcgcatgcatgctcccgggaaggggcctgtccagtcggtttaacctatcgacgcagcgttcccacttgggttgaaggtgacatctggacgacgtgaaaggagccagatttaacaaaactgggccaagaaggggccttactcccttcaccagatctggtgtaatccctggagaggatttca

SEQ ID NO: 537493 - DNA, 743 bp, Homo sapiens
  misc_feature (20)..(20): n is a, c, g, or t
  misc_feature (528)..(528): n is a, c, g, or t
  misc_feature (545)..(545): n is a, c, g, or t
  misc_feature (547)..(547): n is a, c, g, or t
  misc_feature (568)..(568): n is a, c, g, or t
  misc_feature (644)..(644): n is a, c, g, or t
  misc_feature (662)..(662): n is a, c, g, or t
  misc_feature (673)..(674): n is a, c, g, or t
  misc_feature (680)..(680): n is a, c, g, or t
  misc_feature (697)..(697): n is a, c, g, or t
  misc_feature (701)..(701): n is a, c, g, or t
  misc_feature (708)..(708): n is a, c, g, or t
  misc_feature (710)..(710): n is a, c, g, or t
gcagaacaagcccgacagtnggttgatgctaacagcacgatcacttcagcgttacacacgctttttctccagcgttggcgtttaagtctgatcggtgcaagcaacgacgttaacatcaacagctattagaagaagaacgcgaacaactgttgagtgaagttctaggaacgcatgacgctgagcggacaacttgaaccgattctcgcagataacaatactgcagctggtcgtctgtgggatatgagcgccggtcagcttaaacgtggcgactatcagttgattgtgaaatacggtgaatttcttaacgaacagccggaactgaaacgcctggcagagcagctggggcgttctcgggaagccaaatcaataccgcgcaacgatgcgcagatggaaaccttccgcaccatggtgcgcgaaccggcgacggttcctgagcaggttgatggtctgcaacaaagcgatgatattttacgtctcctgccgccagaactggcgacactagggataacggaactggagtatgagttnaaccgtcggctggtggnanaaaccagttggctcacctatncgcctgcacggtgagtcgtggcgtgacaaagtgatcgaacgttccggatggtacataaacgattacgatgaacagncgcgcgggccgcatcatngtctgtgtggnntacttnccggctcaatgggcggncttnaatgaancngtgtgcgaaagcggtctggctggcctgatgcgc

SEQ ID NO: 537494 - DNA, 966 bp, Homo sapiens
tgggttttacgggtttccccaggggatccgggaaaaaaaaccccgggtttttggcctgtcccccgagggtggttaaaaaagaatttcggccacttaagagaggaaaattatcaaaccattttctatcaaaacaaagggtccacaggaaatataagaatgccgcatcaaaaagaggagggggtccggtcccattcacgtgggtggatttggttactctccccgcgtgcgctcaaagtgggcagcggctctccaagtgcgggtgttcccgcagggcgacaaagaagtcgcccggagaccccacctgcgtggaaaaaacacagcggagaggggggtccctgcggttaatagagcgccgcagaaaaattagttctccgaacggcgtggtggggacaccgcgggcccggagggagaaaatccgcgagaagggttttgtggagacagactctcctcctctccgcggggggggagtggagctctcatccgcgggtggatggagtgtgttccccgcagagagtgtgtgttcccccgtttggtggcgccacagcaattttttaaaacaaacaaaagaggttgtggagattagaaacacccggtttaagccacctcgagaatagaggaggggacaaacagcgtggcgacagtgggggtgaaaaagcacgatgtagagtgacacacaccgccaagacaacccgtgaaggaggcccacccccgacaaaaacctctgggggggcgcagaggggagacaacacccccccgtgagaggaagagacggagaaacaggggtgagaaaacggcccccccgtgtgggtgcaaaacccccccacagcggggcaaactctcttctcccggggaggaacaccccagggggcccctcggtgagaaaccccccctttaaatacatcgctacaagcagcacatggggagggataggccccgtggaagagagatggacgataaagaatgtaa

SEQ ID NO: 537495 - DNA, 921 bp, Homo sapiens
  misc_feature (274)..(274): n is a, c, g, or t
gaggctgtggccgttgcgttctcttggctaaaatcgggggagtgaggcgggccggcgcggtgcgacaccgggctccggaagccactgtcacaaaggggctggagctgacctgaaacaaaatgtctggatttctacagggcttgagatgctcagaatgcattgacttggggggaaaagcgcaatactgagttgcttccgattgcctgcttggttgtactcattgtcttggtacaagggctaggattgggactctagtcgatacgtatggcagacntggtatactcttaatcgcacactcgagtgaagaagatcttcacaccagcctcgagtaccgatgcactgtggatgttataggcgaaccatagccttcctaatgattaactgcagtatcgaatggacaagtccgaggtgatagttacagtgaaggttgtctgggtcaaagcaggtgctcgcagtttggactcttgcgtaggttatcatgatcggccctttggcatctctgattgcatctatgtggcattcttatataggagcgttatgtttgctcacaagataacaagacattacgtcataccctggcaattcgcttgtacttttgccgagtaatgcctctcgatctttctcttggcagggcatggttataatacagtatctggcaggaactgaaagacttcatggcagtgatacacatcgtgatttccgcacgaggcaccaatgagtccctggcaagtgggctatggtggagaacgttttgactgcatcactcccagaccattagtgtacatgccatatttcgtaaagcttatggtctggagcgtaagtctcagcttcagcagttgtgtaatacgtaacatccacgagaacaacctaagagaacaatcaaaaattctatggtggtatgcggcttgatttggtttatga

SEQ ID NO: 537496 - DNA, 1181 bp, Homo sapiens
  misc_feature (9)..(9): n is a, c, g, or t
  misc_feature (22)..(22): n is a, c, g, or t
  misc_feature (37)..(37): n is a, c, g, or t
  misc_feature (53)..(53): n is a, c, g, or t
  misc_feature (66)..(66): n is a, c, g, or t
  misc_feature (120)..(120): n is a, c, g, or t
  misc_feature (151)..(152): n is a, c, g, or t
  misc_feature (208)..(208): n is a, c, g, or t
  misc_feature (567)..(567): n is a, c, g, or t
actctactngcccctaatccgntttaaaattctcagngttccctagtggttcngcatactttatgngagtgctatagctgtaccattaccactttatttgctgttggtgtttcgtgactntggtaattcggcattagaaacctttcacttnncttcaaaacgtagttatattttggagttttcatttgatatataattatttattttncccttttatttcccaaagacattgtaagggttaattagatcattatattttattattacagattaaagttgggcagtaatcttaattatgatggaattatcattatgctaagtaattaactttacctagtttgttttacaactagaacctgccctaaatgttgaatatcttcctagcaagaaacagtctgtcattttacttacacgatgtctaaccaaaccataactttacataaactagtcgtttcggtcaaatagaaaaatgtgtgaatgccataaaaacaaaaattctcagttaaatgatactgggaaatagggaagacagcaaagtgagacttgggctcaggatggttcaggaanaaaaaaaaagaaagacccctgagtaccattaatattcctcagaaattattatttcaaaaggaaatatttctgtattataaatttttcatgagcagccattatgaaatctcacaagaatcatagaattcaataaaaaaggtagaaagtaattttagatacttaaacactataaattaaacataaacatttctaaaatcataagcacataaatagaacttaccaggccagaaacgcaaaagctgaaggcaaccatatctatcctgttcaaaaatgtgaaacccaggatgatctctagaatgagatgcgcatgaatagagaggagagaaaaacaaaaaaaaaaacacaaacaaccacaaaaaagaacaaaacaaacaccaaaccaagataacaccggaacgataaacagcagaaacagagaaaaaacataagaccatataagccgggaaactaaataaacacaaaaacacgaaaagaagctaaaacaagggaaacaagcctaagaaaaaagcgagaacagaagtagaaaacaggaaaaaaagcggaaaaacacaagaaacaacaacgagatatagaaaacaagcgaataaagagaaaaaaacaggaaaaagaacaat

SEQ ID NO: 537497 - DNA, 522 bp, Homo sapiens
agacggcgacagcgacgacggcagcgatggctggtgtgctggtggccagccccgtggactcccgggtgcagtgagtgacccgtggtcccgggtcctggcgctggcatcccggtgcaaaatgcggctgaggaacgcttgaagtgaaatggagtgcggagatggccctgtttgagcagtgaatgttctggtgggctccagtacctggaatcccaactgctgtgcctgcggtgcccactgtccccacggtccccacatgtagaagctgatgcatggtcccagctgtgctcctgtgatcctgcccaattatctgctgaccaacacataccagcatgtgtccatgcagactctgtgagtgccctgagcatgctgctgcagccacatgtagtttcctcccatggctgggtgtgccctcctttttgtagtgccctagatggcttttggcccttggtgatctggagtcaccttggacatgcccagatggctcgagaatgccatgttccttgcggctgggcagctgtgagc

SEQ ID NO: 537498 - DNA, 336 bp, Homo sapiens
gccttttttttttttaaataaaaatttttttttttggtttttcccctttaaaagggcccagggttttttggcaaactttttttttattaaaccttttttcaaaaccggtttaccggaccaggtttttttggggccaaaggttttttttttgagggctttttttttttttcccccattttccccttcaaaaattggggaaattttccccaaaaaatttttaaatggggtaattttaccaaatttttttttttggaaaatttttccggttttcccggaccccctttttttttttttttttttttgggggggggttttcctttttttcccccttgggga

SEQ ID NO: 537499 - DNA, 413 bp, Homo sapiens
  misc_feature (28)..(28): n is a, c, g, or t
  misc_feature (98)..(98): n is a, c, g, or t
  misc_feature (134)..(134): n is a, c, g, or t
  misc_feature (143)..(143): n is a, c, g, or t
  misc_feature (244)..(244): n is a, c, g, or t
cttttttactttttattcatccttgggnttttatttatctaaaatggggattgatttttaggccggttttgaaaaaaaaaagtgttgggaatgaagcnagtgattgattggaaaacatactgaatggaagaaanatttaattnaaaatgaggtaggttgaagttttttttttgaaatgataaataaatggtgaagataaggcttattgtgaggattcagtgaggtaatatatgccaaggacttncaatgttttggcccatagtaattaattaaaaaaatcgagcccccttaattccctaaaaagcagggttgttagttttttggttgacttttgttttgctggggcattttcccatgttttagggtcatttaataaataatagtacccataaaggttaacctttattaagtga

SEQ ID NO: 537500 - DNA, 291 bp, Homo sapiens
  misc_feature (76)..(76): n is a, c, g, or t
  misc_feature (108)..(108): n is a, c, g, or t
  misc_feature (113)..(113): n is a, c, g, or t
cctctgtccccagagatgatgctgcgcgttggagctttcctgcttttttcccgttttccagatttccttataagcnatttgacttcacagcgtgacctttttatatanatttnatatctggtatttgtttagaccttagaagtgttctgaggccgggcgtgtggctcatgcctgtaatcccagcactttgggtggctgaggtggacggatcacctgaggtcaggagtttgagaccatcctggctaacgtggtgaaaccccgtccctactaaaaataacaaaattagccggg

SEQ ID NO: 537501 - DNA, 438 bp, Homo sapiens
cagtgtcagagaaatcagtaaaaacaaaaggtaaaataagagccagaggcgtcgccacggccgagactctgtctaaaaaaataaataaggagccagtgtctcataacataacacagttgtgtccagaattcaataagaaatcactcaacatatagtcatgtgccacattacctatgtagggggtcaatgagagcccaggttaatgatgcgaaatctgtaagactataaacccatatttttaccattccatttgcggtgctaaattattgtcagatatccaaatacttaccatggcccgggcgcggtgcactcatgccttgataatcccagacacttgggcacggctgaggaggtataaaagagtcataagaggctggcaccaggggtaccacacgctgtaatcccagtacttgggcaggctgaggagggggaatcctc

SEQ ID NO: 537502 - DNA, 242 bp, Homo sapiens
aaaacaaatagcctcatcatccccaccatctagccccctccccctcccttatcctcttcttcttacctcgccttaatcttactccaccttcaatcacacttactcccctatatatctaacacacgttaaaatataaatatgacagtttgtaacatataataatcccactcccattcctccctcacactcatactccttaccacgctactcctacctatctcccttttatactataatcttat

SEQ ID NO: 537503 - DNA, 392 bp, Homo sapiens
agcccgagttccctgatggaaagatgatggaagtcctcatttaactgccatccctgtggaatttcagtacagaaccctgacaaacaaggaaagcggcaaagaaaaaagaaagccctaaaaggttgtaaatgggaaatcaggaatgatttgaactgataaagatttcagactcataagaacccattttataaatgttaaacccaaaaactacatgactgaaaataaaaaaaaatgcgatggattttattacacatggtggaaaaaaaaaaaggggtgtaggtttgcaaacaaagttaaaaaataggaaactgaatttttcattgtacaaaaaatgtattttttggggagggcctgggtacccccattttttgattataaccagattaccccca

SEQ ID NO: 537504 - DNA, 192 bp, Homo sapiens
tttaagggggggccccccctttttttttaaaaaacaaaaaatttaccgggggggggggggggggcctccctttccccctttttaggggggttgggcgggggaatggggtttcccttgggggcaaggttttcctttaacccaaatggggcccctcccctcccgcctggggggcaggggggggctccttttcca

SEQ ID NO: 537505 - DNA, 896 bp, Homo sapiens
ggttccttccggggttcttgggctgagaactgaatggcttgagagagctcggtggaagctgataagagtgcggacgagcagtggagctcatggctgagttatctcgtatgcgcatcatttccactctcactcctatactctgagcaaaccgttgattaaccagcccactagtctgggataccacgccattgctgccagctggtcgacagacctttatcagggacccatacaaacggcatgccgctgattcccagtgagtgtgtgactccgtgtattactatatgacttcgtatccatctgggctcctacatacgacttctagaaggaaaaacaagggaggagtgttgccgtatggcttttccataggaatggcctaacaagaactaggcatcagagagacaaccaggatctttggcagccgcaaactggaacagagaaatcgcgaagcttggaattgagaggaaaattgtacgctgcaaaacatagtcggaccagacccaccagggttaaccccctgtcccaggctcaggaattttcaactggagaaggccaaggtatcgcggggggactaatgatggccttctctgttgacaggccaggagacacacataatgcacggtgtattgccgttctttaaggccttgaacatgcccgccagcttgggttccaataggacagccagcaagttgcaaggcaaaaggcagcaagcgatgaacccttaagcactggttggcttgaaagcattcctggaaaaaatgaagtctcccaatgtgctttttaattaagaattaggcagaattaaggtttgtgcttcaaagagaaaattagggttaagtggttggaacatcatagattcagtggggtaacacatgcaaacatttcaaaatggaataaaa

SEQ ID NO: 537506 - DNA, 168 bp, Homo sapiens
caagggtactaagcaaagagataaacgaaaactccacacctcagccctagagtcatagcatcatttttgaatagtgaccattagtgtacagacttgggcttagaacttctgcaagggtcttttctcattattaaaaagaaaagaaaaggagttcccgtcgtggcgcag

SEQ ID NO: 537507 - DNA, 132 bp, Homo sapiens
  misc_feature (31)..(31): n is a, c, g, or t
  misc_feature (104)..(104): n is a, c, g, or t
  misc_feature (106)..(107): n is a, c, g, or t
  misc_feature (116)..(116): n is a, c, g, or t
  misc_feature (124)..(124): n is a, c, g, or t
gatccagaggcgagaagccaccctgttaganctcctgtccatcatccaggtaagtcaactctctcctttcagggccaatccccagaccttttgttgagccaggncnntatcacctntcctactnacttaaag

SEQ ID NO: 537508 - DNA, 133 bp, Homo sapiens
ggtaagctatcacagacaacaacattaacctactgctgttttatcattttttcttggttttggctctcagcagtgtactatgacttgctaggtgtggttttctatttgccttattggggttagggtggtatag

SEQ ID NO: 537509 - DNA, 1518 bp, Homo sapiens
gggggtgaaaatgacagatttattcaatttaaagggtcaccgaggctacagaagaaaccaaggcgtggttccaaataggcaagccacctacgtggtcagccagcaacattaccattttattttctttcaacgagcattcgtgagcccctcgaggggttatagtgttttccatataaaacaaaaattatctttatttaagcccgagtgtgtgggacacccgcgtgttctacagaggcacaattttataagatgtggcccaagtgtgtacaaaacaaatttctcacgcgtggaacaattcacaattctacaaattcacaagtgtggctatgtgcgagccccactgtggatacagaacacacacagcgtggactataagttatactctcgagacattaatcacatatagacacacagagacaaccttatagagagtgcccgtaccaatataagagcaccaaacatgagtcagagaccatctttatacacacacactgcgtgagacataaaactctctccgcaaagtatctcaaagaaaaagacaagacgcgctctatattctccctgtgtcccgcagagaaactctttctcaaagtggcgctctctgtgaaacaccacactctgtagctctatatagccgttgagcgagcagagagaggctctgtgtctcctcaaaacgccgcgggtagacgcggcggctatacacgagggaaggatatcatcgatgggaccaccaccacctaccacactatgtcgccccagaacgtagacacgctctctataaccacccacaaaacgcccgcaggaaagaagagagacacaccacacgaggggctgtaaccacagggtaggcgaaagcatagagagaagtgtcagcaagcggggcggagaaccacagagacgacgcggacactacaccgggtggaatacacaaaaaaggtgtcgcacacgaccacaaggggagcccttccaacacaacggcgggggcggcatcagagcacaagccgaatgagagaaagccactaacgacaaagggctccctaccagcacaacacacaaataaactaccgaaggagcaccaccccgatggcgccgcccccatgtgtcacacagcacaacaacacaccaaaggaggaagaaacgaagcgaaagaacaaaccgtacggcctacaaacacacgacttttaataaccgaaacaacaaaacataccacatgtttataccactcgtcggggaccacaaccacacctggttgctgttgccaaaccaattactaaaccaagaaatttatattcacaaccaaagaccgtagcagcttatggtaggacgacataccaaccatcccctgcgtggtcgcccatacaacaaattaatgaaaagtcacccacgacaaagagaagactgctactccaaactacacgacggtggtgagcatagtactacaagaccgtacacacgagtatattggtaggagacagctcaccacacaccacacgagatcccccaccacaagtagtgagt

SEQ ID NO: 537510 - DNA, 226 bp, Homo sapiens
ctgtccgtcgttttacactggccgttgttttacactggccgatgtttttctattctcctcttttttcattgtctttttcttttacatttttttttctttttcaccttttttattttaattttttttcttctttttctttatatttttcttctcttttttttctctttttatactattttctttctattctggacttctctcttttattctcccttttccttctttc

SEQ ID NO: 537511 - DNA, 263 bp, Homo sapiens
agctggtactacaggcgtgtgccaccatgcctggctaatggtcatagtttttgttaggacagcggctcactatgctgccaaggctgatctgcaccttttggcctcaagcgatcctcctgctttggccttgtgtttacagatgcattggtgcccgacctcctagaacatcatcgtgtgatgatctgttgcgtgagtggtcttgcctatgagacatatatgagcatcgagtgtgagcatttagcagaactgcagtgttctttctc

SEQ ID NO: 537512 - DNA, 302 bp, Homo sapiens
gagtgcagtggcgggatctcggctcactgcaagctccgcctcccgggttcacgccattctcccgcctcagcctcccaagtagctgggaccacaggcgcccgccactacgcccggttaattttttgtattattagtagagacggggtttcaccgttttagccgggatggtctcgatctcctgacctcgtcatccgcccgcctcggcctcccaaagtgctgggattacaggcgtgagccaccgcgcccggccaccaacgaggattttgaacaagtctatgcatagagtagggcccattgtagac

SEQ ID NO: 537513 - DNA, 329 bp, Homo sapiens
  misc_feature (14)..(14): n is a, c, g, or t
  misc_feature (41)..(41): n is a, c, g, or t
  misc_feature (65)..(65): n is a, c, g, or t
  misc_feature (285)..(285): n is a, c, g, or t
cccaaactgaagcncctagcctaaaaatagggcccccaggncagatgcctagtttcccatagganacaccgaccctgtgtcaaagtcaagttcacccatggctcctggcagcaccccagaagttacccaccctcacccctggaaatgtctgcataaactgccccttcatttgcatataattaaaagtggatacaaataccactgcagaactgcctctgagctgctactgtgggcgcacagcctgtagggcagccctgctttgcaaggagcagcgcctactgctgnctgctgtgcacagccggccgcttcaataaaagttgctaacatcc

SEQ ID NO: 537514 - DNA, 246 bp, Homo sapiens
aacgctcgaaaagggggaacggcagacggaacttaagcgctaatttgcactgataaaataagataggatcactagtataccaggatgttaatctttatgtgaaaaatcttgtattattgtctttattatgaacgtctccggaaagagttttctccattttgtacaatcactagttctgatggttattattgacggttgtcgctgcagagggtttggttttgtatgtttctgggtaccgatgctcga

SEQ ID NO: 537515 - DNA, 256 bp, Homo sapiens
tttttcatttaaacaggaaaattagggtttcccaaggcatcaatcttagccataatctataaatcaaagctgctatataattcccatggcttaacttttaaaatgacattacccctttccatttagaatgtcctagaagcacaattaagccaagaaagtttccagatatatggctgtatagtatggctgttaatactgtatgaccttcactgaggaggtggccataaaatacaaccctttaaaatttgaaaaacca

SEQ ID NO: 537516 - DNA, 332 bp, Homo sapiens
gctctcaggatccgaaactgacatgaggcaggtgataagtattaggtagtgtaaatagtctatgatgctgctcatgcgtgtaatcctctacttattgtctcacaactcttcatatctatgtcgtttatgtattttgatatcagtctgttcaatatggaagaaagcccgtctccaccaccccccagaagagattagtcgggggtggtggcgtgtgcctgtagttccagctactcgggaggccgaggcatgcgcagtgcttgaatctgggaggcggaggttgccgtgagccacgatcatgcgactgcgcttcagcctgggcaacagaatgagac

SEQ ID NO: 537517 - DNA, 411 bp, Homo sapiens
tgttgaaatcgacggaaccatacaccaggtgtatgtgctgaagcgacctcacgtggacgagttcctccagaggatggggcagctctttgagtgtgtgctctttactgccagcttggcaagtatgcagaccctgttgccgacctcctggaccagctggggtgtgttccgggcccgactcttcagagaatcctgcgtgttccaccgtgggaactatgtgaaggacttgaagtcgcctgggacgggaagctgagcaaaagtgatcatcgtggacaattctcctgcctccctacatcttccatccttgaagaatgcaagtgcccgtgcagtcctggttttgacgacatgacaagacacggaagcttgtttggacctcatcccgttcttcgaggggcctgagcaggggaagacgat

SEQ ID NO: 537518 - DNA, 887 bp, Homo sapiens
tcgatggcgtgtgaaaaagttgagaagcctcatactaacagagaacaaacccgtaagccgagtaaggttgatgctggtgagcaacggctgaggaaagagtgtaacctcaagagtcgtaataaagcccgagaaggggagaggccactcgagttggcagcacgccacatcgcctggtaactgtgtctagaggaatcggcacggatattcccgagtctgtcactgctacttccagaaaaggaccactggtacacagaggaagctacatcagtgcgcgtatgaatccacaggttgatgaaagacaacagaacgagtaaggttctcgcaatgtgtttacaaaacccagtcttgggtggttgagaagaatcggcggttacccgtggtgggttacacaacttcgcaaaagtgcctagcatattactctcgtagcatgagagatgtgcgctcgaagagctgttgtatgccaccgtggcaaaaaaagtcgcttccagttcagcgaccgatgaaagtagatacatcatgttgagcccgagcagttacccccgggacgcactctctgactcatccctcaacgttgggacagcccaacagggcgcacaagaggggttgggtctttccttgaagcagacatggcgtagtggcttattacttgtgacgtggaccgtcatggtccgtgcaatcgaggttcctcgtacgaagaacacaccagaaatttgtcattgccaatttgaccaaagagtcgatatcagcaatggtaaaaatccccaagaaatcttactgagtgcttacgttcaaggaagcaagaaaggtgggggaaagacccaaggatggcccaaggaaaggggggagaaatcctttcgaccccggaaaaagaggaggaaaatatttga

SEQ ID NO: 537519 - DNA, 403 bp, Homo sapiens
tgaacggcccggagtagtctttccctcctgaatgccgccactccgcagtccagagtatttgaagatcaagctgaaattgagagactgacgagagtggtccctttttgttcctaacagatttcttgcgacaaggaaaccggcagtcttccgcttccggttgctgttgcatagtaacgcacccataacagccgtggtggttatgctggctgagcggcgagatcccgacggagttcacgcggtcgttccgctcatcgaatgcacgctacgcgaggcgtgactgtggcggagatgacggaccctaggaccgcgccgcctgtcgctgctaggctactgctactaccgcctgcaggagttcgcgctggcgccgagtgctatgagcagctgggccagctgacccggaact

SEQ ID NO: 537520 - DNA, 389 bp, Homo sapiens
gggagtgggtctgtccaaaaggatgccccccatggtgtcccgggcaaaatggaaaagtttccattgttccccaccacgctgttggccttgttgttaccccacagttaagggcaaattttttccccaaaaaatttttgggggttttgggccccttaacccctttaaaaacccgaatagtttccttaaccggtttaggggaattgttcccaaaaaaaaaaaaccccaaaaaaaagggtcctgggtttcattaaaggccccccctccccccccccaaaaagcccccttttttaaaacccatgggaaggggccttagcttttgggcccttttcccttttattttttggcctttttgggttttaaaaaaaaaataaaggccctttggggcccca

SEQ ID NO: 537521 - DNA, 416 bp, Homo sapiens
aaccggccccaattatagcctcggctcccaaagtgctggagattacaggcttgagcaccgcgccggatatatttaatcttttatctatatttacttatgacatttaccaatcaccaagcttgcaacaaacactgctttagacactggggacacaaaggggacaagagccatcctcctttgacacctggtcttcagattctgtgcccaacgtatatagttttgacaatgaccaggttggactgtttaatgtctttcaacttaccacgtaatcctcttgtagggatcacatctttcttatatgatattgtatttctctacctctaacagtaaaaattccattcaacccttaaagctcacttcaaattcttctttgagaagtttttcctttctccgcaaccagatgtacatatttgaac

SEQ ID NO: 537522 - DNA, 274 bp, Homo sapiens
cacgccatgtccacgaattagtgattcagggcataaaatactgcattaaaaggcgtgtatcagatacaggatgaagattcagaaggtgcttagtggcatacttaggatgcttagtctgtcgtgtattgacccacctcaacaaaagcgataactctgatgattccaggagaagagtatgataattttagacccatctcaactctgagcatccttagaacggaatgtctattcagggtggggctccagtgatttcatctgaaggatgctcagagtt

SEQ ID NO: 537523 - DNA, 293 bp, Homo sapiens
gatcgggaccgcggcggcgtcccgcgagcgggatgttccggggcttgagcaattggttggggttgcagcaacctgtggcaggcggtgggcatcccaatggagatgctccacccgagcagccgtccgagacggtgtctgagtatgcggaggaggagctgcagcaagcgggagaccaggagctcctcctccaggccaaagatttcgggaactatttatttaactttgcatttgctcccacaaaaaagataactgactcagttgctgtaacagcacaaacaataaagaaatccgta

SEQ ID NO: 537524 - DNA, 692 bp, Homo sapiens
attcggcacgagattaactcgtcatttagcattaggtatatctcctaatgctatccctcccccttccccttccagcatctgttgtttcctgactttttaatgatcgccattctaactggtgtgagatggtatctcattgtggttttgatttgcatttctctgatggccagtgatgatgagcattttttcatgtgtcttttggctgcatacatgtcttcttttgagaagtgtctgttgatatccttcacccactttttgatggggttttttttcttgtaaatttgtttgaattctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaataccaaagggtttcttctaagggttttatggttttaggtctaccgttaaatctttaatccatctgattaatttttgataaggggtaaggaaggatccagttcagcttttacatatgggtagcagttttccagcaccattatttagggtcgtttccccatttctcgtttttgcggtttgtct

SEQ ID NO: 537525 - DNA, 948 bp, Homo sapiens
  misc_feature (150)..(150): n is a, c, g, or t
  misc_feature (193)..(193): n is a, c, g, or t
  misc_feature (195)..(195): n is a, c, g, or t
  misc_feature (216)..(216): n is a, c, g, or t
  misc_feature (275)..(275): n is a, c, g, or t
  misc_feature (294)..(294): n is a, c, g, or t
  misc_feature (303)..(305): n is a, c, g, or t
  misc_feature (307)..(309): n is a, c, g, or t
  misc_feature (327)..(327): n is a, c, g, or t
  misc_feature (329)..(329): n is a, c, g, or t
  misc_feature (338)..(338): n is a, c, g, or t
  misc_feature (365)..(365): n is a, c, g, or t
  misc_feature (367)..(367): n is a, c, g, or t
  misc_feature (377)..(377): n is a, c, g, or t
  misc_feature (450)..(450): n is a, c, g, or t
  misc_feature (472)..(472): n is a, c, g, or t
  misc_feature (494)..(496): n is a, c, g, or t
  misc_feature (513)..(513): n is a, c, g, or t
  misc_feature (521)..(521): n is a, c, g, or t
  misc_feature (528)..(528): n is a, c, g, or t
  misc_feature (573)..(573): n is a, c, g, or t
  misc_feature (583)..(584): n is a, c, g, or t
  misc_feature (592)..(594): n is a, c, g, or t
  misc_feature (596)..(596): n is a, c, g, or t
  misc_feature (598)..(598): n is a, c, g, or t
  misc_feature (603)..(603): n is a, c, g, or t
  misc_feature (606)..(606): n is a, c, g, or t
  misc_feature (615)..(615): n is a, c, g, or t
  misc_feature (642)..(642): n is a, c, g, or t
  misc_feature (652)..(652): n is a, c, g, or t
  misc_feature (654)..(654): n is a, c, g, or t
  misc_feature (663)..(664): n is a, c, g, or t
  misc_feature (753)..(753): n is a, c, g, or t
  misc_feature (807)..(807): n is a, c, g, or t
  misc_feature (842)..(842): n is a, c, g, or t
  misc_feature (859)..(859): n is a, c, g, or t
  misc_feature (863)..(863): n is a, c, g, or t
  misc_feature (877)..(877): n is a, c, g, or t
  misc_feature (914)..(914): n is a, c, g, or t
ctgccggggcggcgatctctcagggatctagggtcacctggagagccgcccgccgtctctgcccgctcggctcctccgcccgggccgctcggccggtccagccgcggccggcgcgctggctgtgaggtggattcccggcgcgcagtctgnccagtgctccctccagtttttccacttcgttcggaccttctcntnactatgtccaccctctacgtntcccctcacccagatgccttccccagcctccgagccctcatagccgctcgctatggggnggctggggagggtcccggntggggaggnnntnnntcccgcctctgtctcctncnacccccgtntagcgggcctagctttcccccaccgcngnctgccgtgcnctgtgagcaggggcgccggtgggctctgggtcgtggggggcctacgtgctgtggccagctgctgtggccagcnggtctggggggcccagggggcngccgggcggctgttcttgtccnnnagtgggtcagttacgcnggcacggngtttatnccagctgcctgtggagcatacgctgccggccctgggactccgaanctcggcccannacccccannntntnctggnggnccttggcanggcccggagtcccttggaggagtggcntcggctgcananctacttggnnggggaggccccactctggctgacctggcggctgtcacagccttgctgctgcctttccgatacgtcctagacccacctgcccgccggatntggaataatgtgactcgctggtttgtcacgtgtgtccggcagccagaattccgngccgtgctaggagaagtggttctatactcaggagncaggcctctctctcatnagcnaggccccgaggctnctgccctcccaaagacagctgctcagctcaagaaagngggaaagaaacgggagaagctagagaaattccac

SEQ ID NO: 537526 - DNA, 756 bp, Homo sapiens
  misc_feature (234)..(234): n is a, c, g, or t
  misc_feature (506)..(506): n is a, c, g, or t
  misc_feature (697)..(697): n is a, c, g, or t
cttttaatgagtggagctggaattttatcagggagctatgcatgcatgtcaggggagatcaagtttatggtttccagaatctacactttctttttgagaatgggaacttttgccagtacattgttttcctatcctcatttccataatttctcaacaacagtaagtagttggaaggtcacatttgcaagttttttgaggagcctgggatgtaacttttctggagacttcaacctnctttaaatggtcacatgccccctgtgtccctcactgcctcccttctgctgagctctccccagtcctgggaaggctgattctttagctagagaacccagaccagccctgtggcctcatatttccacatcagccttcttgaatctgtgttcctcccccctcacttatctttttacatcaaacacatggctcaaagcttttgatatttgacttgactcttcaggaccccaagctcctctgactcagccctccaccccccacccctaacccacggnccactctgcttgagggctcccccctcaaactccaccgtaagctccctgagcagccacaaggattttggggtttggtttggttttgcctcttactcccttttcattttccctggcatcattcacattcaccaatcagattcattgttatcatctcctattcctcatgaagacctgaggtgagggggtatctnctcttgtccttctatccatgcctgtatgggttgtctgtggcctaccctctatcttgatc

SEQ ID NO: 537527 - DNA, 887 bp, Homo sapiens
gcggtgggcggtgcttgtagtcccagctactcgggaggctgaggctggaggattgttgacccaggacgtcgaggttgcaatgagccaagatggtgccatgtactccagttgtgttgacaaaatgagaccttgtctcaaacaaaagagtgccattgagatttgatagggatggcgtgactctgtagacttggtgatatggactttaagtgatatttttccttcaagtgcatgattaatggaatgtcttgtattaatgtgtgcttcttaaattttccttcagtgtttaataatttccagtgtaccaagtctttaaaccttcttgtggctaagttatttctacatattgtcaacaatatttttgtggcttgtggtaaacgggagtgtttcttaattgccgtcttcagatagccgtgtgggtacttagaaatgctgtgatttttatatattacgtgtggatccaggcagttttaggtgtattcattttatgagttctaaccagttttctgttgtggtggagttgtaaggttttctacatattatttgttcattgtgtaacacacgctaattttgccttcccgtgtcacctatcgggaggtcccttttaactccccttaaaggtcttcttctcgtggagattcaccgcattacacgtgcgactacggaggtgcaacaccgtggggactcattggctttcgtgatttaaagagaaacgtttcaggtttccctacggttatgcatcatggggggttattttgaacaacgtggcaggatccccatttggaccagcgggggcctgacgacggagtcaaaccacctgtgggattggaccgtctaaaaaaaacccgggggggagccggcccggtggaggagaaatgtccgcgggtgcc

SEQ ID NO: 537528 - DNA, 306 bp, Homo sapiens
ctctcctttcttactcacttctgtcttcagggaagctttctaaaatgtatccctttcggtccatcaacaggatacctgactggggcagtgaaggaggggatgcacagcgttatgtgtaaaaacaagttctgtttacaatcccgggatcgtttgcaatgttactgaatccgttgctacattgtgaaggcttaaatgagtttagatgggaaatagcgttgttatcgccttgggtttaacttatttgatgagttccatttttctcatgtcctacccgaggagaagaggagtttgttaactgggtttcga

SEQ ID NO: 537529 - DNA, 88 bp, Homo sapiens
aaagaggtttattcattctgtcattaggatacaaaatagaacatgtaaaaggcaccccttctgtcgtcaactcgccgccgtatagtag

SEQ ID NO: 537530 - DNA, 240 bp, Homo sapiens
ttcggcgtcgaacgaagaaggctcgctgggcgcgattatcgacatgcaggcctcgcgcccgttcgacttcagcggtccggcgctttcgatgagcgccaaggtcggctggaacgacctgtcgcgtgagaacgacccgcgcttcaccttcctggccagcaaccgctgggacaccggaatcggtgaaatcggcgctctgatctcggtggcctgggccaaacgcaagacgctggaagaaggctc

SEQ ID NO: 537531 - DNA, 333 bp, Homo sapiens
  misc_feature (81)..(82): n is a, c, g, or t
ttcacacactgcccattatgaacaaaggcggtagaaagttcaaaaccagaagatgccctgactgacactgttcaaatttcnncagtgcgccaggcacagtggctcatgcctgtaatcccagcattttgggaggctgaagtgggtggatcacgaggtcatgagattgagaccatccaggccaacatggtgaaacctgtctctactaaaaatacaaaaattagctgggtgtggtggcgcatgcctgtagtcccagctactcgggaggctgaggcaggagaatcgcttgaacatgggaggcagaggttacagtgagccgagatcacgccactgcac

SEQ ID NO: 537532 - DNA, 853 bp, Homo sapiens
atactcgggggtatggtttctggaagtgttcttcattgcctgtgttgctttgtcacttttgtatctgcggtggcttactctattttggtgaatcgtgcccaggttggtaacctaaattattgctgcaggactatgggaagaagtagatattttgccatactgaatgagaagttagaatgaatgtgtcgtgagaatgggcttaatcacatcgttggtttgaaaacttcgcatgtttaaagaattgagagtgtagtctagttagaagagaataggtaatggacttggacacatgttatatttatatccaaatatacctattgcagagtgtatttgtgaggctgttgtagcctgggtcttttggtgatgtgtgtggtaaagaatggctactttgagtaggcgtaagtcaacgatgaaagggttgagaaaattgctgtggaacatccgaggtgaacttgcaggaaagacagtgaagatggaggagttggagcttctgtggagataatcttcattaggtatatatcttgagggatacaggctgtctttatcttataggcaggaagaatcaagttttgagggaacatagaagggctgcgttacgcaagaatttaacaagtggcattgtcatgagtggcttccttttcactagtaaggcataatgtagggaatatgttgaagaatgtttgatgaaggcgtctgggtgatcagaaacataggttggggctaatctgagatttgtgggatggcgaggatgaccttttaattttatttgggtatgaggacctaatattcaggattgttacagataactcgggaggatccattttataagaaaagtttcattattaggggtgaa

SEQ ID NO: 537533 - DNA, 381 bp, Homo sapiens
  misc_feature (1)..(1): n is a, c, g, or t
nccgcctttttttgggggggcaggatcggtggctaacatctgcaatcccagcaacttgggaggtcgaggcaggcgtgagcacatgcgcccggccaagagaagtttttcttaaaatccttttttggggggggcccggatcggtggctaacatctgcaatcccagcaactttgggaggtcgaggcaggcggatcatgaggtcaagcaatcgagaccatcctggccaacatggtgaaacctcatctctattaaaaatacaaaaattagctgagtgtggtagctcacgcctgtaatcctaacacttggggaggccgaggcagacagatcacctgaggtcaggaggcggcgccgaaagcagatggcgctaaaaaaaaggggggccg

SEQ ID NO: 537534 - DNA, 249 bp, Homo sapiens
gaaaaaacaaacaaacatatgtacgttcagagtggaagagacagaaaatgtttaaaaacaaagtaaaaatccttcttataatgttctcacccaaaaacaggcaatgctatactcaaataattcgcatcaggaagagggtgtttggtttccacatctgtgtgtctgcatgtactaccacctgccatcactgacctgctctgagatagcatctcactttttcaccacggctggagtgcagtggcacgaact

SEQ ID NO: 537535 - DNA, 103 bp, Homo sapiens
acagggaggatgacttattgtgcagtgatggactggtatggaatggagactaagtggcaggaggactggtcaggaatgagtaaggggaggaggactggtcagt

SEQ ID NO: 537536 - DNA, 606 bp, Homo sapiens
  misc_feature (104)..(104): n is a, c, g, or t
  misc_feature (126)..(126): n is a, c, g, or t
  misc_feature (177)..(177): n is a, c, g, or t
  misc_feature (195)..(195): n is a, c, g, or t
  misc_feature (393)..(393): n is a, c, g, or t
  misc_feature (477)..(477): n is a, c, g, or t
  misc_feature (508)..(508): n is a, c, g, or t
ttcaccagttcttcatcgatgcggcacttcacccggcgccagcgctcggtattcagcgcagtgttacaacttgacccggcccacactggcggacagacgctggnacagcgagcccaaacgtgtggncacatcgcccagccagttgttgaggttgtcggcacgcgcataaaacagcgngccgcgctggttcgggtnagacaggcgcgcttcgtagcggcccagggaattgatgccttcctggtattccgactcactggatggcagcacccaactcttgttatcgaagttgaagcgcggctcggccttggccaagtcagcgtcttcagccgactgcgactgggagcgggcgaagtctttacgcagggcgcgggtaaggtcacgcacctgcaccancacgccgtattcccagctcggcatgttgtccatccacaagcccggcgggaaacgatcgttggagatgtagccgcctggcttgtncagcaaggtgccgaccacggtcttgagggtntcgacggtggtgtaacccaccaccatctgcttgccttccttctcggcggcaagctgggcattttgctgcaccggaaacagcgccggctcttggctcca

SEQ ID NO: 537537 - DNA, 1162 bp, Homo sapiens
ggcagagctggaaggtctgtgcaagctggtctcctgctggggaatcaataaagtgaggcagagcaacgcttattatttattattgcgccgttggccatggccagggtttctgccagtggctctatcgccaagtggagcgcaggggtccaccgtggggcctaggacgccgtgccgagatagcccctctcttagccccaagggccgacgggctctcagggctcccggggctccgcgtcgctctgcagggctctctcccggataccggcgaggccgcgtgcggagagctgctatcgctcttaaccttgcaggtgctgtgtgccgcggggcgcccggggcaggcaggacgcagaggaggaggcgcccgcacaatgcccggggcctgcggggctcccacgcacatcgggattacccgtcccggccgcaccccgaggaacggcctgactgcaggccccttgtgacaagagcgaagagaggcgagcgcgacgagaagagcaggaggcgagacgaaggagagcgcccgccccgccatggggcgaagagctcccgagaaccacgggggaggcactcggagcatgagacccctattgcgacggggaatatccctcagaccaccagagaagagggaaccccattgacgagaaaaagggcggggaccacacacaggagcagaccccgtagggggacccacctcgggagccccacattcagggcgagagccgggcagcggggtgcacatacagcacgacaaacaggggggaacccgcaaaggtcccacgaagagaagagcccagaagaagtagtggtacgccttagagaggccctttggggcgccgagggaaccccacaagaagaaaccccacgggaccttccggaaatgcgggagcggaggacagcggcggaccacaaaggacctgtatggaaggggggccgcgaccacggagtgtgaggaccgaccacagggggcgtggttcaccaaatgcagaaagcgcagccccaaatgtgtagttgcaaaagcgccaaccaggcatggaaccccagcagagcagggagcagaaaaaaaaaccgccgtatggaacagagtggacaacactagctgccacccaccaagaggtataacacggggtgggtatcaacgacgaacgtggagaacacacagacacat

SEQ ID NO: 537538 - DNA, 754 bp, Homo sapiens
  misc_feature (180)..(180): n is a, c, g, or t
  misc_feature (182)..(182): n is a, c, g, or t
  misc_feature (198)..(198): n is a, c, g, or t
cccccgggcttccggaattcggctttaggcggagcgtagtgcgcacgccggggtggcaggacttcggcaagaccaactttccggttcggaagcggcgcgggccgcgcggctcctcccctcctctccctcccctgcgttccccctcccttccactcccccctctccccgccccccaacccncngcccccaccgactccngagcgcccgccccgcccgctgctgccaccgggccgcctcgcccccgcgccagcccgcctgggcctctgcgccgccggcggcttcttaaatacaggaaagggaagggaacgtatgtcccccttttaccccatcttatacacatttacctccgtcctacagtcgcatttgcatgcacaagtcactctaccgaaagttgcaacttcatcaatcttccataatcgcccctcttttctctgaaatactgtgttgctcccggactactactacctagacttatctaaacccttactaagaattctctcttgaacctcactcaaattttcctctgccgaaatctttctttcctatcttcccgcctgctctaccctcttatttccctacagactaccttctttatctcgcccgcattctatatcctcactctactattagccatacacgtggcccttacccactcagcccattcgaacgattcccacaatctctcgcatctcccggcctggcttccccactcctatatatattccttgtattccatattatcattacctgtccg

SEQ ID NO: 537539 - DNA, 141 bp, Homo sapiens
agagtgagatgtgactggaggaccaagtatatacggtgagcgcttctcgatgagaactttaactgacgcactacgggcctggctgggtgagcatgtgcaaggcgaggcaaagacaccaactgggtccacagattcttcatc

SEQ ID NO: 537540 - DNA, 373 bp, Homo sapiens
cgaatcagactctatatcatcttccaggcaattgattattgtacatatccctctttgtcactggattatgaattcctatgagagggaggttccagcgatctgtatatatctgtatctccagatgcctacatcacaaaaaaaataggggtgaagctttgcatgtactggcaatttccctttgctctactgatccagaaatagtctccccaatgactgagtagagtatgcgctttcatagtatttaaactacttttgaaaagcacagagcttacaaactttggcaacatggattttcatatcacaaacgcaatcctgggacaatcatatcaggcagacccactccttatctgagggggggatgcagaagatgaga

SEQ ID NO: 537541 - DNA, 991 bp, Homo sapiens
ggcgggacagccagtacgagaccacggacaccatgtgtaagatcttaccgcaaaggggttgtgtctgtccttgggccctcctctagcccagcatctgcctccaccgtgagccatatctgtggagagaaggagatcccccacatcaaggtgggtgccccgaggagacacccctgccttcagtaccttcgcttcgcgtctgtcagacctgtaccccagtaacgaggacgtcaggtgtggtggtctgccgaatccctcaagtccttcaactacccctcgggcagtctcatctgccgccaaggctgagtgcctgtgcgattggaggaactggtgcgtggcttcctcatctccaaggagaggctgtcgagtagaggatgtggacgagcatgccgggacccagaccgactgcgtcaaggaagcattgccgtgatgacaaggtgtcaccagtcatcatcgacgccaagcgcctccatctcccagctcatgctccgtaaggtctcggaatggggaatgacctcacggttttacaggtacatctcacacccatggcacttccccatccttgcgtctgggacggtcattgttggaggactcctccaacatcctgggtgttctccatgtgcaagacgtgccaacgctttatcctgagtagacccgagctccacgtgtcctggagggagaactgagaaaggtcagactactgtgccctgcgctgtcagccggcctgatgtggcgccgtgacttgtgtgagctgtgccataattgaacgaggcagggactgggagagcttgagctgtcatcgaccaatttggcccgtacccagcctctactcctgggctcgcacaaattgcgggacacgggtccgtctacacgggcagaccctcacttccactaaaatcgcgccagcatgtgggtcacacataaacacccaacaggcagccaactagacccaacagcacacccggacaacgatacacacagctctacacagacc

SEQ ID NO: 537542 - DNA, 150 bp, Homo sapiens
ctcgccactgtgatgggggaggcaaagagattcgggaggaagctccttctctggagccgaatctgtcaccgaagcacagtggtctccgtcagctcttcggtcaccctttcttggtgatgacatagagccgaaccccgtcctgtaccaagg

SEQ ID NO: 537543 - DNA, 432 bp, Homo sapiens
gtaagtgaagtgttccagccaggtgtgctaagagagtggcttccgaggggaatgtggatgctggaagaaggaagcaagagtaatagagcgggcaaggctagaggccagcgaggagaaagcgagcaagaggaaaagtagacagaagagagcgatgaatgggcggagcagtaggaaaacagacggcagaacagatagtgtagaggggcaaagtgatcgggagataaagacgagataatggtatatgggcggagaataggtggatagggctacgtgtatgatcatcgcatgtcgtcgaaagagcatagctgaagcgggggagtgaaaggtatgcgcggatagagagaggcaatgtcgcggcagatgcaatactcactcgcactctctctcactctctctctctctctctactctctctctcactctctctctctc

SEQ ID NO: 537544 - DNA, 1008 bp, Homo sapiens
  misc_feature (53)..(53): n is a, c, g, or t
  misc_feature (186)..(186): n is a, c, g, or t
aacaatgaagactatcactaagacacgaaagaaacgaaaccgactcaacagtngcgtaaccaactgccggtcggcccatggtggtgtcccactcagtgtagctggccatctggctcggctgtgtgccgtaacgccgttgagtacggcgcgttttgtttgtacaagcgccctttggtggtcgtgaanaatgtttgctcgctgcttgaaatatcaagttgtcgcgtgttgtagtctgttctctcgtgtactcttcgtcatgagcggtcgtcatgaatccctgaagtgttcgcttccacatgcgaagggcattgttggaacgcacaaatgggggcactggtatcgataagtgccctccgcgcgcacccttgcggtttgcacatctgcgcccaaattctcgtggtcctggacgtggttccaaccagaatagttttggcccgcaagagagtccccccctgtgactggattaataaaacgggggagatccccaaaaggagcgaacccactctggatggctccccgtgccgaagaattctatctgttcagtattgcccgcttgtctggtcaacttgcgcttttatgaagacaggcacatctactacactacctcgctgtcgagagccgcttatatagctgggcgcgtcgttgagcaccgcggataaccccccttgtataagcggatatgtctggagatcacggtggagttagtaccctggtaaactctttcccggggggcgacacccaccactcttctgaagattccccccttgcgggaagaatgcccgtcgcaacttggtaagtgctgcgtatgacacagtagatatcgctttatccgcaccctcgtgtctataaacgccgggcagttccctcgtccccttttaacaagagtagaatgggggctctgtttctgaaataagcagctcctcttctatagcgaaatgatagaatttaagtcgggcaccccatctttcctatttcgaacacaaagaaaaaacccccaccaaataacac

SEQ ID NO: 537545 - DNA, 641 bp, Homo sapiens
  misc_feature (24)..(24): n is a, c, g, or t
  misc_feature (83)..(84): n is a, c, g, or t
  misc_feature (110)..(110): n is a, c, g, or t
  misc_feature (173)..(173): n is a, c, g, or t
  misc_feature (199)..(199): n is a, c, g, or t
  misc_feature (234)..(234): n is a, c, g, or t
  misc_feature (264)..(264): n is a, c, g, or t
  misc_feature (289)..(289): n is a, c, g, or t
  misc_feature (295)..(295): n is a, c, g, or t
  misc_feature (315)..(316): n is a, c, g, or t
  misc_feature (320)..(320): n is a, c, g, or t
  misc_feature (339)..(339): n is a, c, g, or t
  misc_feature (352)..(352): n is a, c, g, or t
  misc_feature (363)..(363): n is a, c, g, or t
  misc_feature (368)..(368): n is a, c, g, or t
  misc_feature (381)..(381): n is a, c, g, or t
  misc_feature (445)..(445): n is a, c, g, or t
taacgccttatgatgaattggttngaagggcattttctttatgaacaaaggctgggatgcatattcctttctttctggtgaanngggtattatccctgaggaaagtggcncagtgaaaaccagtctggttgtgacccactacatgtttggttttaatcactattacctgagtngaacttggctcaccatgttggtactngtgggtctggtaatgaagttgggttgatgccatcnttggactggcgaagcgtaatctggggtatnacttagctctcggcggatctcagtntggacngtgtaacaacaaaaccaaanngggngggacagacttctggggtntggtaaatataanctaggacagtnctggnaggttggtccagngtgctaggggagtatttccttaaggtaaaaacttcacttaacagagagattctttgttagcagntgggagggggtgactcaccgcgtacgacactactttcagtgttgccgcaaggctcccacagaacctatcagcgggccaatctgacaacccttcaaaaacaacccggttccaatatctccctggttactatcaaacccttggccaaacttgcgccccgacaacaactggggcgcccacgacacaaacaccggacaaa

SEQ ID NO: 537546 - DNA, 302 bp, Homo sapiens
ctcctaaataaaagtgtgcagtctctattagctggagtttatacgtgctggttcatcgtgagtaagaagcctgccttgactgtacctgggaagatgccatagttttcgtatactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcatcgtcac

SEQ ID NO: 537547 - DNA, 1365 bp, Homo sapiens
  misc_feature (185)..(185): n is a, c, g, or t
  misc_feature (509)..(509): n is a, c, g, or t
cgatgataccttgatctgtctcgaggaatagtagtatttcgactacgacaacacaatattacaccctatgtgatgctcctagaaggtatattgactatcgctgctacatcaatagcctacgtgctccctaaccctatcccaagacctgacttccatcatatagtccgagatagtgtggtggcacntcatcgggccgatagcatagctcatattgtcccgcactgacggtaacgactggctgagatgagcgtctctagcacgctctactagcgtaatcatattattacatcacattgctggtgcactataactagcgatccatggaactaagatcataccttaccgaaggtgtatacagacgtaaatcgcttactactagaatgttctcattagttaaccaactaggagcgtgaaccgtatcccatcgaaatgatagcgattcatgtgtagcatcccacaacgagtgaacgccagagtaccttaaattgagttaaggcattcgattcgcncagtcgatactataacatgggtctcttaaaccgctagaaatctctagaacgatatccaaagacctagtgatgatgcatcgctatcgcgctcgagaggtctatctttactcgttacgggtatccacacatttacattacacctgctcaccttcaacatagcgtacactaaagaaagttaaactttagggcgtccccttacactctcccaatccaacagcatgccattttgcgcccacacggctcagacagcgcatgcattcttattcctcacgatacggtattcaaggacatttatatctaaccgcaaaggagaacacttacctcaacacatcaataccttagggtggtcttaggttcttatccgcacattgaaccctaaaaatgccctcccccgttttgatacaatttcccgtcacaacttaatttattacacgtaatgaaaacaaaaccattgttaaacccatgagaacttacaaaatgaggtttttttccaaaactatttccccttttcccttttccgttaaaaaaaccacacaaccaaatttattctccacctcacactggcgcacaccccacaatttggcgttacgcttgtaattccatactcggtgccaacccttggtgacgttagtcaccgcgaacatagattccctaaaagttccgaacgaaacaatggtgcccaattgtgatacccctgtacaaagttgagcgtatgtaaactcaggcaataatgcgcgcgaattaagatatcaattagcataacggcggcactttaaatttaatgatagccatatcgcctatattgtacccaccacaatgagggttcgccacacttagcgaccgaaatgtttgagaa

SEQ ID NO: 537548 - DNA, 623 bp, Homo sapiens
ctggggaagtgatggtgtggccaggcagttatagattaaaggcctgtgagtactgcaaaaaaaaaaaaaaaaaaaaaaaaaaaaactgtgtttgtgggcgcgcgcccgtgggcccccgagaaaaagttttttagaaaccattcgcgttgtggggcgcgcgcggggccccagagagggtatagggtgaaaccgtgtggccacatagcggtgtttccctagggagaagatctctgggggtacaagagagataaggggcgtgtgggagtattatcaccagcagatattaaataaaagcaggccgggggggggaaaacacgagagggcggtcttgtggaaacaatattcaagatattggagagatctagtaggaggggtaaattaaaggggagttctatattaaaaggaaggagtggttcaaaggagagacgccttaagaatatctaaaaaaattataagagcccgcgcgccgctggggggaaaaaaaaaaaaagaaaaagaaaaacaaaaaaagagaaaaaaaagcaaagaagagaagacaaagaaagaaaacaaaaaaagaaagagaaaaggaaaaggaaataaaaagagaaaagagagaatacaagaatgaaaagaagaacaag

SEQ ID NO: 537549 - DNA, 112 bp, Homo sapiens
accttcccgatagtctgaagatgtggaagagctttgcgcttgctcctcagggaactccggtacgcatcgggaaagagttgctgccagagacagctgttattccagaagcaaa

SEQ ID NO: 537550 - DNA, 871 bp, Homo sapiens
  misc_feature (2)..(2): n is a, c, g, or t
  misc_feature (147)..(147): n is a, c, g, or t
  misc_feature (182)..(182): n is a, c, g, or t
  misc_feature (230)..(230): n is a, c, g, or t
  misc_feature (259)..(259): n is a, c, g, or t
  misc_feature (289)..(289): n is a, c, g, or t
  misc_feature (350)..(350): n is a, c, g, or t
  misc_feature (380)..(380): n is a, c, g, or t
  misc_feature (422)..(422): n is a, c, g, or t
  misc_feature (460)..(460): n is a, c, g, or t
  misc_feature (463)..(463): n is a, c, g, or t
  misc_feature (493)..(493): n is a, c, g, or t
  misc_feature (520)..(520): n is a, c, g, or t
  misc_feature (524)..(524): n is a, c, g, or t
  misc_feature (615)..(615): n is a, c, g, or t
  misc_feature (617)..(617): n is a, c, g, or t
  misc_feature (649)..(649): n is a, c, g, or t
  misc_feature (667)..(667): n is a, c, g, or t
  misc_feature (690)..(690): n is a, c, g, or t
  misc_feature (693)..(693): n is a, c, g, or t
  misc_feature (748)..(748): n is a, c, g, or t
  misc_feature (753)..(753): n is a, c, g, or t
  misc_feature (780)..(780): n is a, c, g, or t
  misc_feature (784)..(784): n is a, c, g, or t
  misc_feature (837)..(837): n is a, c, g, or t
tntaactggatagtacaaagtttgcctttgtttgttacttaaaaaacgtactttccgcatactgttgcccgtatgactttcctgtcccatcggaaaccagagtttccccaggcgagcccttcctatctgcggttacatgatttagcnaatttaacaagaagagagtaattcctttgattatnatcaacatgaacttgacaatgtctctataagggggaacactgattttntttttccttttagaaacaaaaaccacccncctattaacccaaaccacggcattgcattnacaacaatcatcgcaaaaacggaacaaacgaagttaccaccccaagggaataacagaagancggggcacaagggagcgacgggggacgcgngggcaaacaaggggggcacagcaaccccaccccacacacccngaccaccgcggcaggagggaccagacacagggccaggngcnagggggggccccagcacggggaaccgaagngacagcaacacaggcaagaaacggcgnggcnaggggaggcgagggacaccagcccacgcgccgggggcagcccagggcccccaaagagcccggacgccacaggccgcggagcggaccacgancnaaggaaaggggcaggccatcctaacagtgggnttttccccggggagaacnggccaacagtcattgcctcaccnccntagtatgttgtttgaccagagagggacagggcggggaggaaaaccggggcgccgngggcngcagttccagccgcaaaaacgggagtntccnccgacgtccgtggcccgccggcccgaaagggagaaacacggagggaatgccancccccgatgtcagaacccgcaccgccgaagattt

SEQ ID NO: 537551 - DNA, 331 bp, Homo sapiens
  misc_feature (43)..(43): n is a, c, g, or t
  misc_feature (70)..(70): n is a, c, g, or t
  misc_feature (88)..(88): n is a, c, g, or t
  misc_feature (234)..(234): n is a, c, g, or t
  misc_feature (243)..(243): n is a, c, g, or t
  misc_feature (289)..(289): n is a, c, g, or t
  misc_feature (306)..(306): n is a, c, g, or t
  misc_feature (323)..(323): n is a, c, g, or t
aatatgtcagctcaacaggaattctatcataaccaggtaaagnaatggaggcacaaaatctgactcaagnaacatttgtttttccttntctgcatactcttggttttataatgtataagattaaatttgagtaaaaccatcagagatagcccacgtattaagagatcagggcattggtagtacaaattagagtctgtatattctttttttcagtataatattgtgtgactttgncctattttntcaatttctctaaaattcagtgttcacatatttaatatacatatantaataatgcgtaacagntatacgtttttgagganttataaat

SEQ ID NO: 537552 - DNA, 331 bp, Homo sapiens
  misc_feature (73)..(73): n is a, c, g, or t
tctgtgactgactcttgcccgcctgtgactgactctgtcccacctgcaccgactctgtctgcctgcgaggctncccgcgcaccagccagtcctcattccctccctactgcttttttttttttgaaacagggttttgctctgtcacccaggctgaaatacaaaagtgcaatcatagctcactgcagccttgacctcctgggctcaaggaattctcccacctcagcctccttgggagctgggactacaggcacaccacgcccagctaattttttgtatttttggaagaggcagggcctcaccatgttgcccaggcgtggctcaagccatttgc

SEQ ID NO: 537553 - DNA, 518 bp, Homo sapiens
  misc_feature (200)..(200): n is a, c, g, or t
ttgtgcctgaacggccaggtctggagtttctggaaacctaaattggcattcgcggcttttgtcggtaaatgttcagtttttagctgcacccggggccagtttttcagctctgagaagagctcgtccacccgcagccagagcgattgtggtggcaacagcgggcgcatcggatcgacgccgcgattctcaaaacgcgccantgttcagcctggaaacgttcggcactggtttccagatcgccagtattcacgagcaaggtattggcagggaaataactgaacagcggcggcagtggttcgctgaagaacaatggctgccagtactcgatcccggcaggtaatgtgcctttactcacttgctggtaaatatgttctggatcgcgcttcacttcgaaggtatcgcgccactggctgcggaacagttcaattgccgctttatcggtcggaaattcgtgcgcgggcagcagattgatccgttctacttcctccagcgtgcgctggctgtcgacgtaaacaccc

SEQ ID NO: 537554 - DNA, 208 bp, Homo sapiens
  misc_feature (179)..(179): n is a, c, g, or t
  misc_feature (197)..(197): n is a, c, g, or t
ggttatatagccgacgccaagaagacgcacggccgtgaagcattcaagcctccagggatcacatcaactctgggcacctctcacagcaaaccagtcatcactctgcaaggtaacctcaccaccgagacacgtcttcaagaacgggggaaggcccgaccttctttccatgacagagaacnatgcctcttgcggtccanaacctccccac

SEQ ID NO: 537555 - DNA, 129 bp, Homo sapiens
cctttaaatcccacattttgggaggccgaggtgggtagatcacgaggtcaggagttcaagatcaacctggacaagcttgccagagtgtctcaggctgttcattctggaataagcaggggtgatctttat

SEQ ID NO: 537556 - DNA, 562 bp, Homo sapiens
aatagcgcgtctagagcggacaacgccatatccgtaatttctctcagagatgctggctctggtgaacacatggctaactagctccattgtgttattattcgaaactttcttgggagggatcttatggatggatacgtccgattaatctctgacagatgaagccgctcgttcaaagtagttgcgcgatcttttgtgctaaccaccagttgatttggccacatttccttagtgttctctctgtgggatgtgtgaacgaccactcgtggcatatccttcaggaaggagtagttaggacagtagtccctgagttctcgtagaattcaaacttttttttcgataactttgatacttgaaagacagatgggctggctttaaaattcttgattcagatggtccttacctttcttgaaaacattgttccatccttgtcttgctttgcccgtagctgttgataaggctgatgccactctaatatttattctattaaagtgacttggtatttttgactggaggccagaggtttgtttcttcctcctcttctccttatctcctctctcctcct

SEQ ID NO: 537557 - DNA, 517 bp, Homo sapiens
cgtagatcataggtgcagtacgctgtctcagagtagacaagagagactagtgaattcagtaggcgatgtagtgatcaggctctcagggtgataatcccagcacttagggagatcaaggtgggagagatcatgatgccaggatgtcgagagcagattaatcaacatagcaagagctcatctctaaaacagtaaataaataaaaagcaaaaacttgtgtgaatttgcaattctatttaacaatatacccaaatgatctcggccttcacaccatcttcttggaaaaacctctgaaccatgagagcctagtggaaggaagcgaatgcgcaggctgaaggcgcaaaagaagaacagatgaggcagaggtccaagtaaacccacaagcttatgcacccatggaggctacaaggagcagaaacatggaatccagaggctggggatgctggtacagttatggggctgcatctactgtctagagctgtttcagtgcatctagaacttcaactccatctggtcgcca

SEQ ID NO: 537558 - DNA, 82 bp, Homo sapiens
  misc_feature (43)..(43): n is a, c, g, or t
  misc_feature (45)..(45): n is a, c, g, or t
gatcccatttaatatttaaaaaaatcagtagcacaaatatatntnaattgtcaacttacaaaataaaatacatttacagtct

SEQ ID NO: 537559 - DNA, 191 bp, Homo sapiens
aagtcctggacttctgcaggcaaagtggaaactgaccccacggagcttacctgttcctacatctatctgcagctgtggactattagagggtgtaatgccctgacccggttttctaaagtgtaatgtatgaaatattggttttatactaaaaggtgttaacagtaggtcaacttccaataaattacctgctt

SEQ ID NO: 537560 - DNA, 152 bp, Homo sapiens
tgtatgctcctctagaccagagggctctatggggtggatgctattgctgcttttccaggccacagggcagtcaggacggagcctcagcacacaccagctggaggccggtgtccctgcgcttggaagtgggttcccgtggccacgggggttga

SEQ ID NO: 537561 - DNA, 292 bp, Homo sapiens
atgtcccctagggggcaactcgccggttagggggggcaggcctcctagggagaggagggtggatggaatgaaggggtgtaagtcatgtaagctaggtagcaggtgcgaaatagtagtagggtcgtggtgctggagtaaaagtagagtaggtagaagtagagtttaaggagggtgatggatggctatgatggtgggtatgatgaggctatggtgtaaggtgactacttcgagaatggcccatttggacaaaaagccggagaggggacatcccgctaagggtacatgggtaccg

SEQ ID NO: 537562 - DNA, 497 bp, Homo sapiens
  misc_feature (193)..(193): n is a, c, g, or t
  misc_feature (200)..(201): n is a, c, g, or t
aggtagaagtgactatgaaactagtagacagggcaggatagtttttcaaaagaaggaaaaaaaaatatactgccactcaaaatgagtcttcaaacaaaaatcctacacataagataaagacaaatgctaacaaaatcagcaactgggagataagtttacctaaagactaaaacactacaacaatctgaaattnagtttannattagtgcatgaggaagcttaaagtgataatgaaaggaagaatacctcctccctcaaatactaaacaaaaacaatcaaacagagaattagtaagttaaacgcagtgctaagaaattgatctgggacacaatacagggagaaaaattcattaaaaatgtaccagagcagttgagaaatgtataggataagttgtgagggttttataatatacaacaggagccccaaggggagagaagagaagaaatgagagagaagcaatactaaaaaacaaaaaataaaaatgaactgtccagaat

SEQ ID NO: 537563 - DNA, 497 bp, Homo sapiens
tctgagcaagcggggaacagaggagggttagtccaattcagtctctctcctcgtgacccagaagggtctctagggaccctatgtctcacaggccaagtctcatctcacatgccacgtctcaggtgaggtgtcagatgcccggtagatgcatgcagaagtagcatcaccccaggggtaccgcaggacctcgcggctgcctcctccttcagcagcaaccacattacaattggggatgttatgggaaaccgcaattccatttggcctggtagagaaaatgggcccccaagaatggtgggtcctatagaactctggagctggagtccattcaaggtcgggctcggtttcttctgggctcctcatctggaggcaggaagtatctccaggcagagggagaggagctattaagtcaacagtcaaagggtgaaaagacaccaagtgggtgactttaccggcctactagggccaggttatcccacaataagtaaaggtatgtaggg

SEQ ID NO: 537564 - DNA, 337 bp, Homo sapiens
gaggtagaagacattgaataaataagaagttatttatattgtactcaacaagtttaattgaatgggattgctggggtaggcactgatggaattgataatggaggtagtgattagggattcaaatggttgcttcctctatttaccacatttttttttttagatttattttggcccttgatctcattctcctttgcatgctttttttcttccttttgaatttagcaatttgtggctaggcacagtggctcactttgggaagctgaggtgggaggatcacttgaggttaggagttcgagaccagcctggctaacacggtgaaaccctttctctaccaaaa

SEQ ID NO: 537565 - DNA, 260 bp, Homo sapiens
ggtggatctagaggatcccggctggggacagcaggactcggtttaagtgtcagaggcttagaggggtcagctctgaactagaagtctctcacatgctatggaaacttctaaaactaggagtttcaatagcattctacccacgttaatgtccttttggttcctagacatggccaaaggtttttttttcttttttctctttggttatggctttcggatctactataaaaggcttttcggctatggaaacttctaaaactagg

SEQ ID NO: 537566 - DNA, 124 bp, Homo sapiens
ctggctggtgaagattgttcgaagtttacagcatttcagcgcacaacgcattaggcgctataagtggggcaggatctctttgcgtacaatgtttctcccaatcaatataccggaaaacgtgcat

SEQ ID NO: 537567 - DNA, 329 bp, Homo sapiens
  misc_feature (11)..(11): n is a, c, g, or t
  misc_feature (241)..(241): n is a, c, g, or t
taagccagaancgaaaggacaaatattgtataattcccacttgtgtgagatatctagtgaagtcaaattcataaagacaacagataaaatggtcaaaagaggtggggggcagagggaaaaggaggattattatttattgggtacagaatttcagcttgacaagatgaaaaggggtctggagatggatgttggtgatggttgcacaacaatgtgaatgtgtttaatgccactgaactgcacncctaaaaatgttctaaaatggtacatttttgttatgtatattttacaataaaaaatgtaaaattaataaaagaaaaaaaagtaaaatc

SEQ ID NO: 537568 - DNA, 409 bp, Homo sapiens
acccacgcgtccggttctagatcgcgagcggcgccctttattatttttattattattatgtttatttactctcctttaaagagaaatttattgaacccggttataccacgcagtaggtttgataccgcggacataacaactcccttaataagataaggcacaagacaaaaaagttaatcttgattagaaacaagatacaccaccatttatggtcttcaaacattatggcacttataactttcgtataagttggacaacagcattcaacgaaacagtcgtggcagacatagtttcaacagacaaataacaccgtgtaagcagacatgacgtgctcctaaatggtttatcaagctattgaatttgacaaactttactaatataagcggtaccgggggacgctggaagagta

SEQ ID NO: 537569 - DNA, 129 bp, Homo sapiens
gaaataagcagttgaaaatcagctgaactaagctttggtgcatctggctgaactgcggggatttcaaatggaaaggaaaatttatgaatgtaatcaggttgagaagtctttcaacaataattcctcagt

SEQ ID NO: 537570 - DNA, 451 bp, Homo sapiens
gatgcctgctcggaatggtatattgctgatctcaaaaaatatggagagcgattatgcagccttgtcataaaattgatatgatgtgccatcttgcagatgtggtagccgactaaaatgactgttaattggacacctccaaaagttcttctgagagttcttataagtaaagtatcgaactgcaatatatgtggtttataaagaaatagctattggggttagcattgcacaaagcccagtttctttctgtgtttgaaaaaattttgatccccttggaatattaagaggtcaacacgtgattgttgtacgtacacattgtgctctggagtgcctatttattgaaatcattgtaagacctgttataaatttaagtctatttaaactaactgtaatatacatccataaaatcatttaagagtcttttatttataaataaaaatcacttcattttcaa

SEQ ID NO: 537571 - DNA, 120 bp, Homo sapiens
taacaacactagcaaacgaaatattagagaaggtaggagtgtagttcattgctcagctacctcagctttaaaatggagagaataagccaggcatgatggctgacgcctgtcatcgtagca

SEQ ID NO: 537572 - DNA, 373 bp, Homo sapiens
aaagtttgaagtaagtacaccacctcttgtaagacaaaatataagaggtcatacctacttagatgtgtgaaaaacggcctattctacaagcgggggctgggaccagcttgagttggctgcaattgttaacctgaatggcaagagggcggtcaagtgaggtccattgtctaaaatagagcagcgaatggacgatcactagagacagcgttaggaatccattctcctgtgttcgttaaacaaacagtggtaggttaatgtgttcagaagtcgctgtcctactactttgcgaagatggaagtccaacaccagagattttcagctcaattgtgttaacatttctaagccttgttgcagaataacgggcattagcaat

SEQ ID NO: 537573 - DNA, 1076 bp, Homo sapiens
tggagacaaagtcaaagaattatcttgaaaaacatggacataaggccctactcaatacatgccgcatggggtacaaaccacgagagtctactacatgattactaccatactattacctaggtgaaactctacacttactgtatggaacaactcccagataagatctggatgctggagacagaggatgctgcttgtattccatgggcttattattcaactgatggatcaacgttaaaggacctcatactagtggtagttatattgagcccctgtatcgtatcgtcgaatgaccttaacttgacagtattcaatcccagaaggaaactggaatatgacctgtctgtcctctcagattcagatgagaatgaatcttggtacttaaatagataataatgaaaatatactctgatacacctcgataaaagtaacattaaatgatgatgaggaattttactagaaaggaataacataggtgcatgctattaagtggaagaagtgtatggagaagcctataaggactcaataatgcacgtggcgagatgcaagtcaaattggtatctagcatgggcacatcgcggccaatcgcaacattagactttacacaactgtcaccatttttccactggtcattatcttccaatatcaagcacaggggcagtttattagtctctggatgtctttgacatgtttccgctggaaacataaccgcaaaaccgtagaaattgtttccaagaatcaccttggaaccttggttactccatctgccatgtgaaccgattcaattcatgctggcaatggaaaccacttaacaccgttcttaccaaaattgaagaaacaaatcttggtgactgaaatacacttggggaaaacgtgggaaaaagaaaaaaagccaagatttcattaacacaggttgttgaaacgtgtaaaatagaaatggtactttggaaatgattttagctttaaagaacgactgggagacatacacgtttgtacacttgtggggggaaacatactaagtgttggcaaggggaagttccaaagaacatataaagggagtaaagaacggaagttggtga

SEQ ID NO: 537574 - DNA, 948 bp, Homo sapiens
tgagcggggtgggcacggcgtgggacgtgtccgcccagaagagggcctgatgaggcggtggcggtgcccccaccgcatgtgcccgcggcgccctctgcaggccacagtgcagcgatcaccagttgcctcatctttcctctcctccctcttggggctttcctcaggccacattttctgtgtgtctgggcagtctactcagcctccgactccgtgccctttcttccacttccaggccgggcgtgtaagtgtctatcgctggtgcaacactgccaataaagtcattgcttctatctcgctcccaagatccaccgcctccccttaagcaccgcgagatctgacgcgcgcggctacccatggcggcggcatttgaatgcctcgcggagccttacccagcagctggccgactgctatgccggctgatgcactgtggcacgtgcaggtcccggacccatgagccaatcatccctgggcctgctgacggactcctgcggaccgctcacggactctcatgaaggccctgtggaccccagcaaccggagcgactagtgctacgttcgcctgcgacgcttgcctggacttcgacatttcacccattgcattgcaactcaccgcggggacctggtcagccttgtcaccgtggagccctagccaaacacagaggactcagggacttccgaagaaaggcgcccctctcgaccctggcgtttgcaagacttcgacacgggccccaatacccatcgtataagcgcttagctgtcattccacaggcgcatccgagcatatccctacttgtcatccaaccgctatttccagcttcatccggccacacctgtggcgcaaacaaccctcttggtggatgttacactccacctcccactccgccgttacttgcgcctctcctctcttagctgccctttgcgagaagcgttcaaccgtaaccccactacg

SEQ ID NO: 537575 - DNA, 227 bp, Homo sapiens
ctttagcggagcaggctgggacgcaaacaacagactggaaactacaccaacaggttatgtatggaaaagcgtcgctggaccaacgacctttcgctacattggaactcattcgggcgaccagtggcgtgaagtctgcgaagatgctccgttactgatgctcctgatgctccgcttactgaactccgttactgatgctccgttactgaccgcttactgatgcccgctta

SEQ ID NO: 537576 - DNA, 197 bp, Homo sapiens
aaggttcgtatcatatggccttatataatggcgtcatactgtctgtgcttggatttagttgggtttaggtttgactgctttcactcagcataattattttgtgattcatctgtgttgtggcatgtatccaatcgttccattccttgtcattgagttaaaccgtaaggggtgaaccatagctcgcatttcgtcatcct

SEQ ID NO: 537577 - DNA, 354 bp, Homo sapiens
ttttactctaatctggctcccgagtgccaaggaggcagtcacggcagcggacatcatggtgacggagcggatccgggagacggatgtggccgagaaaataagccacatctgtagaggaatgaagtcacctgaggagatgcgccagcaggcgcacatccaagtagtgagtacggaccctggtcagccaggcacaaccaaccatgcccccttgctcatatggggtgctcgcaccatcaggcatgggtacgcagtgcagcacaggcatcgtccatgtgcaaactgtgggaaacacttggctgactgtctcggcccactatgggcccaccattatggcagggggcatcctctcagaga

SEQ ID NO: 537578 - DNA, 623 bp, Homo sapiens
cgcttgtcaatgagccattaaggttctggcggggctctcagtccctggcataagccccttgtgatgaagtggggcttgacggtgcttaactccaatgtactgggttcgtgacgctggaggaacgccctttgtcctaaacacgttttggtattactaagggaacatggatgcccccttgagctcctgcggagatcctggtctgctgtagggacggacggccctcggagagccccccaccttactttggccttatcctttttggtttttttctttcttttttttttttttgagacggagtatttgcatcttgttgcctaggctggagagcaatggcgtgatcatgccactgcactatagcctagggcgacagagtgagaccctgtctcaaaagaataaaaagtaggtcgggcacggtggctcacgcctgtaatccaagcactttggcaggcacgaggtgggcggatcacctgatggtcaggaattcaagaccagcctggccaacatggctgaaaccccgtctgtgcataaaaatacaaaaattagctggataccagtgggcgagtgcctagtagtcccagactactccaggaagggtgaggctagagaatcacattaaactctga

SEQ ID NO: 537579 - DNA, 152 bp, Homo sapiens
acgggattccatcttcatgcgcaccactgcggcggacggttgaccactagccaccacatcatcccagagctgagctcctccagcgtgatgacgccgtccccaccagctccctcttcgggtttttcatccttcggtcgcttcactgctgagtg

SEQ ID NO: 537580 - DNA, 242 bp, Homo sapiens
gcgaggacaccgtcaacatcgctaccccgatgaccagtcattgtcagcctgcaggaagcatcatcattctaccggagggacagaccagcaagacatccccagtgagcaaccactctgtgtaatctacgaattcagctggcagaacaataaataacgaagataacttccattcagcaaagcctatgacattgaacataactgtggtcataacctctttcttcacgtatacatgcaacactggt

SEQ ID NO: 537581 - DNA, 100 bp, Homo sapiens
tcagcatccttactcacagtagcatccattcttcacactgcatccccagcactgtggacctatcaggtaggtgacaggagccagcagacacatgacattc

SEQ ID NO: 537582 - DNA, 315 bp, Homo sapiens
gcctagaggatcccagattaagtcctacgtctgactgacacctttagagagtgtcaatcaagacgtaggacttatatccttctgctcatcgagtgatgatacgcccgagcagatgccaacacagcagccattcaagcaatcctatacaaccgagatcggcagatatcgtgttttatccctcgcctatagacatgatttatcctcacactcctaactcatgcagacccacaagcaaatagtcccttctaaagcgctaagtccaagacctacaccccagcgtactacggcctcactcctagacaggcagcagagcaa

SEQ ID NO: 537583 - DNA, 373 bp, Homo sapiens
gaacgcactcacagtcgcgtcagaaccctgtcgggaggtcttcaaactctactcccactggggggttttggatgacctggaggaagcctcggtaagctcgcattgccctgcgatattaacctacggggagaactcgcggtgctagtaagccgttctcctgatgaaatacgctttcctggcttacaggactcagcatgctagtcacagccgaggggtccctgacagttttaccacagcagaaggggggtcagtcacccaccgcagtgacaacataaaaccctcattggcaggagaggacaccctcagggtcatcacccatccgccattctcctcctatccctcaaccccgacatcattgcggggttttcctctt

SEQ ID NO: 537584 - DNA, 359 bp, Homo sapiens
agactcagaggatcccctgcgggtctcatattaggtaaagcctaagactcctgagccactttatatgtaactggctaacctaggctgggggcttgaactaagtaaagaagccaaggcagtcagatactagatagcagagaagtacgtctcatactaaaacattgcaactactgttagagtccaccccatgaagctgtttcagatagtgtatcttggactgaattctataagtatatataggtacagactaaaacaaatgtggctagctaggtgggctgtgctgactcagtcaggacattgacagactccagcttacaccctcgggagacctatggacctaagtgccacatgcattatga

SEQ ID NO: 537585 - DNA, 470 bp, Homo sapiens
atccccgatgagtaaaacttggtcacaacctccacccgcggttcaatgcaattctcctgcctcagcctcccgagtagctgggattacaggcatgcacaacacgcccgttaaattttttgtatttttagtagagacagggtttctccaatgttggtcaggctggtctcgaactcctgaccccaggtgatctgtctgcctcagactcctaaagtgctgggattacaggcgtgagccagcgcacccggaacaggaggttattatatgtagggtgctcaaggcagacttctcggttaaaagcaaaggcagaacaaagaccccaaggaaatgaggaagcccagctagaacagatttctggaggaaaagacttctaaacagaggaaaagcaaaagcaaaacgctctgaggcaaaactctacttggcacattctaaggaaagcgagagggtcagaatgtgccaagatttactcatcg

SEQ ID NO: 537586 - DNA, 123 bp, Homo sapiens
tctagaggatcccatgattaactataatccattgctgaaagatggtcaccaggcaccacatccagacaaggtactgtacacacaagattccacttccctttgcttgaatccttgggcctttgg

SEQ ID NO: 537587 - DNA, 711 bp, Homo sapiens
  misc_feature (645)..(645): n is a, c, g, or t
ttgctactggcagcggaagctctacctggcaccagaaacagagcatcatcctgcctgcagagcctgtgtcggggtgcacctgcagcgcaatgagcttcagccagatgatctcggagaatgcagaatggcatgaatcagaaggacgagtggaatgccctgtgaaggcctgcacagatgcatgtgtgcgtgagtgatgggctggacatggtgtcatggcgtgcttggaggtgcatgcagtgttagcttgatgcatgtggtgcctggatgcctatgcgtgatgtgatgtgctgtgtgcatccgtgtgcattctgtgatgccgtgatgtgtgcatgccatatgttgacatgtgtcacccccatagaagcagctccatctaccttgatgaatggatgtgccctcaatgcgccatgatgtaacgatctcttcctcagcctccatgaaaaatcctgtgtgctgtgcttgaaatgttcatcgatgtaaatgtctcccatgcatgctcggtgtatgaatgctgttgacgtctgcgttctggcagaatgatggtgcttgtgatgcatcggtacaatgttaccatgaaacgaatacatcactcacatgtaccttgctaattgacgtgaggatgtgccactacagaatgataccttntctcagtacatgtgggtcatcctcagtgatgacaacgggtgtagacgtcatcgcttggaaaggacc

SEQ ID NO: 537588 - DNA, 101 bp, Homo sapiens
tcgcgaacgtgttattcagaataggtaaatctataggagatggagaagaaagcagatccatggctgggtgtgctgggtagaggggataacacgttcgcgag

SEQ ID NO: 537589 - DNA, 524 bp, Homo sapiens
tcgtcacagtgtagtacttttgttctaaagagaaagtgatgaacaatccaaaccttctgcatccagatgttggactccaacgtttctactttatcgtctcctggtaccaccatatcctgatgcagtcactggttcacgtgtctgagtatgaacataccgaatagctgcccgagccatccatgaaggggtgagtaagcccgtcattccacgtgccagggtaggagggaggataggacgggtagtaccacgagtctgagcaagggtgtggccgctctattgctgccacacaaatatcctagtattccaccgagttcccaagcctgtccagaaccctggtcctgagtgtgcatgatccttgtagtcctgtaaaagcactgtcgaaacacagaagttgcagcatggccagtattctgtggtcctgtgaactcagacttaaagcctgggggaaggaggtcctgctgagtaggcgcatctctggtaacggtgggaaaagggaggatactcagagtacggagtcgctatgg

SEQ ID NO: 537590 - DNA, 184 bp, Homo sapiens
  misc_feature (80)..(80): n is a, c, g, or t
  misc_feature (142)..(142): n is a, c, g, or t
ccacctccgccttcccctacgcgctcctgagcaacgacaatgccttcctgagctaccacccgcaccccttcgcgcagcancgctcaccgcgcgcttccaggtcaacaacacccgcccgccgcacgtgcagctgttgcgcaancggtgcttcacggccatgggggtgctgggctgctggatgagg

SEQ ID NO: 537591 - DNA, 131 bp, Homo sapiens
  misc_feature (22)..(22): n is a, c, g, or t
gtgactctaccgatcctaaggnacacggcttcgtagacaaaaagtaaaacaagaactttatctttggcttttaaccatctcatacaaccagctacttatagtacagctaagtacatacaccaaaaagttac

SEQ ID NO: 537592 - DNA, 760 bp, Homo sapiens
caggctgtaccgcaccggagttatgggatctccggaagcctggttggcattgacaacaaaatcgagcaagccatggacttggtgaagtgcacctcatgtttgcggtccgggagtaggtggaggtgctgaaggagcagatccgggaactggcggagcggaacgctgcgctggacaggagaatgggctgctgcgcgcctgggctagccctggagccaggctggctcaggtgcctccgtcgggggtcccaacggctttggggccccccttgcgcccaaatgggccctccggtctgaagcctccctttccgctttacaagttgttgccttttggcggcttgcccgggccttgcgtcaacgcggtctttgccacccttcttatccttagttagcaaagggcttttaagttgtcccccagttgtcccccggcggctggagcagttaccaaggggcgtcaggtaacttgggccctgggtcccccccgggtcccgtttagccctagtcttcccttcgattcaatccccccagccgttgcatgccggggaagagcgtaagacggcttttccggatgtaccgctggggcctgaacaaggcgagcggaaggcccccctctttcattgtcatggggtatccccaaatcccgaaaatcacttacgccttactgttggagtgaacacgccactttatctaagttatagaacgaggcttatggcgcgacaacattcgtagcaggcatacaccgtggtaagaaatacccgcaaaac

SEQ ID NO: 537593 - DNA, 384 bp, Homo sapiens
gtagaccagctcggcggcacgtccaccagcagtcgaacgccttcaaggggacccagaattcgccgtagtggttgagcacatacgggtcctggcggatgtcctgcaccgtggatttatgccagggccgggtttcggtcagggtgtaattccgggcttcggcaaaggcgccttcggcatgccaaggaacatatgggtgaaggtcaactgagcgatcacgagcgcaggcaggcgaagggtgtgctcaacgggccgggatcgaggagcaactccgactcctccacgcgtacccgttcgaagctggcgctgcgctgtcggtctggcgctgccaatgttgttccagtcattgtgcagggtgatgccgctgcgtccgctggggatggcggc

SEQ ID NO: 537594 - DNA, 111 bp, Homo sapiens
cgctcacaacatgccaggttggtagatgtgttgctaaaaactgcacatgcacgcaaccgaacacccttacatttctgcaaaagggttaaggaagcggcttactccatgtat

SEQ ID NO: 537595 - DNA, 348 bp, Homo sapiens
gatacaaggagctatggtatagtacacccagagctgataacaacggccatagctattaagagatcctctcaccacagataccaaagtgctgggattgaggtgtgatcatggcacccagactttgctgcctttcttacatgatccaggcccagaacccaaactcaggcactgtataaataaccacttacgtaaactaatgacctagcttgttgccaatagttgattgaacttcccataactccacttcgtgtctgtacctctgtatacagacaccttctgtacccgtcatgagccttaaggtctccatttagcatattgcaaatactatgttccatgtaaggtagctca

SEQ ID NO: 537596 - DNA, 235 bp, Homo sapiens
aaagggtttccaaaatgccagcattccttcgctctgcccttcagatattgttttctgaggattcaacaaagctctgcaatggcatcaaatcaaggggctctgcatatggttccagctgtcaggaggaggcttcaggcacctgcatgctttccggcctcgatcaggaacagtggaggccatggtgtctttgggcggtgatcccagtggggattgggctgatctctatcggacccga

SEQ ID NO: 537597 - DNA, 581 bp, Homo sapiens
  misc_feature (543)..(543): n is a, c, g, or t
aattagaggatcagaagggtgatgggttggatagatacaagactcaactgtatggtgccttcaagagatccatctcacatgcaatgacatccataggttcaaagtcaaggaatggagataaaattaccaaggaaatgaaaagcagaaaaaaagcaaggttgctattctaacttaaggtgaaacagacattaaaccaacaataatcaaaaaagacaaagaaagtcattacctaatagtaaaggtcaaaaagaagacctaactatcctaaatatatatgcatccaacacgagagcacccagacccataattcaagttcttatagacttgtgaagagacttagataatcacacaataatagtgggagacttcaacaaaccactggcaatattagatacatcatcaaggcctaaaatgaacaatgatattcaggacctgaactcaacactttaccaaataagccttacaggtatctacagaactcttcagcccaaaacaatggaatatacgttcttctcatctacacgtggcatgtattctaaaatngaccacacaatttggcataaaacaatccttagctaagt

SEQ ID NO: 537598 - DNA, 294 bp, Homo sapiens
gttctctgatgatgattgctctctgggtttgtcctcgatcgtgtatctgaagcgttacacccttgacaccgcccgtgtcaatccctcgtcgttgttggattacaacaaaacgatccaatatcacctacttttcaaacttccaactggaaaatttcaatctaggatgtgctgctctcctataaaaaccttaactgggtcctgactcacctacttcatgtcctccagatcatcaaatagctgagattaaaactgccaaaggtacacaaaaactacaatcacataagtgatccaact

SEQ ID NO: 537599 - DNA, 200 bp, Homo sapiens
gatcctcggtgtggatgtcacggtgaagggaaaggaaaaaaaagggaggcccaaggcagggcaaatcttgctgcaacttcgatgttgagcatcccggcccacgggacacacacagcccaccagtttccaaaatacatcctttgtccctttgccaggataaaaataaacgctgcttccatgtcctacctcctccaatttgt

SEQ ID NO: 537600 - DNA, 341 bp, Homo sapiens
ccccccgggtggaatcgcagctactttctgtggtaggtggataggctggactagggtaaaaatctgtgacccatatttaataggggtattctctgttgtaaaaagtctcctttcttcccagatgggtgcataaatgtggagtactaagaaagcatatttgagggcatggtggctcacgcctgtaatcccagcacttggggaggccaaggctggcagatcacctgagttcaagagttggaaaccagcctgaccaacatggagaaaccccgtctccattaaaaatacaaaaattagccgggcatggtagctcatgcctgtaattcccaaatccaacggggggg

SEQ ID NO: 537601 - DNA, 744 bp, Homo sapiens
gccacacataaaaataccccccccataaattgtgtttttcgacaggagcaccgttactagcacttcgtaggcactaccacaactaattggagagacccgtctatacatgacgtatatgggcaaaacaagcgcgccctcgtcggtgggaccccctcgcacgagagaagtacatggtaaacagtttcacacgcacgaggggggaacccccaccactaagagcatctcctgtgccccccgtctctcaccctcgcggtgcgagcgaagtatgtcgcccccttacatttcccgtttagagtgctttataaaatacccctctccgcaggtataagcctttttgggccgccaactatcaagcaccacgcctcaacagacacgtccttttggctctcaatataacataataaacgatatagcatccccaaaggaggaactatgcttaaaagcactaatagtgttatttcgtttagatattatacacagaagtaatagaatgtagaaataatagtgccacatcacagcactatacaatagatctcttattgtctcacaagtagtctccccagtctctcttgtgcacgattacccccccctcagatggtccccaacggcgtatgaaatcaatctttttttggtctgtcctgtcggaacaatttgcaattaatcgctgtacacctgctcctggtgactgcttgctaccaacaagttaaacaaaaaaaagaaaggtaatatgctgtcaaacaagac

SEQ ID NO: 537602 - DNA, 255 bp, Homo sapiens
  misc_feature (238)..(238): n is a, c, g, or t
tcataaaagagagaaaagagacacgtgcctatgtaaataagtgagctactttgttgtagtaatagatgagctgctgggaatgtccttgcataatagcatcattatattagtaacaggtgtaccaataaaaagatttacatgataggttaacaggaccaggacagtgagtttcctgaaggagttctttgttcctgatcaaagaaattgatacctgttagcattcactgccaccatattntaaggagaaagaactct

SEQ ID NO: 537603 - DNA, 358 bp, Homo sapiens
  misc_feature (145)..(145): n is a, c, g, or t
  misc_feature (318)..(318): n is a, c, g, or t
ggaaccttgatctgctcgccggtgttgcacctgcccaaccctgatcctagctgtaccttaaaaaaatgtgtctttcggccgggcgcggtggctcacgcctgtggtcccagcactttgggaggccgaggcgggcggatcacggggncaggagatcgagaccatcccggctaaaacggtgaaaccccgtctctactgaaagtgcggaaaattggccgggcgtagtggcgggcgcctgtagtcccagctgcttgggaggctgaggcaggagaatggcgtgagcccgggaggcggagcttgcagtgagccgagatcccgccnctgcactccagcctgggcgacagagcgagactccgtctca

SEQ ID NO: 537604 - DNA, 1520 bp, Homo sapiens
  misc_feature (196)..(196): n is a, c, g, or t
gattgagtccgtgtgtctactgaataaaagtcgtgctgtgcagttttgatggtctccatcagcgtgattattccaggtagtctgtgctaatctgctgcacggttcctcacctgtgtaccgcaccaggggacggtggaggatagcttgggggctgtaccctgtcacgaataggctgccattctgcctcgtctaagantgatgtagtcagatctcacgcagtttggttatcttatacacacaataaccacactctcaaagaagtagggtatttagttaaaaggagtagtgccacgcaagcctccgtggaaaaacagtccaagtgaaaaccaatctttaagaaataccttgttgagacttacgatcctaggcacgtgttctacaaaaggtatcccctccatgttcctatgacatcgagaagcaaggtgagcctctaatgggggtatcaagatctccttctcttgaacatgcttcttacaagtataggtaacacgcaaattgcttcagaatccgacgacattggagacgggtgtacgcatgatattggcgtggaaactcggacagcggaaaggcatcactttccgtaagggggcttgagtaagtaccaaagacttgtaacggtcgaccacaggagtgcctcgcggacaacggtttcttgcgtttagggaggcaccacgttacccgctgtgttcctaaccatggccacatacgcgtgaccggtcgtagtagcgggcgctatttaaataaaagctacgttttcaacgactaataaaggaaggccctccactcataaaatatccccccgaggcaagggaatacgtgagcgcaaaattccaagcacacgattcctaaggagagtttcgaagcccggtccctcgctggaaacgccagtcatgattgctcctcgcatttcgaagccccaagttccggccgttcccatatgaccttgagcgttgaatttggtagaaaccactccaacaacgcatttcaaccacagaaaatgaagcgcaacgaagataccttcggcaaccgtggggggtttttcccctattcgccgttgctaaaacactccgttgaaggagggcacccgttgtccgcgtaaacttatgagagttataccatatagtggcccaacctctgtgcgataaggaccattaagtgggcccggttgtaagaaccttcctagagttgcccgtttcgtttggaaattccacgcgggtttggaaagaccaagttccaccataactttccacgacaacttgattcggacccaccttgtaaattctgggtgagggccaagcgtagtccgaaatggccatgataaaggggtcggcagataagagcgagaagttccttctccaattaattggaaaaagtgttccaccgcgccattaaaggacccaagattcgcaattttacgtacagctgttaatttcgacaaaccactttttagacgctaaaatttaacaagcgtggggggtcttccccttttgtataaaaacgccttgcgttgctccaaagac

SEQ ID NO: 537605 - DNA, 679 bp, Homo sapiens
agcatttttagtaaagtgcctgtgtttattgtggacagagtttattattttgcaacatctaacctttatgaatatctgaggtgacacatgtgtgataatagaactagagctagtgggccaggcgctggtggctcatgcctgtaatcccaacattttgggaggctgaggcaggcagatcacaaggtcacagagatcgatgcaccactcctggatcaatcatggtttgaaaacccctatctctactaaatagatatcaaaaaattagctgggcgtggtggcgcgtgcctgtagatcccatgcattctcaggaggctgagtgcagtgtagaatcacttgaacctgggtaggcggaggttgctagtgaagccaatattgcgccactgcactccagcctgggctaactagtaggcaagactccatctcaaaaaaaaaaaaaccctatgatgcatagtgaacttagcccaatttggtgaaataaccttttctttataaggctgcatatgacataagtactgcactctgggcaccatggtaatttgtttatacaactcgtccctctgaaagccagggattcactggtccaggcactggtcccactgaagcgttttggacagcccgagcgagggtgctagcacaaggaaagttagtacaggggaagcactactgtgtgcccgcatgg

SEQ ID NO: 537606 - DNA, 1090 bp, Homo sapiens
tcccctcttgtgctcagtcgccctgttctggaggtctcttttctctactccagggttctcaatttatttgggggggaaatactttgagcagaatacaaggggaacaagagtctctacccctttctggtccgaagtccatttttatccctctcctgtctgaccaaaactctggtatggaatcaacaccaccgagctcgtgtgggcgaaaaaagaaaaactgtgtctccctttcgccttcgtgctggaacctggagggtgcataggccccgtggtgtacctaggtgcattagaatttcatagcttttttcccctccttttctcgtgatatattggggctcagagagttaccactggtgttctcttagtggtgaacttgtgcgccacgtttacccattttacccaacatgtgtattctgctcatactttccctcttggttctcaaacaacgagaacaaacacacttctacaaaaacagggggtttaatcaaaggctcaccaaaagggttcgcgtcttcgcacaaactgctccggggccctgcgcgctaaacagtgtgggacccaacttagcgccacaccccgtgggcatctcactccctatggggccagtcgtcacacacttggtgcactatttgttcgacccagaccactcccttgacacgcttacaacgacatacccccttatcaaacaataaacagtctgctcctcccataactgtcattccctttttgcacccactctgacccccattacacgtgcggcaccaaattcgcgcacacaacacccgtgttcccgggaactcactaaatttggggaaattttgcactttccctccatatattgaaaaactttgggtccccgtgatgctacttcttcaacaactcctcctttcctgggtctcccactcgtgcaaacgcgaccacacattacctgtcccccactttttcaacccacgttaacaaccgctgtccaacacatctagcgctttggctccacacaactaaaaccctaaatttgtttcccccccactacacatcaagcaaacacacacacatgcaccctcaccactccccacacaacctcactcccccc

SEQ ID NO: 537607 - DNA, 415 bp, Homo sapiens
tcatcccgaggcagatgctgacaacacctgtagaaccagcaagaacaaattactggagagtaggaagacccagccatctctgcccagtgccaggtgggccacagcatcatcctgagcttggactccctccctccatgattgcagactgtttctctccccagtctaatgatggaaggaagcagcagaccatggaccaggcagccaccatctctttcagctctggattagcacctgagaaaaacaggcaagacattctgtgcccacggatgatgaaaacccagcatagacttgcgctcccaaataaaagcaccgtaagccccttgggtttgtttctgtgtgacatgcagagctctctccctggcttctgagagatcttggtcaccttcctctctatccagtttaggtctgtggagat

SEQ ID NO: 537608 - DNA, 190 bp, Homo sapiens
aaagaagatgaagttccaaaagtgttattttggccttttaggagaagggtaagataaatgccgtagtgtgatgtgtacctggagaggaacaaataaaacaggtatttcttccgttggtggccatccactgggttgagaatgggagttcaaaactctatgatggactttgctgtggtgggtattttaaata

SEQ ID NO: 537609 - DNA, 350 bp, Homo sapiens
  misc_feature (13)..(13): n is a, c, g, or t
  misc_feature (74)..(74): n is a, c, g, or t
  misc_feature (129)..(129): n is a, c, g, or t
  misc_feature (170)..(170): n is a, c, g, or t
  misc_feature (185)..(185): n is a, c, g, or t
  misc_feature (207)..(207): n is a, c, g, or t
cctttaccttaanaaacttgcctttcctctttacggactcgcccctgaaatctttcttgtgccgagatcccaanaaccctctcttggggtctggattgggaaccttttgcggtaacaagggtgcaggancatcgtggaaggaatataaagtcagatcaagcctgaattantcgatatgggataantaagcagagatttgtggttcantgttttaacttgagaagctgagaatggctgtcttcatttgcttgtgagttgttgagatatggactcactgtaatcccagcttgggaggctgaggtgggaggattgcttgaggccaggagtttgagactggcttgggcaatata

SEQ ID NO: 537610 - DNA, 306 bp, Homo sapiens
  misc_feature (9)..(9): n is a, c, g, or t
  misc_feature (11)..(11): n is a, c, g, or t
  misc_feature (130)..(130): n is a, c, g, or t
ctcgtgcantntcatacaggagatgttatgattttccctgtactttcttgcttcacaagatttatggctggtttgatctttgtactccacagttgttttagattcatcacttttgtttgtcccacatccnctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgcccaatgggaggtactccttaagggggccc

SEQ ID NO: 537611 - DNA, 205 bp, Homo sapiens
tgataatcggcgactgggcgatccacgcaggaacggcagacctaacgaatcccagcgccagccccccgccacaaagcgccggttcttcagcaccagcttatagtcacgaccgagttctttcagtgcacagtttctcgcctatacgcgtggcgtttcaggcatggctcgttgcagaccgaaaaaggagatcgctgcccaatgcggc

SEQ ID NO: 537612 - DNA, 563 bp, Homo sapiens
ggtctcagccaggcgcaatggctcacgcctgtaatccctttactttcggaaaaaagaggccaaaggattgaggaaaattatgtttattagacgggccgttccctttgcaccacccaaaaggaagcccatttgaataagcttttgattttcatttcatatctattaatctcatggcaggctgttatgcctttcaatgtgacgatataagcctgcaggagtttgtattgcaacaacaaatttttttccctgcgccgcaaatgaggtctccttattgctaggcttgggtcacttttctacttcagctgtggatagcttcataacagctttcagttgcttttaatgtgcctatggcttcgggttttcgagcaaaacaagtgcaccttggtataatgaaaggaacttctttttacaaagggggggaatatttcctgggagggggacggtttcccaagaaaaccgaattgcaccgatattggattctttacaaagtggacagaatgttttgttgattccacaaggtttttgttaaaattggggcaaagaaaatacctggggttttaaac

SEQ ID NO: 537613 - DNA, 159 bp, Homo sapiens
caccctatctccaagggtgtacaatatactgcctacatcaacaaatcttatctcgtaccagggaaataaatctttccatcaaacgcgttttcttatatattgatccagacccacgtgttctggttgtatttcattgggtgtgggtattcggcgtgtgca

SEQ ID NO: 537614 - DNA, 416 bp, Homo sapiens
accagaatgttatccacttctacagtgaccttgttttttctaagtttcttatagaaatacctgtttgtcttgacttgcctttacgctgtttgcaggggccacttgtacgtcacctaaactcttactagataacatcactgccagaagtgcgctgggtcccacccaggcgcacttctgctgttcctgccaccgctgctgctgctgctggacgtccccacggcgtgcggtgtcaggcgtcccctctgcaagcgttacacttctttgggaatgggccaccacttcactacaagacaggctatctatacctgcgggggccccttaagaagtccaatgcatcgcttgtcgatgtgaccctctactataaagcactgtgcggtggctgccaagccttcctgatccgggagctcttcccagca

SEQ ID NO: 537615 - DNA, 326 bp, Homo sapiens
cccaaaaaggtcacccttcctgaggatgggcaccccccaggtttgcagctccggggacatttcccgggcccagcctggcagcctggccctcttggggccccctccccccagcccctgcctcgagggttgatactgcagtgactgccgccagccccccctccccctgaaaagggttgttcctgcctttgggtttgtttcccccaattccggggcccgggggttttttggccccgggggggttttggtttagggggtttgtttgttggggtgttttttgtttttgggttttttttaatgccaatgaagggcccctttgccctttccta

SEQ ID NO: 537616 - DNA, 167 bp, Homo sapiens
cgctaaaatgacccatcaacaggatttgacaaagagccttaaaaaagcgagtcaggaatcaaatcctggctcgcttttaattttgcaatattactcagataacgtgctccccaaccacgggtctaggtggtggtccgcactccggcgcagtacaacaatgggtttca

SEQ ID NO: 537617 - DNA, 160 bp, Homo sapiens
caggcagatacacttgaacccaggaggcggaggttgcagtgagctgagatcacaccactgccctccagcctgggtgacagagctagactccatctcaaaaaaagaaaagaaaagaaatggttgtgagtaggagtcataagaacattctgctggcctttta

SEQ ID NO: 537618 - DNA, 393 bp, Homo sapiens
ccattggggtggtgccaattaaaatggtgggagtgttctatggatgtcaattaaattctgttgcatgatgatattgttaagttctctatcgttggtgatttttctgtctggtttttctatcaattgttgagaaagggatgttgaattcttcacctatcatcaaggatgtgtctgtttcttctttcagttgtatcactttttgctttagatattttgcagctctatcttttcgtgcatacattgcagttgtactatgcgtggttttctttgtatttatcctgcttggggtttgttgtgtttcttgaaaaatgtgacttgatgtcttttgtctgggaaaattctcatgctgtgtgttgccagttttcagtaattaaaaatgtgcttttatgaatg

SEQ ID NO: 537619 - DNA, 431 bp, Homo sapiens
  misc_feature (312)..(312): n is a, c, g, or t
  misc_feature (342)..(342): n is a, c, g, or t
  misc_feature (368)..(368): n is a, c, g, or t
  misc_feature (416)..(416): n is a, c, g, or t
tgcaacccatgcctcatcacttaccctatccctggcaacgacgactcgccccaagctatccagctcttctgcaagctcttccggacaaccatcaacagggccaaggagaagaggaggcagatggaggccctgcatcggctgcagagtcccaaggggtccgagggcagtgggacatctcctgtgcctgataagagccattccccataacagaaagcccttctcccacactagatagccagccctcttctgagcaggaaggtccttgtccaaccctggtctgtgtccccactccctgtcctcagcatcagcaancacagtcctattttccttagatatggccancccaaaagtccaatgatcttgagctnacccttatctgtctcttttctgggaacaaactcaggtaaagtacctangtcacattggcctct

SEQ ID NO: 537620 - DNA, 130 bp, Homo sapiens
cgaacggtacactatgatttcagttcatgcaagtatcctcccctcaaatgccctgttaataaaatgcatgaaaccttgcaatagactaaatcaaagagcacagactgtattttcatgaagcaggaactga

SEQ ID NO: 537621 - DNA, 239 bp, Homo sapiens
gggcatctcatcagagctaataactaactaatattgcataaacaaactagccaacatgcactgtttttgtttgtttatgagacgagtctcactcacctaggctggcgtacagtggcacgatctacggctcctcctccgcctcgcacctcccaggttcaagcaattcttctgcctcatcctccctagtagctgggattacaggtgtgcactactacacccggtaccccggtacatgcaag

SEQ ID NO: 537622 - DNA, 421 bp, Homo sapiens
  misc_feature (5)..(5): n is a, c, g, or t
  misc_feature (10)..(10): n is a, c, g, or t
  misc_feature (42)..(42): n is a, c, g, or t
  misc_feature (46)..(46): n is a, c, g, or t
  misc_feature (133)..(133): n is a, c, g, or t
  misc_feature (264)..(264): n is a, c, g, or t
  misc_feature (275)..(275): n is a, c, g, or t
  misc_feature (304)..(304): n is a, c, g, or t
  misc_feature (348)..(348): n is a, c, g, or t
  misc_feature (368)..(368): n is a, c, g, or t
  misc_feature (376)..(376): n is a, c, g, or t
  misc_feature (412)..(412): n is a, c, g, or t
cgcgngtacntgtgggctggctctgcgggcctggcctgctgnctgncaggagtcatcttcatcgaccggaagcgcacgggggatgcatcagtgtcatgtctgaggtcgccagacctgctcaccaggacgtganggtctggtgtttcctgagggaacgagaaccacaaatggctcatgctgccttcaaacgtggcgccttcatcttgcagtcaggccaggttccattgtcccatagtcatgtctctaccaagacttctactgaanaaggagcgtcnttcactcgggacaatgtcaggtgcgggtntgccccagtgccacggaaagggctgacaccagatgacgtccaantctggctacagagtccggantccatgtnactgttttccgggaaattccactgattgccggggtngtgtgctat

SEQ ID NO: 537623 - DNA, 220 bp, Homo sapiens
caccatctagaagcttacagggtagactaaccggtaacattactgctaggccacctattcatgcacctaagttggaagcgccaccctaacaatagccacgattagccttccctctacacttgatcatcttcacaattctaattctactgactatcctagaaatcgctgtcgccttaatccaagtcctacgattttcacactatctagcttagcgtcggga

SEQ ID NO: 537624 - DNA, 1003 bp, Homo sapiens
gtaaaatccagcccatgacccctaacaggcgccctctcagccctcctaatgacctccgcgactagccatgtgatttcactttccactccatcacgctccgtcatactagcgcctagctaagcaacgacacggtaaccatataccaattgatggcgcgatgtaagcacgagacagcacatccacttacgggcctaacttaattacaccacactgtcacaacataaaggctcttctgatacagtggataatacctatttattaccggcagaagttttattcttcgccaaggattcaatctgcatgtccttttaccaactccagcctagtcaaccctaccactcacgcaattaatgagcgtgctactgcggccctccaaaagtgctataatcccgataaatccacgtagaagtcccaatcgtagggacatccgtattagtcgcatcaggcgtgatcaactcaggctggaggctcactcattagtcttacctagaaaacaatccgaaacccacactaattacaaagcactggttcatatacccattcctatgttgggtctccttatatgagcgcctcctacattagcctcgacgacgtaacttgcgatgatcttaccgcttcagacactttcccgacggcatctgacgtgctcaacatttcaggcaacgatcagcacgcgcttcccacggacgttccagcgtcatccttggctccatgtttccttcacttaatctgcttcatcctgcctaactagtatcatcacttttacatcctaattatcaattcggctttcgaagaccgccgactgataactggcattacgttcgatgctcggactgcctcattcccggatgtcctcctctatcgcacgaggggctctacgaagaactacaaaaagctccataactagcataccaccggggtcaccactaggcacccgcgtggccaaacacacggacccgtcacaaaaggccccaagggacaaaaaacaaagcgcacctacaaa

SEQ ID NO: 537625 - DNA, 604 bp, Homo sapiens
  misc_feature (107)..(107): n is a, c, g, or t
  misc_feature (203)..(203): n is a, c, g, or t
atgccgaaggaacaaagcttcagggcttgggttggtgtctcccactatcaaggaggtgctcggaagtttcccagtttcagtttcgtacagtccttacaagtatttanagttgttgtcaaagatgctgcattaactcaggcaggtctacataggcatcgctagcatcagacatgtctgtaatgaagtaatcaatgacagagatntgggatttgcgtatgctgcaggtatctctgtcacacactggcatcacctcaggtaagccctgctgcttctcttcatcagtctgagacaaatattcttccgaaatgcgtgcagcccactcgatgcagtactgcaggggtcgtcagggattgcacacatcagcacatttaatcagcattcgtttgattagggtccggttctctggagtcctaagcatagtgtttatcgcttcctggtgtttatcagtttccccatgttcttctagtgttgccaagggtttgttgatgctgttgacaaatttgttgacatgctcaaagtgctctgtcatctctgtggctaagataaatatattgcatttatcatctacagtggtcagctgaaaggccaagtccgcatggtggct

SEQ ID NO: 537626 - DNA, 336 bp, Homo sapiens
  misc_feature (325)..(325): n is a, c, g, or t
  misc_feature (327)..(327): n is a, c, g, or t
cctcccttccttcccctagtaggttgtgggttagaaattacttttttttggggccaggcgtggtggcctcacaccctgtaatccccagcactttgggaggccgaggcgggtggatcacttgaggtccggagttcgagaccagcctgaccaacatggcgacaccccgtctctactaaaaatacaaaaaattagctgggtgtggtggcacacacctgtaattccagctactaaggagtctgaggcaggagaatcgcttgaacctgggaggctgaggttgcagtgagctgagattgcgccattttactccagcctgggcgacagaatnantctccatct

SEQ ID NO: 537627 - DNA, 658 bp, Homo sapiens
  misc_feature (305)..(305): n is a, c, g, or t
  misc_feature (362)..(362): n is a, c, g, or t
  misc_feature (424)..(424): n is a, c, g, or t
ggaagaacatccgagaagggagaagctaagcccgacacaacgccctgaggcctggagagacaagctagttgctggcggtagtaggatgagagcgcgtggccggtctctgcgcgaggatgggtgggaactgtggggcagttcttcgtcctcgcgagaagatcagaggactcgccgcgaacgtgggtgcagagccgtgcagaacggacacggacgcgctcctgtcagtggtgctggacgtaggtctcggcatcgtaatccagcgaatctaggaagtagtgcgccggtcaacccaagggtttcggggnccgacatgtgaggtactactgggaaccattcaaaggacttgacgctgcgacctaggnatgcgaatgactgcgtagatggctacatctaccttgattcttggctatctctgagaggacantcaccgccgaagtccatgtaatgtgatcgaatcgctggggtgggtcaccttcttgtggaagcgcattgatgagactgtgatgacatgtagtacacatgtacctggtgagacatggcagagacgggcatctgctgatggccgaggtccaggcgggcatggcatgggatgtctcacgggcaattatggatgtcgtatgtcgtggggacacataacaaacctgggcactacgttcgg

SEQ ID NO: 537628 - DNA, 135 bp, Homo sapiens
  misc_feature (19)..(19): n is a, c, g, or t
  misc_feature (67)..(67): n is a, c, g, or t
  misc_feature (73)..(73): n is a, c, g, or t
ccctagatgttcctggaanttggccccctttatgaaaaccacttcccacagccagtggaactgccanaggaanatctggcgtcgcatggctcccaggaaagtgctgtgcctatccccactgataccatctgattc

SEQ ID NO: 537629 - DNA, 475 bp, Homo sapiens
  misc_feature (20)..(20): n is a, c, g, or t
ccacgcggcagcctggccanaaccggggaggctgggaacctggaggaggttatccaggacctgcgggcccttagggcgctggtcaaggaacagggcgcccgctttttccccctggaggaccaattgggccgcatggaaaacggggatgggtagggccccacccccacgccccctttttttcctccgccgcccccttccccctcagtttttgccagggggtggccccgggctagtgggctgcccaaagcctttggggcagggcagggggcggttcccccccccccccgtcccgggcccgggccgaagccagggcccagctttcccccctgttcctgggggggatgtttcccccccggcgggcccccccccctttggggggccctccccccgcccccggccccgccctttgcccccccccccgggggggggggggggggggctttattttttccttcccaaaaaaattttcttttta

SEQ ID NO: 537630 - DNA, 368 bp, Homo sapiens
aattactgatcacatccaaagggaaggtatgcagtctggcggtgtgtgctgtggcttggttgtggccacgtacggatgctggggctggatgagcgtgagaagtcgctgcacgctgatccgccagctggcagggccactgtttagtgagacaccaccctgcagttctaccatgagcgggtggtgatcatgaactcgatcctggagcgcatgtgtgccgacgtgctgaagcagacaggcacgcagatcaagtttccctccaccggggtggacaaactgccctactggacaactgctgacccccaagcggtccatcaacagaggtgctggcggacactttttgccaaggtgctggacgaagggctggctgg

SEQ ID NO: 537631 - DNA, 161 bp, Homo sapiens
  misc_feature (46)..(46): n is a, c, g, or t
  misc_feature (73)..(73): n is a, c, g, or t
  misc_feature (136)..(136): n is a, c, g, or t
ttttagtcattgccggccgcagttttgcaatagctcttccccaccnctcattttagtaaaaacaacaaaacanaaaacctgagaagtttgaattgtagttaaatgcccaaactggcatttaacactgtttataaanaatatatatatatatatatatatat

SEQ ID NO: 537632 - DNA, 268 bp, Homo sapiens
gcccactgcaattttttttaaaagggagaggttaagaattaggtggtatttggttttctgttcgtgtgttagtttacctaaggataatggcctccagctccatcccatgtccctccaaaggacatgatctcgttctttttaatggctgcattggatcaggaaaaataactaatgggcttaatacctggctgatgaaataatctgtacagcaaacccccgtgacccaaatttacctgtgtaacaaacctgcacatgtactcctgaactt

SEQ ID NO: 537633 - DNA, 467 bp, Homo sapiens
tctagaggatctgcaaacacgcaatctaaagaaaagaaaacttgaggctgggctgcagttggctcacgcctatatcccagaggctgaggcaggcggatcacctgaggtcgggggttcgggatcagcctgaccaacatggagaaaccctactggaaatacaaagttagccaggcatggtggtgcatgcctgtaatcccagctgctcaggagcctggcaacaagagcaaaactccagctcaaaaaaaaaaatgaaagaaaggaaagctggagctggtggcttaggccaatcacccttcccttggcaggacctactggacagacccttttgagatgtccctgtggtgctgtggagatgtgtgtagtggtctaagctcttggtggagcttgtgagtgtgtggtgtagtcatagctgaatgctgagattgcgggtgtatgagggcgtctaagctctttggtgagattgcggt

SEQ ID NO: 537634 - DNA, 1008 bp, Homo sapiens
atctggtggttgtctcttccaaaagggggttctgtgtccctttgatatcacgtccgaggctttgcctttgtaagtcgcaagatgtggtctttgttttgtcggggtgtgctgacccaggtgagctatgccctcaatttgggcgtgtcctaaacaacgctcagtggtgggaacgctgtttctgcacagcggctccgcgccctctttggtgtctagttgggatcccgcccgtctgggctatgtattctggcatcgaaagatcggagtgggggtcccaaggctctaaacgagtgttgggtgactcaatgggccctgttttacgtgcgcccttcgatggcgtgtctattccaccaggtgttgggagcattctctcctcctcgattgtgtgactagtcttgcttcgctaccccccccccattaggggggcctctcttggctaccaagaaatccgttgtgataggcatgccccccctctcttttgaggggttgaatattgctaacgggtggctccaccactggcactctcctccaccctcgcccccacactgtctgccgctcaaggtcggtggtgcgtcgccccccgatgctcgctctctacgaccctcagcgttcgcagctggctatgctgacgagtcatgcggaatgccgcctgcttttcggcgcgccccccgcgcgcgaatcccattctgaagtggacgtcggtgcgcctcaccccggcctcctgccctagcaccaccccgcggtgtgaggcggatgcacaacaggggaatcactgtccgcccgccaatgggtgtccactatcggggcgtctgtatgctgggcgccagacccacgcgcggcgcgccacaatcagcgcgacggcaaagaagacgtgcgtgggagaccacacactcggcggggcacgcaagagagaggggaggagggcgaaggcgagggggtgaccaaaacaggcgccccaggccccctacttgggttaaaaaaaaacaggtcgcttcttgccccaaaaaaaca

SEQ ID NO: 537635 - DNA, 234 bp, Homo sapiens
ctaagtgcttggtggctgcgttcatcccctcacggtcagctcaggagagagagtacaggacttgggaatccagaaagttaggtccagaacctgcctgtgcttgtgtgcttgagtgaaattgatgctctcctctctgggcctcagtttcctcatctgtaaaggtgatgggaggatgctagagtgaggatggaggaattctgccctgtgtgtacctgagctctgaattctgtactc

SEQ ID NO: 537636 - DNA, 217 bp, Homo sapiens
acccactactggtctggacaatttaatagtataccaactgatgaaacaaccaagtgcagttggtgtacggctggagggaaaaaaaaaaagactttttacaggtttaactttgtaaaaaaatgtatcttttggaaaccatagtctccttcacaaattgcacttgagatggctgaatgcattgattgagcaaggcattattatttgtggccagtagtgg

SEQ ID NO: 537637 - DNA, 154 bp, Homo sapiens
ggttgagcacctgcgtttgggccagggcatgatcctggagacccggggtcaagtccgcatcgggctcccatgctatggacgcctgcttctcccactgtctatttcttttcctcatatctgtgtctctcattaataaataaataaattcttaaaa

SEQ ID NO: 537638 - DNA, 213 bp, Homo sapiens
taatgaaacgcaccacgactttacgacgttctgcctcttggttgtaccactactttacaactgtactttacctttacggtgtacctacttgaacgtgtaccccctaacaactggtctctgactggtacacttttagttaccctgtacttttactcaccagtacagtaccttaactggagttaaacttacacacacttggttacttattttacg

SEQ ID NO: 537639 - DNA, 844 bp, Homo sapiens
ttccgtaaaggaaagccactggctctggtaaaagaactcagaaacagaaaggatgtgaaggtgttaatgtcaccaaggaaaacagaaaccaccttctgccagatatcgtgacgtgcgtgcagacaagcgagcaggaagtgaagaccacgtgcattcctgccttccgtgatgggacgtgcccagtttcaagaggagccttgattggagccccttgcctgttcgaggctgttatgcctaatggggggtaatgcgaacccttgttgggggcttttcctagaagaaaaacttcaaccagctgtttccccattaacacagtggtttaaacacaggatcaaaatttagccttaattgctgggaattgtctggtaacaaagattaaacttattccaatttgtgcgttaatctatgctttaaaaagatttcctttgttcacatttccctctttgcaggttcatgccacattgacatttggggtaaactggttgcgcatgcagacaactggtctcccagcacgtatcagcatggaaattccaccccccgtagaagttcattaacactgttgttcccagggcaaacgcccggggacgggaaaacgacagttcaaggttgggccataattcaaggttttgcattgtccactggaaaactataacatttccctcctccaaggtttgccaggctttcatcagcctcacatggccactttaacagctgatacacacgttaactatagactgtgtaacaaacaaattattttttcgcaaaaggaaaaccccttttagggtacattctgcccccaaacttttggttgctacactggctatattaaacgccacaaacatga

SEQ ID NO: 537640 - DNA, 348 bp, Homo sapiens
ggccggtccaatcactgtagtttccatccagattttttcctaaggactccaatgtggaataaaagtttgtcactttcaagggcaaacacttggcaacaattacaagtaacgccgagtcaggattccaggacctggactgcacgcagcaataggtgtggaggtctatttagttttctccatacgatttgcgccagggtctcagccaatctccgattggttacgtaacgcttaaagtctaagatggagtttaacaccctccttggtgagttcctgaaatccggatccggccacagctgcggagaggagtcagacaggccacggcggttcctcgccggcaagtgctttcgc

SEQ ID NO: 537641 - DNA, 294 bp, Homo sapiens
tggtaagtcatgcacgtcggcgatcatggccggctcagcatggtcagggaacccagtgctacttcttccatgagccaagctctaccagctacgcctccagagtgggagcgggtcatgtcaggtccaactcggccccatcttcctctccggggtctccgtgcagcaggagttggagatcatcaaatgagcggctcgagtgggtcactcaggcatctcataaagctcctcgggaatggggtccccctcggcggctgaccaagacgcaggtagcagcatgagagacaggaagagcgc

SEQ ID NO: 537642 - DNA, 445 bp, Homo sapiens
aaaggggctttcggaaaccaaaagggggggttaaaccgtgggcccaagggggcaaactttaggggaggcccccccccccccttttgggggaagggcccccaaaaaccgtgaaaaaaaacccccccccgggttttttaaaggcccgaaaaaggactttttccccgggaaaccatccccttcagtgtgcagggggggccccaaagaattttaaccggggggggggggcccttccccaaaaacctgggccccaaggtgtttttttaatggattgggacgtgaacccttcgccccccttttgaattggaaaaaagaaaggttgggggttggattttttgttttgttgggttgttgggttttaaaaaaccccccagggggggacttcattttttaaagtggggggtgagggccccttcaaggtttttcaaaaattggttttgggtttccc

SEQ ID NO: 537643 - DNA, 1061 bp, Homo sapiens
  misc_feature (27)..(27): n is a, c, g, or t
  misc_feature (110)..(110): n is a, c, g, or t
  misc_feature (113)..(113): n is a, c, g, or t
  misc_feature (126)..(126): n is a, c, g, or t
  misc_feature (185)..(185): n is a, c, g, or t
  misc_feature (270)..(270): n is a, c, g, or t
  misc_feature (306)..(306): n is a, c, g, or t
  misc_feature (701)..(701): n is a, c, g, or t
  misc_feature (732)..(732): n is a, c, g, or t
  misc_feature (753)..(753): n is a, c, g, or t
  misc_feature (762)..(762): n is a, c, g, or t
  misc_feature (789)..(789): n is a, c, g, or t
  misc_feature (879)..(879): n is a, c, g, or t
  misc_feature (900)..(900): n is a, c, g, or t
  misc_feature (912)..(912): n is a, c, g, or t
  misc_feature (918)..(918): n is a, c, g, or t
  misc_feature (951)..(951): n is a, c, g, or t
  misc_feature (972)..(972): n is a, c, g, or t
  misc_feature (993)..(993): n is a, c, g, or t
  misc_feature (1060)..(1060): n is a, c, g, or t
gggaagggttgagggggggggagggcngggagcttgtcttgtagctagttaggtaaaacctgtagtgtccctgtgggaactgctacgcgttgtcttccagctaggctctngtnctcgtctgcctcncacaagatctgtgggctctagtgtgctagctgcttcccctactctcagctacagctgcngaggggccctagagcccccacagaaaggactgttccagcctcgggagccagagatggctccctccggacgggccttatccaactncgccctggagtgtggctggtaggaagggacagaganagaagggacagaggaaaggggctgttccagcgcaagaaggcagttccactgggaagtcagttaggtccggcggcagcgcttcctctggcagggccgaggctcgcgactgcgggggtgggcggaggtcgctgcctggggatcggacactggagccttgcggcggctgcgactcatgcgcaggacccagcgcagcttgtggtgtggcacctgcttgaggcgcgcggcggcagcggcagagcctccagcgtgtgttccgagtgtggcgcgcggctggcgcaggcggtggcagcgcaggtactggagggaagtggcgctggcacaggagcgggtgagcttcatgctgctccgggccgccgtggagcacaccatcgggtagaatctcttgttctgcagcntggtggctgccacaactatacacttcctgtncttgaaaaaggtgagttttcngtgccaggngtacaggtgcacgccaattatggagcnctggccgaaccgcgacgagaagctggtcttgttgcccttgttgtggaggaggcccgttttggagaggccccagctgttctcatccctgcncagcaggctgcagaacgtgtnggggtatttgtncaggtncacatccgacgtcccgatgcccaccatcatgtnggtgccgtagacgggagaggncatcttgatctcccagaagtnctggccctcccccagccccttggtgccccggatgggcgccgtgccgcaccggttctccatgttgganc

SEQ ID NO: 537644 - DNA, 183 bp, Homo sapiens
agatagggtatccaggacccaaaggtgacaggcgccctgttgcgccaccaggtcatcctgtgagtcacctggccctcgaggacacaagggagaaaaaggagacaaaggtgaccaagtctatgctgttcggagaaggacgaagaagtattgctgtcaagcgcgtgagctagccagtggcaggac

SEQ ID NO: 537645 - DNA, 210 bp, Homo sapiens
  misc_feature (26)..(26): n is a, c, g, or t
  misc_feature (69)..(69): n is a, c, g, or t
  misc_feature (109)..(109): n is a, c, g, or t
  misc_feature (111)..(111): n is a, c, g, or t
  misc_feature (124)..(124): n is a, c, g, or t
  misc_feature (134)..(134): n is a, c, g, or t
  misc_feature (140)..(140): n is a, c, g, or t
  misc_feature (145)..(145): n is a, c, g, or t
  misc_feature (195)..(195): n is a, c, g, or t
  misc_feature (209)..(210): n is a, c, g, or t
gttggcggcggggtctgtggcaaggngtgcggtccagtctcttagggcgggtcgtctgttcctaaattntaggtgttgatgtttggatgtcacggttaggaaggtgggnanttcttaatgccantggagggggntgtganggaantactacctacactgggacaagtgggaccagggagccactgactggacgtnacgtgctgtggtcnn

SEQ ID NO: 537646 - DNA, 198 bp, Homo sapiens
cccacgggcaaaagaccatgtggaagtttcaagtaagatagaagaaaagcctccaagaaaaaaaacacctgcttgagtaagaaatgataagtcaactgaatgctgctgtgaatacgagaaaaatgagatatagaataaccggaagattaagcagtgtggggtaagggcgatgatggctcatgcctgtaatccccagca

SEQ ID NO: 537647 - DNA, 207 bp, Homo sapiens
ttggctaggtatgtcagagcagtgaagacttgcccctcctttcgcagctgagtttagtccactttacacgactatgtatatcttacccaatatgtgtagtatcgatccaggcacgaccctacttgacctttcaagatggaaagctagaggttttctacgagacgtctaggaagttcaagaaggtctacaattcctcaaagaacacag

SEQ ID NO: 537648 - DNA, 455 bp, Homo sapiens
tacgtccagttccggcgggcatgcaatgagacccagttggcggccagcaggggaatatcatgcggatggtggagggcttgacgatgtgctggtggttgtcatcttccaaaaggatacaccataggattcatgggacacgaccgccgtactcgtgtggcagcggttcgtcttggccttatattagtggtaggcccggccagccgtgaacgagtggattcgtgaattcggccacctcgaggcaccacagcaatgcacagctctgtctggctgaagagataaccttcatggagccggagggcaggttctacacggtgttctgcattgcgttctcagggattgttgggagcatagagcggtggcataggtccctggatgtccgtggccatcttgccaagtgtcgccaggattcgcctccaggcagtagaggatggtacccatcggcatggtgcccacag

SEQ ID NO: 537649 - DNA, 118 bp, Homo sapiens
tactgcccctagatagttcacaagagaagtcgttcattcaagttggtgtaatcagctaggggaagtagtagaatagtctagcaaaaaccagaagcggcaaaaggcaggtacctgctca

SEQ ID NO: 537650 - DNA, 450 bp, Homo sapiens
  misc_feature (78)..(78): n is a, c, g, or t
  misc_feature (116)..(116): n is a, c, g, or t
  misc_feature (119)..(119): n is a, c, g, or t
  misc_feature (443)..(443): n is a, c, g, or t
tctgtcccgctgtatgggggaagtctctctcactttgggatcctgctgaagctaggtcatgaggtcggaaatccccancacatttgcctagactttgggcacaggagttcttagtncancaaatcagagagaggatgggcttttgatcagatacccctcccaaaaaaaaaaaaaaaaaaaaagttaaggcaaaattcaaacaaattcggggctggagtaaaggggggggggtagggggaagggtactatagaccctcttttggcccaccttaagagagccttctaagtgtctgagcctcagcgggggagtaagattaatgggtctctaaaatgaggtcaggggatagatgcttggggggattgggagtagaacctttcatagtgaatttccactcgggccaatctgagttggaggtgggtgtccggaacattcctccagcttnggggggc

SEQ ID NO: 537651 - DNA, 739 bp, Homo sapiens
tctctaaaatatctccttggtctgaaaattgatggatatgtcttttaacttaatcatttcttagttctaagactctcagcccaaatttcatattcaaggtattaagtcatatgtgattggtacttcacatactattagagaagccaatttagtgaattttacagagcacagaacatcacatacttaaatataatatggccatattacatgatgacatttaattattcagtttcttgataaccaaactatattagaatttaattaaaatatattattgagaagctaaagtttgaatatatctgtggcaatgattttcatatgttaatatttcttagtctgtgctggcaggtgactgagtacttgctgtcatatcatgcttatgtgacttgttatatgtgctttgcatgatggagttgacacatggccttttacaaactaaaccttcaagattcagaatgctaggcagctcattaacatatggcctcaatccaggtgaccaagcagtgagtctggagtcctggtcaatttagcaatttgtgatctgtcatcttaatataacttcctctcatttaactttctttaagagaaatagactacctcacccatagtaatctggttttgacgaggtaacaaaatactcatttctattgtatgaacttaaaatatagtgtacatttatttttgtaagtcttacttatatgcctaaattttctataataaactgatttaagtctaaaaa

SEQ ID NO: 537652 - DNA, 412 bp, Homo sapiens
  misc_feature (29)..(30): n is a, c, g, or t
  misc_feature (32)..(32): n is a, c, g, or t
  misc_feature (50)..(50): n is a, c, g, or t
  misc_feature (79)..(80): n is a, c, g, or t
  misc_feature (93)..(93): n is a, c, g, or t
  misc_feature (145)..(145): n is a, c, g, or t
ttcagcacatgtagtcaagtaggatctgnnantatgcacagtaaatccangtcttggttggtttttctattaaaaagcnntcaagaaagatanggtgaaaaagaaaggaatttagaggtagggaaaagatgattgtcagacattngaagaactatagtaaaatgataaacactaaaggtgctgaataaaatagagtccttgactactaaatccagtatctggggtcatcactacctccgttcctatggagtttttttctttggactatgagtttcatttccctggtaataatgtctattttgaaattatatgcctgacattatacataaatgtggtagagactctaggtcggtgctggtcactatggtagctactaactggggtatggcttccagtggacactaatggtgct

SEQ ID NO: 537653 - DNA, 1005 bp, Homo sapiens
tgcattagggtggctgtcgttttcctttacattgctctcggttctgtctctgccgttttggcctgggtccagagttcgtgaggtacccattgtccaattttcctcgtgcctgctttctttgatgtttgtgtgccggctctttccctagtgttgctatgtgttctagtagccttccatgggttgcacctgcattcctcataggcgtacctcctgccctgtgtttggtcagcatccacctgtaggtcccttctccctgcttctgctccctagtgacacagtgctggagggatcctactgtggccctaagaagcagattggcccgcagatgctgttgtataggcctcatgtcgtggtcctgcactctcgctacatatgagcagcctgtggcatctgcttgcgttggactgctcctcatggtgtcttcacgggtactcagccctgagttgaaagggagctatcacggaacagctatgggagccccagggtcttccctacctcaggcaggaagggcaggaaggagagcttgtctgcatggggtcgggctagggctgatctagtaagggccagtcctgctctggccaggcagttctgtgccccatgcctgtccagcctgggcagccaggctgccaaggccagagtggcctggccaggagctcattcaggcctccctctctcttctgctccactccttggcctgtctcatccaccagcgggtcccagaccatccccagggctctctgctgtacataatttgagactagttatttattccttgtgaaagatgatatacctattctcttcgtctaacgcgtcgtctgtactttactgtcgctgaggacgctgtctggcttgcagtgcgcgtgcacgtggagagctggtgcccggagattggacggcctgatgctccctcccctgtcctggtccagggaagctggccgagggtcctggctcctgaggggcatctgcccctcccccaacccccacccacacatacttccaggtctt

SEQ ID NO: 537654 - DNA, 513 bp, Homo sapiens
ttaaactttttatttggtcaacagccaaatatcatgttttttctgcctctttgcactcataacgtgagacgctggactccaaacacacaggtataataacgtaattgctaacgcggggaaaaaagacacgtttagcttccggagcggagctatgcccatctaccagggatggggaggccactactggaaataactcttggactccattctccatagtccacatgtaatgaactttacaggctgagggagttagcctttaatgcttctctttaaacaaagagtacgctattaaaaaaaggtaggggggcagggacattcttgggatactggatatgcacagaaatttgagagactcattatgtagataccactctgataaggagcaactctagctgcctgggagggggatgggaatggcaccttcttcgttagagcgcctaaggagttcacagactcaatttgacctactggaacgacgtgcactcttactctggggcatagctctactcatgc

SEQ ID NO: 537655 - DNA, 169 bp, Homo sapiens
cagactggttatgccacaagcacgtatctctatattgctcagtgaaatatttagtaaaccaaagattttgaccactggtctttataattatggcacaaaagcattgagacacctgctattttctgaacgagtaatcagttcattattatactcaagacacggtatgttt

SEQ ID NO: 537656 - DNA, 321 bp, Homo sapiens
  misc_feature (10)..(10): n is a, c, g, or t
  misc_feature (68)..(68): n is a, c, g, or t
  misc_feature (184)..(184): n is a, c, g, or t
  misc_feature (244)..(244): n is a, c, g, or t
  misc_feature (255)..(255): n is a, c, g, or t
  misc_feature (259)..(259): n is a, c, g, or t
gaattcgggnacgagcggcacgaggcaagacagacctcttctgtacaaaaaagcagcagcagccaggngcagtggctcacacctgtaatcccagcacgttgggaggctaagatgggtgaatcatctgagtaaggtgttcaagaccagcctggccaacatagtgaaaccccatctctactaaaantagaaaaaattagctggatgtggtggtgggtgcctgtattcccagctacttaggaggctnaggcaggagantcgnttgaacccaggaggcagagattgcagtgagctgaaatcacaccattgcactccagcctgggc

SEQ ID NO: 537657 - DNA, 220 bp, Homo sapiens
gacaatagacattatatactaaaatgtgaccagcaagtactatctcaccacatgaaacatggcagtgaaattttttaatctgcgcgttcaaatggaagactcagaagagattcttttatggattcagggcaagtgctaatgaggaagcatggtgattgaagcacaaaacactgaattcaggctaaataattctgccacatattttcttattatttttttg

SEQ ID NO: 537658 - DNA, 161 bp, Homo sapiens
  misc_feature (129)..(129): n is a, c, g, or t
gagcggtctagtatcacaccaaaagctcgacgtggaattattctccgagggggttgcagcaaagcatgtgtgtttgtgaagtttcaagcttattctcagcacatgggttcaaatgctgtgaaccaaccnttgaaccttgacgaactgagaccgctctaccg

SEQ ID NO: 537659 - DNA, 137 bp, Homo sapiens
agtgcgtaggggggtacctctgctggcccgccaggctgtttttgaactcctgacttcagtgatccgcctgccttggcctccaaaagtgctgtgattatagacctgagccaccacgcctgtgcaggctaatgggattt

SEQ ID NO: 537660 - DNA, 835 bp, Homo sapiens
tccttccaaacgctatgggcttatggttattcctatactggtcacacaagtcaaccataatgtaccacaaaaactattctaccacagtacgtaatggtgctagatagtaaactgaactgtatggctctgacttggctacttgaccactgtgttggactggattaccacacccctttaaactatcatactcttacggacggccttggcgttattcaaacactatcggttcaactatctaagcaaagaaccccactggtaggtggatacaaccgggtggtcttcaccggggtagtcgtttgaagacacacgctttacacgcacactatttaatatacccctatctatgggttccgtccccactcggtacctaccaactaggaactgttcactacttacgttataaacagccctcacaaacgaatgacttccaaaccacagacatgaaggccacgaatacacaaatgtggacacgaaaaaaacatttataaatcctatatcacgacacaacctggttacgacgtagtcatctcgcaaggaattccctcaaccactggcaaatatggtgttactgacggtcccttccttccccagcaacagtgaacaaaagttgttgtcatagcaccttaccgcctacaagattcatacacaagtgcggagaataatccaccggactaccccagtattaaccaacaaatcaaggtgaaatatgcattggtagaacccccttgatccaggttaaccgggccccctggaggaataaatagaagaagcattctaatatacttgtttactagacttctagtgagccgatcaggagtcatgactacaggtgggg

SEQ ID NO: 537661 - DNA, 122 bp, Homo sapiens
  misc_feature (34)..(34): n is a, c, g, or t
tcaggtcggtaccttgcatatggcatgccaaganttgtgtaaggcagcgctgagttgaagagacgaggaagatgaaccacgtgacgaaatagagtgcccctacttggccttgccatatgcaa

SEQ ID NO: 537662 - DNA, 343 bp, Homo sapiens
  misc_feature (30)..(30): n is a, c, g, or t
  misc_feature (101)..(101): n is a, c, g, or t
  misc_feature (216)..(216): n is a, c, g, or t
  misc_feature (311)..(311): n is a, c, g, or t
  misc_feature (327)..(327): n is a, c, g, or t
cccttccttagaagacttgactggtcttanattgctgcatcaagaaacccaagcttgcttgagatctgggacatgagcgacgatgagaccatttgagatgncccgctgtggggctgacttctccctggccgcctgctgaggagctctccattgccagagcaggactgctgaccccaggcctggtgattctgggccctcctccataccccgaggtcntggatcccccctctgcttcccaggagtggccagtgttcgctgttgcttggggattcaagataccaccagttcagagcttaaataataaccttgcntttgccttgctattgncctgggaaaaaaaaaa

SEQ ID NO: 537663 - DNA, 948 bp, Homo sapiens
tttatggcattggctggtcttgcagtgcgggctgttgaccctctgccgcgctcggggctccgtgtgcctgccgctcctcctgctctggcctgagtctgccctgtggctcggctgcgcgcttgtggtgcgacggctctgtgcgtggctgctggactgcgcagcatggcgtgtggagtgacgaggggctccgggtcttccagagctgtgaagatcaatgatcgtgtgaagccaaaaaccttccctcttaccctggtggccgagcaagatgagtgggattgctactgcactgtgtgaacctggaccagtgaggaggttttcagtgaccaaaattgtggaaaagtcactctgcccgttttacgttgagaagacttttactgtgaacgttcctcgtgagctatcgtcacctgtccttctacattttcgatagatgacgtattccggagggattccatcataggtgaagtgtggccatccatgaagtgagtgacttgcagaagtaccacaagcaggtacacctggtccagctgcagcacgtggacgctgactcgtgaagtgcagtggcaaagtgcacctggagctgcggctgagcgaggtcatcacatgacactggggtcgtactgccacaaagctcgccaacgcatcgtcgagtgccagggcctccccatcgtgaattgggcaatgtgacccctacgccagctgtgactgcttgcaggagcccttcagatcagaagctaagaagacgaaagtgacgatgtaagaccaaaaatccccatttcgagtaaagttgataatattatgacaggtgacccggtgccctgttagcttataggcacatgaagtccacttagaatttgagggaggaagaagtgtacagagctacgagatcagagttaacactgaagtgcagtaactgaagttgggagatgaatactggaagaataaggtaac

SEQ ID NO: 537664 - DNA, 254 bp, Homo sapiens
caggtttatgcaccattcgatcactggcctgtctgttgtgcaattgggcagctggactgtagggtcttcactcatggtcagctttctctggttcatgtaggcgtgggccacacccacattgaggtgatccaccaaagcttctgtcaggcaggtcgctgcagtgatagcctctcgcctcctcttttcctgcagctccttgcgttcattctgcttggcctggtgttcttttaggatggcgggacagcatggtcacg

SEQ ID NO: 537665 - DNA, 81 bp, Homo sapiens
  misc_feature (16)..(16): n is a, c, g, or t
  misc_feature (44)..(44): n is a, c, g, or t
tttacaaagtgacttnaaaaaactttattgcagcttcttagagnaaaactgagtgtgcagtgctaggaccatgttgggatc

SEQ ID NO: 537666 - DNA, 344 bp, Homo sapiens
cagcttatttattcttatttttttagaggcaggttcttgctctatcgcccaggctggagggaatggtgcagtcatagatcactgcagcctggaactcctgggctcaagtgattttccacttcacccttccaagtagctaggactacagtcacatgccaccacaccccactaatttttaacaaaaatttttttgtagaggtgaagtcttaactaggttacccaggctggtcttgaactcctggcctcaagcaattctcccaccttggcctatcaaagcgctgggatcacaggcaccaaccgcgcccccggcctcagtttaatttaaatccagtgtaccacactca

SEQ ID NO: 537667 - DNA, 342 bp, Homo sapiens
agtcgttaactgattaggacttcaccaacgtcaccagctgctccattctcctgctacactgagtgacatataccagaaacccacttatttaattatttagaacatctgaacaagtagtcagttaattttaaaaataagtgcaagcatagaatcatgaaaaagttttagacacataaactgttttaactttttacaaataagtctacattcattcaccagggatcttttccttatttatagcacgaatctgttgacccagagctgtgtgtcatctttcttaaataaaccacatcaataatatacattctgtgatcttcatgtctcagtttcttccaagtggac

SEQ ID NO: 537668 - DNA, 119 bp, Homo sapiens
tagcccatgcggtgacgatctcacctgcgtaatcagagaatccttcaccttatgctgaaaagtgagctcagatccagcaccatgtacctcctgaccacatcctgtcgggctagtcgtga

SEQ ID NO: 537669 - DNA, 358 bp, Homo sapiens
tcttgagggtaaaactgcttcagggagagagggaagcatcgccatcgcagctcactgagaccaaagcctcccgggttcaagcaattcttgtgcctcagcctgctgagtagctgggaatacaggtgcatgccaccatgcccggctaatctttgtatttttaatagaaacgggatttcaccatgttggccagactggtcttgaactcctgacctcaggtgatccacctgcctcggcctctcaaagtgctgggattacaggcgtgagccaccgcgcctggctaatgtttttaataattatgaaaatgctttcacgcccagtagcccttgttgcctcaccttctgtgagggaaacagagcat

SEQ ID NO: 537670 - DNA, 486 bp, Homo sapiens
  misc_feature (137)..(137): n is a, c, g, or t
  misc_feature (180)..(180): n is a, c, g, or t
  misc_feature (188)..(188): n is a, c, g, or t
  misc_feature (410)..(410): n is a, c, g, or t
  misc_feature (427)..(427): n is a, c, g, or t
  misc_feature (435)..(435): n is a, c, g, or t
agaaggaatctcagaagcattaagaaaatgtggactacagttacctacttctttttccattgagggtatagatgagtaaaaatgataattgtcaacgttctgtcagtttggcttcgtggacttggaaccagtggtangtctcaaccagacttgtcagttttcaactattacagacactgntaactcanggaatgcgactaatagctccgtcccaaatcttgctcaattgtcctgtttgcatacctgtccaatatcaacagggtgctaccttgagcaagcagaagtttcaggttgactgacgcctgtattagctagcaactgaagcactgggctctctgattgtgaccgggaatatcagcgaacaatgtgactcgaaactgtagccccgaagaaacctccattgtcatcantacaaacgggaatgtcntgcgccanaaagctgcatgcagtcatcaaagtacaaagcatctgatttgggaatgtggg

SEQ ID NO: 537671 - DNA, 408 bp, Homo sapiens
tgacatgatcctctgagcccaaacctgatgctcataatagtctcatcttcatttagcatgttactgaaccgatatacatatcttcccttattatatctggtctcttggactggtagacgttctaagtgctgaggatgtaagagactgtgcaagtatatcaagcccttctaatcatcatcgcaggctcttatcagcgccagtgcatatatccaacacacagcaattcctactgggtcctatgtcatttgctgagcgtaaggatccccattccatttattgcgtatctactcacagaagtctccagttaatcagttatatactgtgtaaagtatattactcggccgtagataacgacacgcagatttcgtgagtgtggtgctgttccacaccgttatttgtacatgacac

SEQ ID NO: 537672 - DNA, 172 bp, Homo sapiens
gtcttatggcaaggcccaagcctcatttggcaccagcaaaccctgcatgcacatccacccaagcaggcagtcatggcagcaattctcaccacagcagacctccactcaatgcactgggcaagcaccacttgtgcctttgcccatcatgccacagggtacctgcagactcgca

SEQ ID NO: 537673 - DNA, 352 bp, Homo sapiens
  misc_feature (111)..(111): n is a, c, g, or t
cttctatccatccttaaggccagcattgtgagcattttaaatattatttgtatatttttaaagttactagtaatatggcatcatttagtgattcttttgggaatttttttntgagttgcatgtttttatccatttggagtttaaattacatatgtgtggttttttttttaaatggagcttttcttactatatgttccattcaaaataaaaaattaaaatcttgccataagaataaatttgattttggccaggcacggtggctcacgcctgttctcccagcactttgggaggccgtggcagacggaaagattgagaccattctggctaacacgatgaaaccccgtccctacta

SEQ ID NO: 537674 - DNA, 169 bp, Homo sapiens
  misc_feature (74)..(74): n is a, c, g, or t
gacgatgacagacaccttccctaaactatattttgacttgtgtgatttagttggagaccattgggatgacccanaacccgatattggagatggttgccgctctccggggggaagaaaaaggacaagactgtatgacttctatgtttgccccggtcatactgtaccaata

SEQ ID NO: 537675 - DNA, 746 bp, Homo sapiens
  misc_feature (678)..(678): n is a, c, g, or t
agcgaaaggtcatcatttttgtgaataatgtaaaacatgttcaataagggatacttaaaaatgaagcaatttatttgtatctggggacaattgtgaagatgggagaaaattgaaaattttggtaggaacagaccatgagtggctgtaagctttaactttttttttttttttttttttggagattggagttcagccttcgctcgtgttcgcccaggcggagttgcaggggcatgactctcagctcacgtgcaacctcgtgccttccggggtccagaggtgatttcttctccctcaacctcctgagttagctgagattacgggcacccaccaccagcgcccagctgattctttataatttttaggtaaagacgggggttccaccatgtttgggccaggctgggctctcgaacctccgtgaccctcagggtgactccggtcataccgttgtcctcccaaagttgctgggagttgcaagcttgagccacgtgcccccggccaaggctttgacacttttaagggctctggggaaccatagaggtctgagattatttctcctacttgagaataaacaaggtttttggcattatcatcagagcagtttaacaggggtatgatactttcaaggccaagtattatccggtctagatttaaagcaatagtgtcttccttaaagccttncctcaaatgctgcccaccttagacctttcctgacaatctatataaccctccaccctttattccctatt

SEQ ID NO: 537676 - DNA, 772 bp, Homo sapiens
gtccacgcgttccgggggacctctatgtactaagctttataggctgcgaggtttgcagacagtctatcctgggtaggaacatctctgacatcaaagaggaggttgaacctagaagactgtacttgattgccttggattaatacattgtggagatgaaagggtcataaacgcttcgcgcatagagccagcctggcgccccagcgggatcccagagaaggatctgcatagtgttataaggacaccctacttcctgctagcaacgggacacgccttgcggggaccatgtgcagaaacaggaggcctgagtaacccagcatgctggcaagcatgcgcggtcctggtcgaggtggcagggagcgcccaggtggcaggagcatggaggctacatggtccaggcccatgcatgcagggcctggcaggctctatatagagaacagagggagctggttgtggtgctgagggagctctgactgaggataccgcacagccccagaagcagtaggtgcaggtgcaacgggtcaaagagaccctggtggttgccaggcatgaccgtgggcctgcgagtcggggggctagcgcctcttgaggaagcggcttgagaataggtggccctatgttccatacagccacgtgatgagaccttttgcattggaaggatgtagggcccaaggaggcaagtcctcactgcacattggtgccttttggcgggacccattgggggggttggagattacaaccccttttagattccctcggtttcttctacctggat

SEQ ID NO: 537677 - DNA, 120 bp, Homo sapiens
gtaggcgatggtatactgtacaacctgttcctgctccggactccactatagcagatgcgagcaggagtatgagagagggaggtaagagtcagaagcttatgttgtttatgcggggaaacg

SEQ ID NO: 537678 - DNA, 560 bp, Homo sapiens
actatctacgctggatatctaccttatcatctgtttacaactagtagcggtatgaaaaggttataatttaatttaccacaaaaatatctattgggttattacaagtttaatacattagtgttaaaaatgtccagaaagcactttccaggtgcttcgcagttgaatatatttaagaatcatttcccgagactgtgggctttctgaaaccagagaccatgctcagatgagctttgaaccagagtgagtgtggaaattcctccaagtgctctcttcttcttgagactggacaatgtccagccttgcctttttggactggggctagggctgggaggacaaggtccccatcatgtttcagaagcagaggtaactgatcacattcagtcactgtgacttttctggttacggaagttatgataggccctgagtgaagacgattgccagccctagccaggtcataggtgtgtataaagaggacactcacctccaagatcaaccctgcccaactctgaggtagtgcagatactctgtctcatattccaccactgtattgaggattgtag

SEQ ID NO: 537679 - DNA, 320 bp, Homo sapiens
gaacgaaggtaggacaatgaggaggaccagtagctgaagaagagaagctttcagctcggtgtggtgggctcaggcctgtaaatcccagcactttgggagtctgaggaggatggatcacctgaggtcaggagttcgagaccagcttggccaacatggcaaaaccccgtctctactaaaaatacaaaaattagccaggtgtggtggtgcacactgtagtcccagctactcaggaggctgaggcaggagaatcgctcgaacctggtaggcagaggttgcagtgagccgagatcgcactcctgcactccagccgggggtcgacg

SEQ ID NO: 537680 - DNA, 1254 bp, Homo sapiens
  misc_feature (274)..(274): n is a, c, g, or t
tggggctctctgaccagcaccaggggcggtgggcaaaaacaacccccttacaaaaggcggcaaaaaggggacccaaaaaaaaagtgtgggtgtgactccattttctctataaaaaaaattgtggtatgtgatgtgtgtgaaagcccctgtgcatatgtgttctcaatatatataaaaaatatttgtggaaaagacccctcgtctcaccagggagaccccacagggaactccacaaatgtgtgcatctctgtgagtgtggtctctctcacagggngtctcgcggtgtgtgtgtgagaaggtgtgaggtctctgtgtgccgtagatctgtgtgcgaaaatgtgagtagtagaagtgtgtgcattttagaaataatatctcgagagccgtggtatttcctgtgagaagaagtggtctcgagggggataaacacacgtgcctgctgaacctcacacttctctcgagtggcgcgagtggagtctctttcaccgcgtgtgacacaaaacaatgtgtgtgtgtctccagtgtgtgtctcacaaaaaaactatgtgtgacagacacacacatgtagatcgtagagagagcgctctcacagcgtgtgagagagtgtctcacagagacactatccccgcagactgtgtgtctctacccctgtgcgctctctgcgctctgctgtgtgtctccctgtgatgagatgcggggagtcatatttcaccattatactacaccacagcgctcaacacacaacatcttcgagaatctcagcgggacagagaaaaccctctctctttatatgtctctccagggcaaccccaacccggggggtctcccccgacacaaaaaatctccccgaggaaacacacaagatagtagactgtggagacactctcagagttgaacccccgcagaaaaaggcggcgtgtcacaacaccacaaacttgtgaccccccttgtgaaacaaacgaccgcggcgcggcggctcccaaacataaaacatctggtgggaatctcccccgagaataacccaagcccttattgtggggccacatcacaacagcacctcttcctgccacacaccaggggggtcttgtgcccccaacagcttctcatattttttatatctcccccgtactttccccccaagggacgaagtgagatccctacccgggcctgtacgccaccaagcgccgttacacaccccctcgtgcgcctcgtcaaacataaacacgcccccaacaggccgtcctcgaaaccact

SEQ ID NO: 537681 - DNA, 1144 bp, Homo sapiens
aatcctcttcttcttttttgtggtgaggaggagagcggtagctagtgactggcggggcgagcagtgggacgaagagaggcgcgagtcaggagcacaccctactgtgttgtgaccagcctgcgtgagggcgaccaaggatcgtttggttggtccacgacgtcctagtaggtacaccggtctgttgtggcgtgcactcgatccgacagaagtgtaggtcacgagcgggacagtgttttctgcgaccaaaagttgttgtccgagggtcttcccgcctccgatatgtaccgggtggcgcgttctatatgtgtcgtgtgggagacctgtgcccgcaacccacgggttttgatgtccgcggtgtgccgcgggtcctctcgtatgcgcctggatttgggccgccacattctggtgggggtccgtcggcgtgtttgcccccgcgatgcgtgcgttgttagtcgctccctgatgggggtccgccgctcacgccgcagcaatctagtggtgcgtatctgtgcgggcgggtcgctgttctatatacttggagccagtggtctgcgtaagtcacaatgagcccccgtggttgtttgtccccccccagggtgattctgtgagaggaacacaatcgggggcctctcgtattgatatctatgcgcggcgttgacaacaggggagaactcctcctgccaaagagccgggcggccccacgcccacgagagtacacacacagacttctgtagaaacaatgcctctgtcttgctttctatacatgtctctcccacgccccccgcccccacaccgccctcgtttctggcacactactacgcggcggtgcgtgctggcagaaagtcctctcggagccacatcacctgatggctccatagtgtcgaaaagagagagggttcaccgcaacatgtctttgggcgtggagagtttgcaacaactgtcaatacacccctggtggagacatcactcaccgcccacagatcccaccggttcgccttttttctccatttttcattataaattagtattccctccctatcttttaataagggctatcttttctactaacactcccctatatatcctcccagcatccccacgtgcaaaataaaaggttcccctaaatacccacaaatacacaaaa

SEQ ID NO: 537682 - DNA, 156 bp, Homo sapiens
gcgtggtctaggaataggggggaagtatgtggagtgaagatagccgcgtagtggtgtactcgtaggtcagtaccatgggtggccaattgattgatggtaagggagggatcgtgacctcgtctgttatgtaaaggatgcgtagggatgggagccact

SEQ ID NO: 537683 - DNA, 417 bp, Homo sapiens
ctacttcattgtttcttcttctgtctgaacatttatttatttttctttccaacttttaggttcaaggggtaaatgtgcaggtttgttacatgggcaaattgtgtgttgtgggggtttggtttatagataattttgtcacctaggttatcagcgtagtacccaacctgtaggtttacattcctcacactttcccaccgtccaccctcaagtaggccccagtatctattgttcccttttttgtgtccatgcgtacacgatgtttaccactcacttataagtgagaacatgtggtatttggttttctgtccctgcatcaatttacttaggataatggctccaactccatccatgttattgcaaaagacataatctcatttttatggctatgtagtattgcatggtgtattatgtaccatg

SEQ ID NO: 537684 - DNA, 236 bp, Homo sapiens
tggtgtggtgatctagaggatcccggttaggtgataatagaagcttgctaaaggggctgtcatttggtgggcagctgaggtgagcccgagcttggtttatcccaagctgagggcaggtagtctgggaggactgaactcagccaaggcagccagagttgcggcatcagggccaggactgagctcttgtgcagcgggtactcgagctctgaattgcgatgagtcatgagtcatagtca

SEQ ID NO: 537685 - DNA, 113 bp, Homo sapiens
tcgctggtaggtctggatctgctggccaatgtgctcccggtaggagccgctcaggagtcttctgtgtcactgccaccagctggatcagttcagacttctccagggagcactaa

SEQ ID NO: 537686 - DNA, 109 bp, Homo sapiens
cctcacaagaccctgatcaatagatggagacatacagaaatagtcagaccacatctacaaaatgccagtatcaggcggggcagaagcaggaagcggcagaagcaggaag

SEQ ID NO: 537687 - DNA, 1109 bp, Homo sapiens
gagcaagaagtggggacctcagaaggaaagccaatcagcagcctggatgccttccccactcaggaaggtacgctgtctccagatgaacctggacagacgacccagatcgccgctggtccgtctatgcgatgtacaaatcaatgaatagtacactgaagtccatcagtgaatgaagaaagatggtaacaaagagttcaagatggcagcaaaaaacgaagtcttcagttggttggcattaatggagggtatgaatacactcttcacagtgatgagttccagtctcacagtgaaagctcttcttccgagtcagatgacgagtgtgatgtcattgagtatcctcttgaagaagaggagagaggaggaggatgaagacactcgtggaatggcagaagggcgccatgcagttaatactgaaggtttgaagtctgccaggggtggaagatgaaatgcaggttcaagaatgtgaacgctgagacggtggcaatcagagagaggtatgagttaagtgacagagatgtagatctgcatgcaacttactgaactaatactataagtgaccccaaagcttagagcagcaaagatcatgaggtactggtctgaaacatcctccagcacgagtggtatccgcgtgtccagtcagaagtcagcatccagccatggtggaggaactacataagctggcttatgaaggccaatatcccaaatgtcctacggctagtcatcagcttcgcagaaggagaggaaaaaaggcttccatacagcgggtccatcgaactcgagatggtcagctggcggtacacggccagagttaaacgggataccagacacagaagacaaaccccagcacaatgagggaccaccaggtgcgttccacccaccaggacagagcagcggcacacaccccgcccagtgaccagttaccaacacaagttacagcacagcggaacaacaatagcgaaaagcagtaaccgataagtctgaccagcgtgaatacaaagcagaacgaacagatgtgcgcacgcgaagctgagatcgccgagacagacaaaggcaaccacacagcgctacatgcccgtgcttgctgcatgctgtgccgcgcagtacgcacg

SEQ ID NO: 537688 - DNA, 225 bp, Homo sapiens
  misc_feature (3)..(3): n is a, c, g, or t
acngttacagtcgtcatttccaaatcacgtagtaatctttatagttccgtaaggacaaaaattcaagatactgttttatatttaaaaaaataatttgcacccgatagtcccagctactcaggaggctgaggcgggaggatcacttgagcccacgagtttgagacaagcctgggcaacatggcaaaactccgcctctacaaaaaatacaaaaattagccggatgtg

SEQ ID NO: 537689 - DNA, 372 bp, Homo sapiens
  misc_feature (31)..(31): n is a, c, g, or t
  misc_feature (273)..(273): n is a, c, g, or t
gacgtttaattgactcacagttcctcatgtntagaaaggcctcaggaaacttacaattatggctgaaggcatctcttgacagagcagcaggagagagaatgagtgtcagcaggggaaatgccagacactcataaaatcatcagatctcatgagaattcactcactatcatgaggatagcatgagagaaaccacccccacgattaaattaccttccacctggtccctcccatgatatgcggagattatggaattataattcaagatgagatctngggtggggacacaaaaccaaaccatatcattttgcccctggcccctcccaaatctcatgtccttacatttcaaaacacaatcatgcccttccaacagtg

SEQ ID NO: 537690 - DNA, 165 bp, Homo sapiens
ataaaatctgctgttcatcacctccttttatgctgctgggcgcgtccacagcaagactccaagagtcagctgcaaagtccttctcatccatctcaaagtcactcactcagctcactgtacgattacctctcgcttcgtcaatggcgggattccacacgtgagctg

SEQ ID NO: 537691 - DNA, 471 bp, Homo sapiens
  misc_feature (26)..(26): n is a, c, g, or t
  misc_feature (311)..(311): n is a, c, g, or t
  misc_feature (403)..(403): n is a, c, g, or t
tttgccaagaagcacaacaagaaagncctgaagaagatgcaggccaacaatgcaaaggcagtgagtgcgcgcgcagaggccattcaaggccctggtgaacctcaggccatcaagcccaagatgccaaaaggccccaaactcaagcggctggctttcatcgctcaccccaagcttgggaagcggattcgaagctacatggccaagggtcagagctctgccaaccgaagcctaaggtccaaaccaaggcaggggccaaagctccagctaaggcccaggcttcagctccagctcaggctcccaaaggtgctcangcccccaaaggtgcccaggcccctgtgaaggccccatagaaaaggctcctgccagtgtgaagacagacggactgctgtgacacacctccccncacactatttgcagatgaccagtgtcctatgctgttcttacaaataaactcaggcaagatctgttaaa

SEQ ID NO: 537692 - DNA, 563 bp, Homo sapiens
gacgttcccatggtagaaaagaagagcaagaaacccaaaaaaaaaaaaaaaaaaaaaaaaaaaaaaaaaaaaaaaaaaaaaaaaaaaaaaaaaaaaaaaggggggggggggttttttttttttccggggggggcctttttgggccccccttttttttggaggggggccccttgggggggttttttattagaaagcagcagacgggggccgggcagtgtttaaacagcgtcgtgggggggggaaaaaagctggtgcatcgtgggagacatcttgtgggagggagagaccctaatcattggtgggggggggggagacatattgtggggaaacaacttaaccttatagaagtagtattatagactgccctggaggggatataataattatacttttctacggggtgttatgggggggtgtaacacaaacaagcgggaatgatgttgcgtgggcatgagtgaaaaaagatgggtgtgcggactaggatgataattatgtctatttcagtgaaatattattatttatacacgggggagtttatttgagttaaaaatgaaggggaataa

SEQ ID NO: 537693 - DNA, 605 bp, Homo sapiens
cggacgcgtgggtcgacccacgcgtccggttctagatcgcgagctgccgacctttattttattatttttggtttatgggttttttttaggagccattttgtccccaaggttgaattagctactaaaaatcccaattaatgaactcctcacagggaaagagcaatctatcacccgtatagcaagaactaatgtggagctatacagataacgcatgaacaaccatgtcttcctccgctataagcctgcgtcaaattaaaacactgaacatgacaattaacaggccaatatctaaaatcaaaacaaacaaagtcattatataccctcactagttaagaccaaaaagaaagcatgctcaatacaacggacacaacgggttaaaacaacacagttaagcaacggacacttcgggcaaaaattcttttaacccccgacctgtttacccaacataatcaatcaacattcttagcattcacccaagtatataaaggaaccgtcattgaccaaggtgacacaaattgtataaaacaggacggtggaaaccctaaacccggtgcacaggtaacccataatcacttgatacattaaataagggacctgattaatgg

SEQ ID NO: 537694 - DNA, 159 bp, Homo sapiens
tggtccctcgcgacgtgttatccctccttccaggaggcgcttcgcagtgaggtgcgggctcacggcctcgagtctctccgggagcacgggctgcggtgcgctggcagcttacggggcggccagtccttgccccacaagcgctgtggacgccctgtgaaa

SEQ ID NO: 537695 - DNA, 165 bp, Homo sapiens
ttttttgaagagacggggtttagggccaaattttgcccaggcgtgctcctttaagacttgggactcaggagatccgcccaccatggcctcccaaagtgctaggattacaggcgtgaaccaccatgcttggcccatctattatgtttttattgctctgtaacaaat

SEQ ID NO: 537696 - DNA, 447 bp, Homo sapiens
aggctggagtgcagtggcatgatcttggctcactgcaagctccacctcccaggttcacaccattctcctgcctaagcctcctaagtagctgggactacaggcatccaccaccacgcccagctaatttttttttgtatttttagtaaaaatggggtttcaccatggtagccaagatggtcttgatcccctgaccttgtgatccacccacctcggcctcccaaagtgctgggattacaggcgtgagccacagcgcctggccaactttttttgttttgttttgtttttaagttccaggatacatgtgcagaacatgcagtttgttacataggtatacatgtgccatggtggtttgctgcacctattgaccagtcccctaagttccctctcctcacctccccaccctctaaaaggccctggtgtgtgttgttccccttctgtcgtcttctc

SEQ ID NO: 537697 - DNA, 236 bp, Homo sapiens
cggccggggagatatagggtcgaatccgcactcgtaaggaggtggatttttctatttagccgtagagttgcgatacgtcaaaaggtaatagttattagtagtaaggctaggcgtccgtgcggtggccgctacggatgctgaccgctcgagggtcgcgattctagttagcatgccagagtcccgtcccgttactcggaattaatccagacaatatcgctccacgcaagtaagaacgg

SEQ ID NO: 537698 - DNA, 771 bp, Homo sapiens
tcttaggagggccccgtggggctagggaagtttggttgcaggggcgccaatgtctcgcgtggagtgacgcacgcatgttctgtttattctggaggccgaaaggtgtgggggttccagaagcaagaaagtgtctgtctctcccctccgtgccacccttttttcgaaggcaccaccaagtatagacagtgggcactacatcgaatctgtttttggacacttgtagagaaccagtacacttttagattcgcagtatcttctgtgtaatattttgatttgtttttcctgttagctttgaaaagttgtataatacttaactgactgtagccaagttttatatgtggtagcataccggtgaatttatcctatgaccaaactgttctgaattttcttttggtgtttaaagaagaccaaacttgttgcttagaagccctgaattattcttattttgacttcaactgtcgaaacttccttgttttaaaaaatgatcatttgggttcaactcacggagaatgcatgtcacggaaacttgtattataagtttacttagttgtgatgtactcagtcaactgctgttacccctttttcacaagaaattgtaattgacttttgaagttttctagattgtcacactgctttgtgacctaactgccaagaaagcacactcctgtgttgtatttgttctagtcatttttattcaggctatatattgtagcttaatttttatttgcaattaatttatttaaactaagtaatacttttccaaaatacata

SEQ ID NO: 537699 - DNA, 236 bp, Homo sapiens
agcactctgagcgcctgtttgccaacgcagtgactggcagagaccgagacaagacgattccagccccagcctttttcactatctaccccaattagctccccatgaatcaatgtacaaatcagcacccacatcccctattcttgacaaatgatttttctagagaactatgttcttccctgacttatagaggaaggtgaatgtgttcccgtcctcccgcagatcagaaaggagactct

SEQ ID NO: 537700 - DNA, 899 bp, Homo sapiens
  misc_feature (121)..(121): n is a, c, g, or t
  misc_feature (147)..(147): n is a, c, g, or t
  misc_feature (164)..(164): n is a, c, g, or t
  misc_feature (173)..(173): n is a, c, g, or t
  misc_feature (175)..(175): n is a, c, g, or t
  misc_feature (204)..(204): n is a, c, g, or t
  misc_feature (210)..(210): n is a, c, g, or t
  misc_feature (273)..(273): n is a, c, g, or t
  misc_feature (299)..(299): n is a, c, g, or t
  misc_feature (317)..(317): n is a, c, g, or t
  misc_feature (335)..(336): n is a, c, g, or t
  misc_feature (368)..(368): n is a, c, g, or t
  misc_feature (373)..(373): n is a, c, g, or t
  misc_feature (382)..(382): n is a, c, g, or t
  misc_feature (394)..(394): n is a, c, g, or t
  misc_feature (398)..(398): n is a, c, g, or t
  misc_feature (413)..(414): n is a, c, g, or t
  misc_feature (421)..(421): n is a, c, g, or t
  misc_feature (453)..(454): n is a, c, g, or t
  misc_feature (488)..(488): n is a, c, g, or t
ggggaggtccctgaggccgctgaggtcgtccggtgtctgttgaacggtctgtgggcgtcttgctgccttgggtagggggttaaaatcgttcttgagaggaacgtctctgtgcgaagagatnatgagttagctctgagaagtgagctngtagtggacaaaacaangaggaaaananagaagagaactgtctgaggaacagaaacnaagaanttacagatgcttttgaactatttgatacagacaaagatgaagcaatagattatcatgaattanaggtggcaatgagagccttggggttngatgtaaaaaaagctgantgtactgaagattcttanngattatgacagagaagccacagggaaaatcancttgngaagatttnaatgacgtggtngacnggactggatatgggnnagagatnccccatgaagaaatatctcaaggcatttaacnntatttgatgatgatgattcaggtaaaataagctngaggaatttgccgagtgttggtagagaatttgggtgaaaacatgagtgatgaagaacttcgaggtatgatagaagaatttgacaaagatgggtgctggggaattactcccagaggaggttcaattggctaatgaattgatttgcttgacattttagctgaattccggggttaacagctaggaaatgttggagttaccagtgttagaattcaaatttagggctggggcattgtgaaaaaaaccaactaaggttttattctttagggcaaaaaaggttttatatttggttacacatggaggggctggtggaagggggatgcacaaatgtgaggggataaaaaagttttaagagaaaagggtattgtgggggggaaaaaaaaaatgggagacaccggaaattttttgagaaaag

SEQ ID NO: 537701 - DNA, 245 bp, Homo sapiens
  misc_feature (18)..(18): n is a, c, g, or t
  misc_feature (21)..(21): n is a, c, g, or t
  misc_feature (37)..(37): n is a, c, g, or t
  misc_feature (76)..(76): n is a, c, g, or t
  misc_feature (82)..(82): n is a, c, g, or t
  misc_feature (84)..(84): n is a, c, g, or t
  misc_feature (120)..(120): n is a, c, g, or t
  misc_feature (131)..(132): n is a, c, g, or t
  misc_feature (137)..(137): n is a, c, g, or t
  misc_feature (139)..(139): n is a, c, g, or t
  misc_feature (155)..(155): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (179)..(179): n is a, c, g, or t
  misc_feature (204)..(204): n is a, c, g, or t
  misc_feature (213)..(213): n is a, c, g, or t
  misc_feature (228)..(228): n is a, c, g, or t
  misc_feature (245)..(245): n is a, c, g, or t
cgtggagaaaatcaaacnganagggctgtgtgaaacntggttgtaatatgcgactgcgaacactgaactctacgcnactccngnaatgatgttttcaggtgtcatggactgttgccaccntgtattcatcnngagtncntaaagtttaaagtgcncgtgattgtataagcntncntccnttgagttttaaattatgtataaacntaagttgcntttagaaatcaagcntaaatcacttcaactgn

SEQ ID NO: 537702 - DNA, 973 bp, Homo sapiens
ggagtatactcaggcttctctcccatcccgaggctgtgtggagccaggtcgcccacagctcctccctgatggccgactcttagccaacagcaagcccgatccaggccggcctgtccctccctctactggggcccagtccacggccacccaccagtctcaagacatcacatcagcaacagaacagaacagcagcagcagcagcagcagcagcagcagcagcagacagcagcagcagcaggcagcagcagcagcagcatcacggaaactctgggccccctcctcctggagcatttccccaaccacttggagggcggtagctcccaccacgcacacccttacgccatgtctccctccctggggtcgctgaggccctaaccaccaggggcagaacagctgccaccacctcacagcaggtgtactacagcaccaagcgaggccccaatggtcctccagtctcttcctcttccaattcttcctcttccacttctcaagggtcctacccatgttcacacccctccccttccccagggccctcatggggcgccctacctttaccaccggtgactacggtcacactcttcggatacctttccagggtcatggcaccgtggcttcctcgccagcaggtacaaaacggctccccagctgagccccacgtacggaaagagagccccgtcccgggggctacaagaaagcacaccacgcgaaaaaaagccgggtcggtcctctccgaagggagcccagcgggtacgaagaactcgcacctgcagccagactcagcggcgccacggagctggcctgcaactggagcctagcccatgtgcacacctgggccgcggcggcctgagtacactcacgaggcggacacacaaaggaggagcaagacgactccagtaaaagacagcacacgacacagcacgaacccaacaccaccaaccacaaagacaaaagacgacaacgcgcaagcacacga

SEQ ID NO: 537703 - DNA, 127 bp, Homo sapiens
cccttttcccttaagagattagatcgtctgaaattattattaaacgaaacgttccgtatcatagcacagcgaggtgaataaaaacagctttcgagtgggttttccccctatttggagtctgctgtta

SEQ ID NO: 537704 - DNA, 418 bp, Homo sapiens
taagcccatggttgaagatgatgtagtccagatgaacatctgcatcttgtgtctactcgcttggggtttgatggccatcacgttgcctgtcaatgagtggccatggtgccccttggtggcttgcctgcggtgaagtcgctgtgcaccttgaatatggcccttactaggagcagcctgttcaggcaggttcttgcgaggcagatccctctgtctgtctgcagctcctcattccagtctcgggtctgtccaggaatgtgctcctcatagcccagcctcgatgtgtgtaggctgtcctctgcacgcatgcaatcaatggcatgctccgccttggggggttgtccagctgtacacctggaatggggtgccgatcctctcgaacggatggcgctggacccttttcttctgcagcacagtgaag

SEQ ID NO: 537705 - DNA, 168 bp, Homo sapiens
aagggacattcgtgctaggtgctgcagtacgtatgtggagtccaatggcgtcttcaccacccatgtcagaaggctaggaggctcatttgccaggtgggcagcccacaaagggtcctcatctactgccccctactgctagacgccccccatgttcgtccatagagtgtg

SEQ ID NO: 537706 - DNA, 826 bp, Homo sapiens
agcggggtgggctggctcgctctctcctggggagacagaggtcggcagtgcagcgcacagagggacctacgggcagctgtgccttgcccctgagtcaggaatccccggaggcccggaggcctgctagcaggagcggtcatgaagaagctgatgggggtgctgagtctgattgctgcagtcctgaggcgagatggagcatgacataacgttggtgcatgtgcaggacccatgaggacaaagactatctcagcacctaccagagctgacccgtctacagcctcgtgggccagattgcatcttgtggatggaggtccattagtgccatcgcacctgtagggtccgtcacaagctgactaccacgtgcataatacaacactgaagtcttacaggagtcattccatggtggcacgcataacacattcgggcacaatgggacgtagttccccacggagtcacagagatcgtgatagtgccaggaggcatggtgagtccgacacgcgtgaactgtatgatagccagagcagggcaatgtaaccaggaccatcaattgcggtgatagtgacgccctggtaacggacgtcaagcgaaagctactactgaaagtctatccacgaacccttttcgcactgggagggaggcgaaattggctccagaccgaacacgcactccggactgggcacattccatgggctgggggcaaaggaccaggcagcatggtgaaatttcccgtgtacatcaattccaagtgtggcatcgaattccaaactgggtgtgcccgtgaggaggtgtgacgcctgcatacgctgggccgaagaaccgacgacac

SEQ ID NO: 537707 - DNA, 241 bp, Homo sapiens
caacgctttatacttctcaacgcttgatcttcataccgggcaatgcgatgagaagtattaagcgttgaggaagtataaagcgttgagatgtataaagcgttgaggaagtataaagcgttaaggaagtataaagcgttaagaaagtataaagcgtgaagaaattataacgctttaagaattataaagcgttaagacgtatcacgcgttaagaagtataaagcgttaaggaagtctacagcgt

SEQ ID NO: 537708 - DNA, 395 bp, Homo sapiens
  misc_feature (260)..(260): n is a, c, g, or t
acttagggactggcagacggacggacggacggcgaggaccctacccgagcccccgagccatggccgagagaaagcaatccgggaaggcggcagaggacgaagaggtccctgctttttttaaaaacctgggctccggcagccccaagccccggcagaaattctgtggcatgttctgcccggtggaagggtcctcggagaacaagaccatcgacttcgactcgctgtcggtgggccggggctcggggcaggtggtggctcancagcgggacgtcgcccacttgggcccggacccgcagccgccgtactcgcggcagggccggcgcgccggcggagagccatctgttgaatcgggccggaaggtggagatccggagggcctcgggcaaagaagccctg

SEQ ID NO: 537709 - DNA, 234 bp, Homo sapiens
  misc_feature (32)..(32): n is a, c, g, or t
  misc_feature (158)..(158): n is a, c, g, or t
  misc_feature (202)..(202): n is a, c, g, or t
  misc_feature (211)..(211): n is a, c, g, or t
atgctgtgcctgtgtcaagtctggtgatgagnaccaggacttccagctggagggcagttaacatcactgaacctgaggcgagaacagaaagcaggacaagcgcttcgccttcatcccgcttcagaccagcggcccccacccacccaatttttgagtcntgcccgccctgccccccggtttggtttccctcttgcaacaagcngaatggaangcttgaacccagccccgttcaag

SEQ ID NO: 537710 - DNA, 220 bp, Homo sapiens
  misc_feature (216)..(216): n is a, c, g, or t
  misc_feature (218)..(218): n is a, c, g, or t
taagggcactataggcggtttgttgtctgttaccaagtcctggcatcatggcgtctcggatggcattatcgctattccatttcatacggaaattctcagggtacacatcatgcatcattaaaccgcatactaagggcctggctaagacgctacaggattcacaagcaatgataacacatattgggggggcctctgtggtttcttggtcccttcggngnct

SEQ ID NO: 537711 - DNA, 209 bp, Homo sapiens
agtctcgctcagtagcctgcaatctctgcccccggggattataatcgcttctcctgcctcagcctcccgagtagctgggactacaggcgcccaccaccacgccgggataagatttatgtatttttagtcaagacagggttacactagtgtcagcccaggctggtctacgatctcctgcaccattgtgatcccacctgcctatggcctcc

SEQ ID NO: 537712 - DNA, 946 bp, Homo sapiens
  misc_feature (103)..(103): n is a, c, g, or t
  misc_feature (127)..(128): n is a, c, g, or t
  misc_feature (145)..(145): n is a, c, g, or t
  misc_feature (177)..(177): n is a, c, g, or t
  misc_feature (191)..(192): n is a, c, g, or t
  misc_feature (201)..(201): n is a, c, g, or t
  misc_feature (211)..(211): n is a, c, g, or t
  misc_feature (243)..(243): n is a, c, g, or t
  misc_feature (262)..(262): n is a, c, g, or t
  misc_feature (264)..(264): n is a, c, g, or t
  misc_feature (555)..(555): n is a, c, g, or t
  misc_feature (557)..(557): n is a, c, g, or t
  misc_feature (564)..(564): n is a, c, g, or t
  misc_feature (567)..(567): n is a, c, g, or t
  misc_feature (593)..(596): n is a, c, g, or t
  misc_feature (600)..(600): n is a, c, g, or t
  misc_feature (610)..(610): n is a, c, g, or t
  misc_feature (618)..(618): n is a, c, g, or t
  misc_feature (624)..(624): n is a, c, g, or t
gagacaaggttttccaagcaagatgaagcccaacatcatctttgtactttccctgctcctcatcttggagaagcaagcagctgtgatgggacaaaaaggtggntcaaaaggccgattaccaagtganntttcccaatttccacanggacaaaagggccagcactatctggacaaaanggcaagcaacaaanngaatccaanggcagttatnctattcaatacacatatcatgtagatgccaangatcatgaccagtcccgananagtcagcaacccgatttggattggccttattagagacgacaaatatacaaagagatctctgaggtgagaagtcaaccaagtgcctccataataaacaagaacggcagagcaccatgcatcacatcacaaggtcattttcacagggtagttatacaccatacaaggaggcaacagctcatcgtgggacacaaacatccttctcaagatcccggcgaatagcccatctggaccgggcatatccagtcaatattcaaacaccagaagaacggctgtgggttcatggactaagtnangaccaanttnccgtctctggtgcacacaaaggtcgnnnnacanggcggatccnaaagcagntatgtnctccaagacttgtgcactaagctagttagcatacaccaacaaaacaactgttgcgccttacagacaatttctcgattcacaacattaccgggcgacttacccacaatattgttggtattaacagctgtagaagagggaaacattttccaaaggtgcaaggcttaaaagaatttaaaattgttgtcttgtggcaccaatgaaaaaaattcacaaagtgtagtccagaaacaattttattttacacaatgtggtgggtactagtatattacgagaatataaagtgaatcaagatgttcaagaaagaaacaaagagttcgaaagg

SEQ ID NO: 537713 - DNA, 709 bp, Homo sapiens
cgcggtggctcacgcctgtaatcccagctctcagggaggctaagaggcgggaggatagcttgagcccaggagttcgagacctgcctgggcaatatagcgagaccccgttctccagaaaaaggaaaacaaaacaaaaaaaaaaaaaaaaaaaaaaaaaaaaaccccacagcacacaaaaacaaacaaaaaaaaaaaaacacactgttgtgggggcgcgcccccgccccccaggaagaatctttacacccacaagctgggggggggcggcggggcccaaagagaagaaagagaaaagagggcgacacagcgggttcccacgaaagaaaaccagcggggtgacaaaaaaggagggggggagcacaccacaccaaaaataagaaagagccgcgcgggggagaacacaacagaaagaggaaggaagagacacaaacacaacaaaagaagagagaaacacagagaggagacacaacaaagaaaggaggagatctaaacacacagaggagggagagaacacagagcgagaagcagcagaacatatacaaaagaatagcacccccccggcggtcgggggggggggcgcaaacgaatagagacgaagaaggaataagataagcaacaaatgagaaagaaacgagcacacaacagaaaagaaaaagacacaaaaacagagacagaacacaaacagtcgaacacagagagaagatcacaa

SEQ ID NO: 537714 - DNA, 297 bp, Homo sapiens
tagatagcctggaaccatgccagatgatcttctgaccacattggatgacacttgtgatctctttgcccccctagtccaggagactacttagcagcccccgcagacggtgaacgccgattggtcatctcccagaaacgttaacaaaacccgaccaggttgcccccttcaacttcttacaacctcttcccctttccccaggggtcctgtgctccactccagatcattcctttaatatagagctgggcagtgaagtggatatcactgaaggatataggaagccagactacactgctaacg

SEQ ID NO: 537715 - DNA, 165 bp, Homo sapiens
gttttctacacgtcattgaataacaatggaaaatgagaagatacagccaggtgtggtggctcatgcctgttatcccagcactttgagaggccaaggaaggagggtcgcttgaccccaggagtttgagaccagcctgggaaacttatagtgaggctgtatgtcaaa

SEQ ID NO: 537716 - DNA, 1016 bp, Homo sapiens
ggagcaagacctctgagcccgccaagcgggcggcggacggacctcgtgtggcgatggcactgagggactacgcgctagcagaaggaaaaggttaagaagttcttacaagagttctaccagggatgatagaactcgggaagaagcagttcaagtatgggaaccagttggttcggctggctcatcgttgaacaggtggctctgtatgtggacctggacggacgtagccgaggatgaccccgagattggtggacatctaagatttctgtgagaatgcctaggtggctacgcgaagcttgttctgcttgatgccgtacaagagctgctgcctcagctacgaaggagcagggcacatgtggtcatgataacggatgtcctggggccgttgttccttggagcatcggcatagtgatgggagcacgcggcagtcgggcaccctgggatggtccgaagcccccagtaaccatgttaccccttgcgtgaatctcatcgcggcagatttgagctgtgatttgcaagggcctatgggagcaagaatgcctcgttgtgatccggggaatgtgcgtggcatgacttcttgtgtgggcacaggttggtgagcttgtgcgttggctatcggtcactctgtgtctctgaagttcataatcccaaagatggtgttggccacttacatttgtgaacagtgtgggggcagagacctaccagccgatccagtctcccactttcatgcctctgatcatgtgcccaagccaggagtgccaaaccaaccgctcaggaaggcgggtggtatctggcagacacggggctccggagttcatcaaattccggaaatggagattgcagagaattgtgcagggggcgcgggggaaaaatacctcgggattcacggggtgtgaaagggagaacaggttgcccctgggacagtggtaggatttggcaccggccggtcccgggcagggtcaagccggggccgttgaccccgaggaatgggaagcggggggagtcagggccaggggacg

SEQ ID NO: 537717 - DNA, 92 bp, Homo sapiens
gaagtcctggaggacctgggacccaggccagctcccatcgctgggggacggtgaacggacatgtgttaatgttacgatgtttttataagaca

SEQ ID NO: 537718 - DNA, 532 bp, Homo sapiens
gtatacccattcttctgctcagcctcctgagtagctgggactacaggtgcctgctaccacgtctggctaatttgtgtgtgtgtgtgtgtgtgtggttttttttttttaagtagagatggggttcaccgtgttagccaggatggtctcgatctcctgacctcgtgatccaccctcttgggtctcccaaagtgcggggatcacaggcgtgagccaccgtgcccggccaggtgggattttataagtagtggggccactaaaatttctgagtggtacagtttcatgtctttagtgggcagaccaaagctgatccactcataaaattttatttagggctctcctttgacgtgagacaggtggtatatttatgggccccgtaataggggctacattattggacctcatatttcagtttgtgtcgcaaggtttggggcataagagctaatgtataggaagccctgtgctaacatatgctgagtatgagtaagtagtgggttaccaacggtttttcatgaaatatctgcattacaccaca

SEQ ID NO: 537719 - DNA, 408 bp, Homo sapiens
agattgcatattatactgctgccacgcaatgagttggtgtttacagtgttcccaaggagtggcttatcttcagagcatgcaaccaaatgcgctaattcacagggatctgaagagcaccaaagtcagtaataataatgttactaactgtcagcctcttactctttctctctcactctcaacactcagaacccagtctctaattctcagttaatcgtaatgctgaggctggaccaatcgattggatcgaggaggtggggtggactgagagcgagcatcgatcgactgacatgtccatccatggtggcgacgtgatgagagtccgtctcaaaaaacaaaaagaaaaaagaaagtaaaaaattaaaagcaggactgatggagcatatgtatatgtagaaaaatacccagtca

SEQ ID NO: 537720 - DNA, 271 bp, Homo sapiens
ccccccccccaaaagggttttttcccctggggggaagccccttggggggttttttttttccgggggtttttttcccccccccccccccgtttaaacccggggtcccggggattttttgggggggtttttttttctttaaaaagggcccgttccccgggggggggtttttattttttggggttcccggggccccaaaaaaggggcccccggccccctttgcccccccttgggtttttttttttggccccttaagccccctttttttggggga

SEQ ID NO: 537721 - DNA, 697 bp, Homo sapiens
cacctccaaatatctcatcaacaaccgactaatcaccacccaacaagtgactaagtcaaactaacctcaaaaacaaaataataaccatacacaacactaaaggacgaacctgatctcttgatcactagtatccttaatcatttttgattggccacgaactaacctcctcgagactcctgcctcactcatttacgaccaaccacagcaactatctataaacctagccatggccatccccttatgagcgggcgcagggattataggcttgcgctctaagattcaaagaatgccctagccgcagcttcgttagccacaaggcacacctgacaccccttatcgcccatactagttattatcgaagaccatcaggcctacgtcattcaaccgaatagccctggccgtagcgcctaaccgctaacattacgtgcaggccacctactcatgcacctaattggaagcgccaccctagcaatatcaaccattaagccttgcctctacacgttatcatctgtcacgagttctaattctactgactatcctagaaatcgctgtcgccttagtccaagcctaggttttcacacgttgctagtaagcctctacctagcgacgagaacagcatgaagaatcgaatacaaaaaaaacttaaaagccatggtgtgtggctgggcatgagccctgggaaaagttcataaagacc

SEQ ID NO: 537722 - DNA, 403 bp, Homo sapiens
tctcttatctcaccaaaaaggagataaatttgtttacagataaacgtaacaaccagtcaaagaagcaggggataagtaagctcctccaaagttgcttgcagtgctggaaatagatctcatttttaggttttctcttcgttccagataccaaataaatgagacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagatggtagtagctatgtttctcataccagaattctcttaaaaaaaaaaa

SEQ ID NO: 537723 - DNA, 476 bp, Homo sapiens
  misc_feature (31)..(31): n is a, c, g, or t
  misc_feature (41)..(42): n is a, c, g, or t
  misc_feature (75)..(75): n is a, c, g, or t
  misc_feature (91)..(92): n is a, c, g, or t
  misc_feature (107)..(108): n is a, c, g, or t
  misc_feature (121)..(121): n is a, c, g, or t
  misc_feature (123)..(124): n is a, c, g, or t
gtctcctgaaatgggaagcccagcaataccnacgcatgtcnncctccactttctcaaagcacactggaaaggccnattaggaattgccccnnagcagagcagatctnngctttttttccangnnagcaaaaattgaagcactaggtactaacactactgcttgttacccttggcccccaaaagggaaaaacctctttacaatctgacctggggcttttgggttttgggctttgggcaagctggcctttttttcctttttacacattttctattacatggggggcccttccttttccctttggcggcgaaaaatagacacttttcccccgtttccgaccacccccgtgttttgtgtggtccgcccaaaaaactggaaagccggggaaagaaaggcgccccgtttttgtgggtttttggggagggaggggcgggcgcccttttggggcgtttgggacaaacaagcgcttttgtgcccg

SEQ ID NO: 537724 - DNA, 823 bp, Homo sapiens
ggtgtgcgtggggtgtgggcttcgctcagctgcacaacctggacgaggcggtgggcagcggcggcgaggaggacggggagcccgggggaggcggctgcgtgcggcggcggcgacggcagcgagcccggcgagagcagctcgatgcacatctgccactgctgcaacacctcctcgtgctactggggctgccgctccgcctgcctgcgctccctcctgggtgcatggaagcctgctgccgcagcgcctggcgccagacgggggggaccagcctgctgcagcctcccgcgagccccgtgcgccggacgcaacccccgaggccctcgtggcggctgtgtggagcctgccgccgccgcaaggtggagcggccgtggctcgactgcctgtggatcgtgctggcgctgtggtgttcttccgggggacgtgggccaccgacctgtgtgcatggacctcgacatacataccgcaaggggggactacgtatacttcgagcctgaccctcattcttcggtgctggttgccgtccgctgctggttgcagagcctgagcttccgctggcttcgtggcaaggactacacggagcggccgggcttgggcgccgttgcagcgggctcaccatgccggggcccccaatgattgggggccggtaacgtcacgggcagcggcccgggtggccacgcagtagggtctcccccaacgccggggcagcagcgctgtgtcgcctctcccggtggatctagagagtcgggtatccacctgatgagatgcggaaggtcgtggagcttaaggaaagacatgagggctcagctaaatgaagatgttataa

SEQ ID NO: 537725 - DNA, 920 bp, Homo sapiens
agataccataggcctgggcagaggtaactgaaacagccttttgtaacggagtgaaccatggggaacctactcttaatgtcgagttataccagtgtaaccacctgacaagggtaccccatagagagggtctattcccatggggtcccttctgggcccgttgtattccccgccccgcccttattttgccgaggtccacagcataaatgccccggtgacaaacagcagagtgtcgcaccaggtacaaatgccacctttggtaaaccagcttgtacccgcccccgttgcactgtgggggactccacccaggaacggggtggggggaacaacccacaaacttgaccggcgtcaacgtgtagaaagtggaggacgcccaccctgtgtacaagcgcggtcccccggggggattttaatgtaaacttagaccctcccaaacgacccacacacggtgttttaaaaggtttaccaagaagacgccgcgtgttttgcctagaaacaatatgataaggagggagatagatatcgcaaagaccatttgagcgccaagctctaggaatagccccgcgtgaatgtttttgtgtcctcgcgagacacctgttgtctctttgagagacagctgggtgaagatccctacatcacgacctttccgcggacaaacttctagttggttcaagccacccgtccggaactcctccgtcttacatttgtgggcaacccccctccagactggcgtggtagaattcgagggtgtgtctgtacgcggagaaccccggtggaaataagttcgttttattgatacaagtacaaaagttttgggggcgccgagatcacgtgttgttaactctctcgataatccggtcatcggtccccaaaaacaaaaaaaccttggcaaacacaaccaaaaaaaaacgccccacaaaaca

SEQ ID NO: 537726 - DNA, 1004 bp, Homo sapiens
tttgtttttttaaaaatccctcaaaaacggtttataatacaagtgagtttggagtcacgaggggcttatcggtaggattcctggtagcgagcgcgggcaccagggcctccaaacttttgggactcgcagcgacgagggtcagctaccagcagggtccggtcatacgggatgaggatgtcttggatctccttctgggaagcctcatccacatatttctgggtaataggccaccagggcttgggagatggcactggacggatagcataaatctggggccaggtgaccaccaccctttacacggacacggatgtctacaccagcaaatcgctccttgccgagaaagcagaacgggctccagcagctggtcctggaagcgtgcgcggtcaatcgatctccaggggccgcccgttcacctggatgagaccatggccgcgttggcagtcgggccaaagctgtcgctggcttctggggtccgaagacctgcacagactgcagcgggcccttggcacggcatgtggctccgaagcgttggactagacaaccgtcaccgtgcctgtttcccattccagatggaggggtgtcaaggctcacagctcaacaaacgggttgagttaaccattttccagggtcaaccagaacagtaggcccctatagggcacaatccgagggaagtccaagtaccacttcggggctccacatattgtgcgggaccaaagcacagtggagtctcacaagaggggttccccggtacctggggcgctgacacgtggccacacaggggccaggcctcaaaggcccaagggaaattcacccagggctgggggccccggagccacagggggcccaaaagagtgtgcgacacacagacacagggagctcacacttggggaaactgcgaccaggtgcacgcggacaaacaccgggggccacagcagtacaacgagaacgggaccccggggggacccacacaggcactagggggccagaacacaccctgtgccaca

SEQ ID NO: 537727 - DNA, 730 bp, Homo sapiens
gagtctaggtgcagctgccggatccttcagcgtctgcatctcgggtcgccccggtaccgtcgcccggtctccgcgtctcccgggtttcggggcacttggtccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaccgagtttatgaagaagaatatggctcaagcctggaagatgacgtggtgggggacacttcagggtattaccagcgcatgttggtggttttccttcaggctagcatagaccctgatgatgggattgatgaagctcaagttgaacaatatgatcaggctttatttcaggctggagtaattaaatggggaacagatgaagaaaaatcccg

SEQ ID NO: 537728 - DNA, 135 bp, Homo sapiens
ggggtcgagggggcaactcacagaaggggactgacagtgggcaacactcacatgccactggatgctgttctgaaaacatctgattgggtttcatgacgtttgggtgtggtggtggactgctacattatgcgccac

SEQ ID NO: 537729 - DNA, 345 bp, Homo sapiens
  misc_feature (193)..(193): n is a, c, g, or t
ctggctctgaatttagggaggcagagcttgaagtgagcagagatggtgccactgcactccatcctgggcgacaaagcgagactccatcacaaaaaaaaaaaagatttcctgggcagtaagcgggtggcccagtgcctataatcccatgcacttcgggaaggctgagtgtgggcggaggagtttgaaaccaccncggggacaagcatggcgcaaaacccatatctctacaaagaaatagaaaaaaaataagctgagtgtggtggcgtacctcacagtcccagctaccgggaaggctgaaatgggagggacatctgagcccaaggggccaagactgcagtgagctga

SEQ ID NO: 537730 - DNA, 82 bp, Homo sapiens
gggggaagggtttggggcacaggttttggtttcccttcccccttttttttagggcttaaaaaaaaaatttttttttccctta

SEQ ID NO: 537731 - DNA, 1070 bp, Homo sapiens
taggtggctctcctattggggcttgttgatcatgctgtgtgtatagtgtgcttacctaatttcgccgaatatagtttctggctacacgttctcctcataataggaggcccctgaacggtgaattagttggctatataggtgctcctctgatcgcactgactgctcgacacgtggctggcatgttggtccggggcgacactcgcttgggtgcaacacttgattcttctccccgaattgtgtttccccaaacggcccatctcgatggctcttcggagtttcctctttgatctaacatttatttccctcggcggtgggaaagtgtctcggaaccccgttgtgatagggtactcccacgtgtgcctcatagtttacattggtggttgtccaatccgggcacatcttgtagcccctctattccagggctaaggctggaccttcaaaggatgtcaagggcgttcacggcacttcccagtggaaactaataccgttgcatctgagggatccctttctaaagtacatgcattgcttggaccttattttgtggtgtgtcttgaccttgactgtccaacggaagcacggtcccctgttacattcgtggggtgcccactgtaatctctcaatttcttcggcttgaatttttgccatgttgttatcgggtcattgcttgccggtatcttcatctgtatgtggttctgtaatccatttcgatgcctttatccagcaaaacgccaagatccaggccagttggtaccctgctgtggttggagaggtccattcactgaggcctccccgagcgcatctgaatgtcccctgctgtcagactcagaggtgaagtgcatcgagaatgacgccaagctgccagggcattgggtccactgggccagcgcctggcgatactggttaggggccaggatcattctgccccttgtccacgcaccaacctaccagccctcttcgcgttctaacatagggcacctgcatggggataagggatgtatagggacgagttcacagccctgccatatgaccctggtggcgacccctcctctgtccactgcctccactgctct

SEQ ID NO: 537732 - DNA, 225 bp, Homo sapiens
actagttatggatgcatatgctacgcaggatgcagcttcagaacgcgtatgctagccacacccctacgggaaacagcattgattaacctttagcaatatacgaaagtttacttagctatactaaccgcagggttggtgtcaatgtcgtgccgagtcaacagcgctctcgcgattaacccaagtcaatagaagccggcgtaaagagtgttttagatcaccccctcc

SEQ ID NO: 537733 - DNA, 300 bp, Homo sapiens
  misc_feature (127)..(127): n is a, c, g, or t
  misc_feature (225)..(225): n is a, c, g, or t
agcaatcacataaggaaggcacctcgagtctagtaacactgtgactcttgcggtctcttagaggtacttggtggtcttggataagatctggaagaattctttggatttccagacataggctcttgtnctcttcccttactttctcccaaacaaatggcatctctctctctctctctctgtgctgagctgcctagaactgtgggtgggatcacacaagcacccttntggccattgcccttgggactgtgctaggtcagacctgaagtcagcacagcattgggtctcacccaacacctgtgg

SEQ ID NO: 537734 - DNA, 241 bp, Homo sapiens
  misc_feature (143)..(143): n is a, c, g, or t
gcggcatagtcgcagatgaatggactctcggctctcgctatcattggtaagggaccacgcagtcctcacgcatcagaatctatacactcgacataagctgtgatacgagagacgtagtcgcctcgctacgccgtgaattgatnacctgtagagtgtgtatacaggttagcccacccgatgctttgatcaagttctcggatctcccagcatgtaattgaacccacgtgcctatgtcatgttc

SEQ ID NO: 537735 - DNA, 102 bp, Homo sapiens
gtgctttgggggttgtgagcagcgatcactaccttgtaattctcgtagcgtgccgaggccttcatggtgtgctctccgcgtttgccgcgtaccaaagcacag

SEQ ID NO: 537736 - DNA, 892 bp, Homo sapiens
tttcaaccagagagaaacatgattcatatatttaagagattactgtagtgactaggggtagggtaatgggatcaaggccgagaggtgagagatcagtatagatgtatcagaggtgtcagaagacagtagttgggttggggcagaggtaacccagattggaggtatgtttgaagtaaaaaaaatatgggggtaactttgctgctggtatcatgtagaaggagagggagtaggatggtgatcccactgactaaaatggaagaacgctgagaagttcagagagcagaacagttttgtgactgttgatgtgtagccatatgatagacacacagtgcaagtgctctgagaatatcttcctcatttaattttcacccaaagggtctgagaggggggtatatcctcataatatagatgagggtagatgctaaggccaatttttgctggggaagatatggattattattcttcaagtgacattaaaatatacttggcccaaggtaccagtttacttggaaagtggcagagttggatgaaacttagcctttcaactctaaactatgggtgtttttccaagttcatgtttgaacaagaaatacaggcaaattttcctgtaggagtagggcgcaatggcactgtcgggtatactaattagacttcttcctatgtggacccaacttgcgcggctcaatgtggctcaaggaaaatcagcgccccgtttaacttttctaccctcagggccacacaactctcaagtttaacactcaccagtctttggccccctcggaattgttgggcccaaaagtaaaaatctccctcgcattgggaacaccttctcgggggaagccagagtcaaccctggaacggttgaatctacccatctcgggtgcacagtcac

SEQ ID NO: 537737 - DNA, 307 bp, Homo sapiens
atggtaagtctctacttcatggctggaggagtcatacaggataacaaagaaaaaacaacatagaaaaaaatacgcaaagtggttccctttatcgaggaagaccacagggtgctgtagggcagcacatgtgctgggcaccaggcagttagtgcaccaggaagaagaagcacaccaccgcaaatggccatgctgggtgagaagcttcagcagggaaatgaacgttcccgcaggtagtgaaaggtgcttatctcgattgtccttcgagagttgcctgcatgactggtttccagagcgcatcatcacacat

SEQ ID NO: 537738 - DNA, 1349 bp, Homo sapiens
  misc_feature (1349)..(1349): n is a, c, g, or t
agcgggggcggacgccttcgcgtcaatgttctcaccgagtgctctgcgtaggtttcccaccgtctgcgaaatggaccacatggaggggttcaaaggttcaggatcccagtacgggcaaggtgatccctctttgagtctctctccgttgggcttgttgtcggactttgctggacctcggaagccacagtgagactcccattgacggagggagtgactcgtacgatgaaggatgtgatgatgacggtacacaagacacgaccgacacggggggctcgatggcggcccgtggggacaagccacagaaggtgagttgtcgcatatggtacctccacatgtgacaccccctgatggaacgtcacggagtatatcagggcgcttacagacatgttcacgggcacgacagggacgggacgaggagtagccgattgttccgacgcatgtgaatagctatccgggaccttttcgcaattgagcaccttaagctgaaccgaagggaatggatccaaagtatgcgaatgcatgtctacgactggatcacttggggggtgacctggaggaacccctgttggccccgttttctctcaattagctcgttccccgtgaataagcgtattcactatgggggtgcccttcggaaaagtttcgaaggtaaggaaactacccattggggttagaaagtacatgatcttaacccggagggcaacgtggtgtaaccaatggagctacgtttgcttgtgagtaaactttccagattggcgttgtaaattggttaacttcccagggactttagctctcttggcgccacggacacccctggggtacatgcctatagtggacgcgcggatggaggttcttgctgggagacagaaagggtagacctttacccgataacgaacagcgtgtgtacaaatttcccaacggtcatcacaaaacctctatggattgatcacaaaggtaaggtttggcttgggcattccgcccctaagggaacgcggtcgccccatttgtgcaactaaacgagcggtttcgcgaaatgcggaattgctggacgtggggaccattactctgggcgaagagccgcggccctaattgccctttaataggaagatccctaatgcaacaggaggggtaccacaacgtgggacttcatttcacggatcgttgtgcggcacaagcggttttgtcaccccaaggacgaagggcggtccttttcaaggcacccttgggtatctcttaacggaacgcgtccgctccatatgagcccccaacaaaaggttcacctctcaattttttctcaaccatgaacaggcgagattcgtccatatgggtgagaacacagcgaaggaatn

SEQ ID NO: 537739 - DNA, 121 bp, Homo sapiens
gaggaccccctcatctcctcctttctctctctctaatatatacatgcgggtatgtagagtgtgtatatatttattttttgtgtgtttatatggtgtgtgtgtgtgtgtagtccaaaggcag

SEQ ID NO: 537740 - DNA, 694 bp, Homo sapiens
cacccgcgttgtggtacgtgggctgtgggcaaggacagcgcggtcagcgcagggtacaaggtaccgatagctacaatgcggtggggcttgccctggacagcagcttttcccagcgcttttccctgggggtgcgtaacaacttgtcccgggatcattcaacaaacgtacaaggcgcgcgcaacagtgtgtctgtgagcgtcggcctgcctgcgaatgtacagatgtccttgagtgccactgcgcagacaccgggctatcgtgacgtcatcgatacagtgacgcctcatgtaaacgatgtggatggttcgcgattcaagaaccagtacaccgtaggattcagttgggcggaccctcagttgggtggcttctcaatcggttataaccggggggccgatttcaagagccggattacccagaatatctacggcacgtggaacaagagcttcagatatgccagcgtcggtgtgaccgtggactctcagattggccagtccaacagtgccgatgaccggaacgatgacggactgggtattcgactgcaggtcagtgttcccctgggccgtgatcggagcctcagcgcattcgctcgacgtcaggaagagcgctccagtatcggcactgcctatgatgagcgtgtcgacgagacgctgaactaccagatacgcagcgacagagacttcggagggcatcgtga

SEQ ID NO: 537741 - DNA, 123 bp, Homo sapiens
actgcatctgtgcctcagtgataatttaaggatgaagaatgaccctttagactggaatggtgatcacatccacaccaatttcagggatatgtaccagcatctgagaagcatgggcgtactttg

SEQ ID NO: 537742 - DNA, 465 bp, Homo sapiens
gcgtgtttatagcttatccagtagttgggatgggagcaagttcacaaggaataggacttaattttgggaaaaactagaaacctgacaaagcattgctttgggagtgtctgtgacggtgtgtgcagaaggagttagtgtgagcatctgagtggaccaggtggggaagatccgccctcagtggtgggcaggcaccagctaatagcctggggccctggagatatacaaatacagaaggtgaactgtctctctcagagctgggacacactttttttctgccttggacatcagaaatttgattccatgaaagtgcattatcacattgactttgtaagccttgtgcctgtacattaaaaatgttgaaacttcctcagtaaaagaagtgtgctatttgtgcacctgcgcttgttgaaagataaaatttctcaagatcttggttctttggttgactacttgtgcagtggtgaa

SEQ ID NO: 537743 - DNA, 865 bp, Homo sapiens
  misc_feature (477)..(477): n is a, c, g, or t
gtgcggggtggtggttcgggggaggggtcttgcggggccgggttgtgtccccccggcggcatttctgtgggcgattgggggatggctgtgcgcgttgcgcaggagggttggcccccgtgggagtccccggtgggagtgtcggggtgggtgcgcacgaggggctcgttgtttgccccgagctggtgcccggagtgttgtggtgggcgcgctgtggagtgtgttgtcgcccgggctggcagacgcaggcctgcggtcgccgtgagtttgctgtcgcccgcgggttatggtgtgtggctcgcgcggggggtagcgggtgtaagggccgccgggttgtcgtcggccgccgcgcgcgggtttttttcttcttggaggggagaccgccctgtggggggggccgcggcgtatgggttgggccgagtggcgcggggaatggttttgtcgtgggcgcgctggattggcgcggcgtccggtggtgtnttgccgggggcgcaccagagaggtggttgcccgtagagagttggagcgcgagttagggttttgtgtctgcgcacccccccgaggttggagctgtgtgggcataccctttgtgcccgcaccagggcggtgctgtgtcagagagggtgtgtgatgaggcgataggtgggtcacaactgcttttgtgtgacgaggagggatgacagagagagggagtcacgccctgctcgtggccgtgtcacgcggcctgctttccgcatagtatgagtcaccggggtggtgcgtgggtaaaaccaaatgcagcagcatcagttgcagaatgatttgcgctgcatggtgatgcgttgtatccccccgctgtggggagaaaaaaaagggcgaaccacaagac

SEQ ID NO: 537744 - DNA, 221 bp, Homo sapiens
tatctctacattaccattattctatagaagttaactacatctcttttattttctcctattttgatagtattagccacacatagggtttctagtttctcaacacctattcttttctttattttagtttcttttctcatttatttatttttttttatttttatcttttttgagacggagtctcgctctgtcgcccagcctagagtgcagtggctcgatcttga

SEQ ID NO: 537745 - DNA, 899 bp, Homo sapiens
ccaaatctcatggtatccttgagcctaatttcccttgactgcctcccagtagactattaaagaaattggtaaagctcctaatctcaaagacaaacggggtgagggatgacaggaacaggatgggggcgtgggactgaaagtggactccctcgacgggcacttactggcatgtccctttttcatctttattagggtctagttggtacactgcttcagatgtatacgagtaaggccgttctacaagactatgtctacagatgtcgagagtgcccggcaagctggcgttccttcgcgttcctgccccacaagcgtcgcgtggacctgaatttcgctacctaaatagttaaccatatgccgtagtctctgaaactaaaaacttggacctcatcctcagttattagctcctttcaactctgttgaccctcattgtactggtcttcctctcaagaaggtacccgcagaaatttgtattgtgtgcgccctggcccgtcgtaaatgcccaagtccggggctgcacatactcactggactgttccagttttgacagctgccagtcttcctgcccctttcacactgcagctgaagttcattacctgaaggacgcctcatcatttcattccttggtccaaaccttctgcttgctctaaggataaaaaagctcaacttcttaaacagtgtacaagtgtggcacttccaactttttatctgtcctctcaccttcagtttagcgtcattccaaaaaccacaccttggaaagcttgtactccgcaccccagatgatctccaggcggtcagatctctttctgacttggccggcctggcccggtacttctcctttttgtggcccagtcccagcaattgtactccccaagggaaccgaaaagggtgaacccaaggtg

SEQ ID NO: 537746 - DNA, 308 bp, Homo sapiens
tcattcttctgaatcctgactatgtgcgggaccttggctatgtggttgagggctacatggcactatatgaaacgaagatggtgttcctgataacatgaaaggaaaagacaaaatcgtgttcggcaacatccatcagattaacagagctggcacagagactttaaactaggtagagttagagaagtgccttgaagatccataacaactatgatccctttctgttaaacacgatagaaggttgcgcatctacattgcttattgtccataatagaccatcgtctgagcaccttgtctcagaataccttgat

SEQ ID NO: 537747 - DNA, 464 bp, Homo sapiens
agttacttcgggaggctgaggcaggagaatcgcttgaacccaggaggcagaggttgcagtgagccaagatcgcgccattgcactccagcctgggcgacaagagtggaaactctgtctcaaaaaaaaaaaaaaaaaattcagtgaaatacacctttatatatgagatccaagtttcactttttgtgatataatgagccagttttctcagtaatgtctactaaaaaaaaagccattaacctttctctaatatttgcatgattctaataaaagtatgtcaacttcttaaaatgttttattgaaatgtggcattcctttgaattttatgacattaaaataatccacgacatggtacagctcttcactttttcagctttttaaatgtccattaataagtttgaatacgttaaaattatatgtttaacctcaacaaaataaatggcaatatgttcaacttgaaaaaaaaa

SEQ ID NO: 537748 - DNA, 223 bp, Homo sapiens
tccagtagagctggtggtgacccatctatgctcttcaggagtgcagtgagacaaaaggaaagagctccagttacatattaataccttgtaataaacggggactcactatgttaaactgggagggagcccacgtataacccaaactggggagtcttgacataaccctagaaatgtttttctgtagtacctgctgatggactctctatagacaatgaatcttgtc

SEQ ID NO: 537749 - DNA, 170 bp, Homo sapiens
gctggagtggcatataactcctaagactcttggatctccaaagtgatgtctttttgtgtgctaatgagttgccagatggctggcagctcctaggtagcttcaggatgggggctggtcaccagcaaatgattagacgcgttgggacttattagccctagcgcccatcactt

SEQ ID NO: 537750 - DNA, 315 bp, Homo sapiens
ggacgcgtggggaaaggatcatttaatgactgttttacttataagtcattaagtaatccaccatttcttatggatgatgcttaagcctggtgaggtttgtactctaaggagcccagatcataatgcagtgcatttccttagcccttagagtttcttgcaaacatttaaaaaaagacatatttaagaaagaaagataaagaaaaaacataaagcagtacctgtttacagtaattaaatatgttttttctttatctttctttctacttcaaccaaaatcagatctttgaggttttgctgacattgttggtggttttg

SEQ ID NO: 537751 - DNA, 987 bp, Homo sapiens
  misc_feature (35)..(35): n is a, c, g, or t
  misc_feature (38)..(38): n is a, c, g, or t
  misc_feature (40)..(40): n is a, c, g, or t
  misc_feature (48)..(49): n is a, c, g, or t
  misc_feature (74)..(75): n is a, c, g, or t
agcgagaacacgcccccgacataaggacctacaangcntntggtcaannaaccccgcagggatgtgaattaaannacgacgcatacatacgtcctagtacgagctggtggatcgacgagcgaatcgcggtctgctcacaggctggagaccgcgctcgtccaccggcggcgcatagcagcctcgtcactctcacgacctcggatgcccaagcccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537752 - DNA, 434 bp, Homo sapiens
ctcctagatggaaggaatgctttgcttttctgtttgccctttgtttttgtttttgaagcctgggcgacaagagtggaaactctgtctcaaaaaaaaaaaaaaaaaattcagtgaaatacacctttatatatgagatccaagtttcactttttgtgatataatgagccagttttctcagtaatgtctactaaaaaaaaagccattaacctttctctaatatttgcatgattctaataaaagtatgtcaacttcttaaaatgttttattgaaatgtggcattcctttgaattttatgacattaaaataatccacgacatggtacagctcttcactttttcagctttttaaatgtccattaataagtttgaatacgttaaaattatatgtttaacctcaacaaaataaatggcaatatgttcaacttgaaaaaaaaa

SEQ ID NO: 537753 - DNA, 329 bp, Homo sapiens
acccccgtctccactaaatacaaaaaattagccaggcgtggtggcaggcgccagcaatcccagctacttgggaagctgaggcaagagaatggcttgaacctgggaggcggaggttgcagttttccaagatagcgcgatggcactccatccggggtgagagagtgagactctatctcaaaaaaaaaaaaaaaaaaaaaaaggttaaaatactcaggggggggctccaaaactgggggtgatggggggatgagggaagggggtgtgccagagctgcttaaggtccaaggaaagcaggaagcacgttcagttggatgaggagagtgggagga

SEQ ID NO: 537754 - DNA, 1206 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgcgcacggacctgatccaggcgccgggacaaccacctgacggcggtcgccgccgtctccttctcattctgcacgcgcatgacagtaccgccgttctaccctctgcgaggctgcggacgcagaagacatagcctaggcaagtgatcgtcaggacgtgtccgccgactcagactccgcgcagtatctacaagctgggaggcatctaacggcacctccgtacgatttcccgtggtccagtggtcgtatacctaacgttatgcacccgtcgactgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537755 - DNA, 467 bp, Homo sapiens
  misc_feature (119)..(119): n is a, c, g, or t
gggtatggaggttcactggtaatcccagcactttgggaggcccaggcaaaaggatcgctgcagcccaggagttcgagactagcctgggcaacatagcgagacctcgtctctacaaaaanaaaaaaaaaaaaaaaaaaaattcagtgaaatacacctttatatatgagatccaagtttcactttttgtgatataatgagccagttttctcagtaatgtctactaaaaaaaaagccattaacctttctctaatatttgcatgattctaataaaagtatgtcaacttcttaaaatgttttattgaaatgtggcattcctttgaattttatgacattaaaataatccacgacatggtacagctcttcactttttcagctttttaaatgtccattaataagtttgaatacgttaaaattatatgtttaacctcaacaaaataaatggcaatatgttcaacttgaaaaaaaaa

SEQ ID NO: 537756 - DNA, 1465 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaacaaaaaaaaaaaaaaaaaaaaaaaaaaaaaaaagaacagatagaacatgcatgaacggggggggggggcggacaaaaaaataatcaagacgggggaggacgaaagtaaagaggacgacccgacgaagtagaaacaaaaggggagcacaaaagaagagcgaaaaataaaacgcacagagccgcggacgcacaaaacacacaagcgagagaagaaaaaaaaacagaaagagggacacatacgcggagaagacgacaccaccaacggggggacggaaaacagaagaaaaaaaaaggcaaaaaacaaaacaacgcaccggcaa

SEQ ID NO: 537757 - DNA, 1562 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggcgaaaagaaacccgggggggggaatgggggcccattgttgttagaaagggggcggccctatggagggggcttttataaaatgtagatgaggaggaggcggcggtataacaaacgattgtgtaggggagaaaagtgaccgagcggatgtcgtaggaacaaaccccacttgtggtggtcagacaactttggcgcataaccgaacgaagtttacagcgcgggggaaatagtagatcaggtaatgtgggcgaacacacttatatcgcgcaaaaagtggttgtgagagatagaatttg

SEQ ID NO: 537758 - DNA, 208 bp, Homo sapiens
gagaacaccttcttcatggaccccccactggagcggcaggtggagaccattcgcaaactggtggactcatacgtgggcctcatcaacaagtccatccgcgatctcatgccaaagaccatcatgcacctcatgatcaacaatacgaaggccttcatccaccacgagctgctggtctacctatactcctcggcagaccagagcagcctca

SEQ ID NO: 537759 - DNA, 1613 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
  misc_feature (1187)..(1187): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaacaaaaaaaaaaaaaaaaaaaaaaaaaaaaaaaaaaaaaaanaaaaaaaaaaaaaagagaggggggggcgggtttaataagtgtttctctctcggggggggcgcgaagattttgtgctgcaccgcgttttttttagagaagggggctactattatagggggggtagtatttatagaagggagggaggggacgcgggtgttatataaacaacggctttggtggtggggagaaaacatgatgctgtagtggtgtgaagacatttttgaggggggaaagcaccccacttatttttgggggggggggaagcaaatatgtgtgggagaaacaacttcctacccagagagtatattaacggtccgcgagggggaagtaatataaaaaactttgggagggtgtttaggagtggttgagacaaggtgataattatcgttgggtgaaaaaattttgtgcggaggagaatttattgaa

SEQ ID NO: 537760 - DNA, 1075 bp, Homo sapiens
  misc_feature (479)..(479): n is a, c, g, or t
tctccccttttttgatatcgtgtattcttatgggcctttctttttgtatctgggtggttggttgtatggttcgcggctcttttccataccgcttcttcgtttttgcgggagttctttccccggcccttgccttgctttggcaccatgaggcgggtcccaagacgggggccctcggtctccggtttctcacccgcgttcccggatttattttcgaacgccagaacttgatggactttcccgggcattgggcttcaaatcagaatggtctttcaagattttcttcggggcaccttgctggtgacggccgatggccccccccatgggaagcacctggcttcacgcttcaggggattatcccgggaccatccaggccccatttagccccggctatgcccctgtattggattgccccccggctcacattgcaagcaagatttgctgagctgaaggaaaagattgatccccgttctggtaaaaangctggaagatggccctcaaatttcttggaagttctcggtggatagctcgccccttggttgataataggtttcctcggcacagacccatagtgtggttgagagactttctccagactataccccctcttgggtccctttgctcgttcgtggatatgagaccagaccagtttccggtgggtgtctatccaaagccagtggccccagaaggccttctggagctggccaggtctcacccagatcttgccccagaaagctctcagaaggccttaatgaatattatcccttaataacctgcccacccccactctttaataccagtggtggaagaaacggttctccagaactgtttgtttccaattggcccatttaagattttagattagttaaaagactggtttaatagataaaccaatgcatcgttaaaccttcagaaggaaaggagaatgttttgtggacccctttggttttcttttttgcgtgtggccagttttaagttattagttttttaaatccagtacttttttaatggagaaccaacttgagcccaaaaatttgtcaccagaattttgagaccccctttaaaaagtttaatgaga

SEQ ID NO: 537761 - DNA, 260 bp, Homo sapiens
  misc_feature (9)..(9): n is a, c, g, or t
  misc_feature (32)..(32): n is a, c, g, or t
  misc_feature (55)..(55): n is a, c, g, or t
  misc_feature (185)..(185): n is a, c, g, or t
  misc_feature (193)..(193): n is a, c, g, or t
  misc_feature (250)..(251): n is a, c, g, or t
atggtatcnggggacccggtcaccacactgtnaacatctacgaggaggtatagcnctccccatgccatcctgcgtctggacctggctggccgggacctgactgactacctcatgaagattctcaccgagcgcggctacagcttcaccaccacggccgagcgggaaatcgtgcgtgacatcttaanggatgaangctgtgtctacgtcgtccctggatctttcgatgcatttgatgatggccacgggctgnnttccaagct

SEQ ID NO: 537762 - DNA, 564 bp, Homo sapiens
  misc_feature (58)..(58): n is a, c, g, or t
aaaaaaaaggtttcaattaacattttatatatggataatgctttgtaaagtgtaaganaaaggttgcagttggtcattgttttccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537763 - DNA, 130 bp, Homo sapiens
gatactggggagtactttgagtcagggacccgaacactgatcgctgggtggcactgggcatcgtgtcctggggcatctgggtgcagcaggggctcagtcctcctcctccatactcttatcttgatccagt

SEQ ID NO: 537764 - DNA, 1192 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
  misc_feature (1181)..(1181): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaacaaacaaaacaaacaaaaaaaacacaaacaaanaaaacaaacaa

SEQ ID NO: 537765 - DNA, 472 bp, Homo sapiens
gtttcttacatttatttttctgaggagttatagcttttgaattggtagttgacgttttttcactacatttgagaatacagcaaccatttttttcctcatcttttccagccatttcttcttggtccctggttccatgtgtggtgcgtgatattgtaccacaggtcactgagactcgcttccttgttttctttcagtcccattttcccttgtacttcagatggaattgtttctactgatctcttttcaagttcactcattcttctacaatgttcaatctctctctctctttttttttttttttggaaacagagtgtttgctcttgtagcccaggttgaagtgcagtgcattgatctcggttcattgcaacctctgtctccggggttcaggcaatccggcctcgggatcccaagtagctgggataacgggcttctgccaccacacccggttaatttttggttttttaagtaaaga

SEQ ID NO: 537766 - DNA, 144 bp, Homo sapiens
cggcgtatctcctcttctctagcgatgaagagctacagatctgcccgatggccaggtcatcatcatatggcaatgacgcggttccaggtgtccggaggcgctgttccagccttaccttcctgggatatggaatcttgacggcat

SEQ ID NO: 537767 - DNA, 1327 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaccattatataatcaataacataataaaaaaaaacatgtcggccgctttggcccagtcgactttagaattgaacatactaattcatgcggcctgaattcgaggctaacttgggccaatttcgcccctatagtggagtctgattcacaattacattgggtcgctctgtttacaaaacgtcctacaactggtga

SEQ ID NO: 537768 - DNA, 756 bp, Homo sapiens
gcccgggctgagctgcgcaggggggttgggccaaatggggcgagggcacaaaataaccattaccccttctcaccgaggaagagcgggagacagggtatggcacagtcacaagggtgggtgaaaagatacatcagggccttgggtaagggcttcttggtggggtgcctgtggaggtgatttctgggatcgggtcgcctgtgtggcacgagtagaaggagcatcgagtgcagccttcttgtgaatcctggggggagccagtcatctgatgtggtgctttgaccccatgaagtgaggaattcttgaagtacaccgttgtgaccttgtgtatcatgggtggtctcttaaaaaccagaacagaagatcattaaagagagtgatgctctggaaggagatatggtcagaacataggacacaaaaaccggtatgtcaaagtcccccgtgtcacatcgtgggtcgaaggtgatcatcaggggacacagtttgacagtattccttgggcggttccctaggacttctgatgccattgcaaattatctgtgccccaagaggcgtggaagaaatggaatctgttctcctccagagcgttacagtacgagaggagagaatgatgtgaattacctgagtgtggctgggggccgtatgcaaggagggaaaagaggtcaagggaactctgcattgcggtgaaatattcggttaaagtgggttcacaacttacggtacgtaatgccggtgggataaccgggtggcccatgaggg

SEQ ID NO: 537769 - DNA, 2036 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggggcacacaagagactactgccgggggagccacaaacgtacaacctcaaccacctttgtttaagcaaagaggggcgcgctcccaaatgggggggctaataaatcaaaagacagcaacgcggggcgggccgataaaaacaccaacgcggcggggaggaaacaagcggcacagcggagcattttggagggggaagcacccccacgcgggggggggggagaaaaaaaataggggcgccgacccccccctcccgcaacaagcgagctaaattacaagaccgaccggacggggagcaaaaaacaatacaaccactactgcagacaaggagcgataagaggagggggggacacaacccaccacgacggaacaatataccgacgcggccgaggcaaaaacaaatcgtccgccacacccgaacgagacgaactaactcactaccacaacgaacaacatacttcatatcagcgacggcggcgggtttgctgacagcaaaatataataacaccacctcgagccggccaagcgtcgcagaccactcgtaagagaacgccgggtacgacacaaagacagcggcaagacatacggacagcacgcagcaactacgacgcaacgagtcggatagccagcgcaccgaactggcagcggcacacaccactgagaaatagacggtcggcgaacagccacacacaagcgaggacggggagacaagacagccagaagacaccacggaggtcggcaacccgagcaacgaaaccaacactaacctcacaaaacacaaaccaaaaacggcgacagccgaaagacaacaaaca

SEQ ID NO: 537770 - DNA, 1514 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaaaaaaaaaaaaaaaaaaaaaaaaaaaaaaaaaaaaaaaaaaaaaaaaaaaaaaaagggggggggggcgaaaagaaacccgggggggggaatgggggcccattgttgttagaaagggggcggccctatggagggggcttttataaaatgtagatgaggaggaggcggcggtataacaaacgattgtgtaggggagaaaagtgaccgagcggatgtcgtaggaacaaaccccacttgtggtggtcagacaactttggcgcataaccgaacgaagtttacagcgcgggggaaatagtagatcaggtaatgtgggcgaacacacttatatcgcgcaaaaagtggttgtgagagatagaatttg

SEQ ID NO: 537771 - DNA, 125 bp, Homo sapiens
gtcacgttccagcaggctccagtgaaatcaaaccagtaaaagcaaaagcccagtgaggggaaacgaggggcgtgccggtgaagcctgtgctgcaggggtgagacgctgggtccatgtgtggtgac

SEQ ID NO: 537772 - DNA, 235 bp, Homo sapiens
ggggggttccccccgattccccaaatgggggggggttggggtttgccctgggattcccccttccccttcccctttggggtggggtgggggtggtggttttcccgggcccccctaaaggcggtttttttagccaaaaatttccggaaaggggtttttgggatcttttttttaaagggggggacttatttttggcccaccctgggggctttttcctttaagttttggttttccccca

SEQ ID NO: 537773 - DNA, 102 bp, Homo sapiens
acgacacacgactggcgtcaggttaccggcaggacgcatgaacctgtgtctcgggtaacgtgacgggactggggtgatgctggcagaccagaggaatccaat

SEQ ID NO: 537774 - DNA, 201 bp, Homo sapiens
  misc_feature (174)..(174): n is a, c, g, or t
agctgggagttaaggagaactcggcatacatctgcagccgcgccagagggttccttcggcgtctctgagcagcaggcagtggaagcctgggagaagctgacccgggaagaggggacaccctgaccttgtactacagccactggcgcaagctgggtgaccgggagatccagctgnagatcagtggcaaagagcagcaggagg

SEQ ID NO: 537775 - DNA, 109 bp, Homo sapiens
atctgtttggcgagtcgggtaggagaatgcacagacgtatggcagtgaaggtgagcgtggggacaccgggaaaggcctgggacactgcagccaatgagccgcggctcag

SEQ ID NO: 537776 - DNA, 103 bp, Homo sapiens
gaccaggctgagggcagtgaatcgtgagaagacagactccgtcgagacttgtgaggaggatggcagcaacaaagaaaacaggacagcagcttgtctttgtttt

SEQ ID NO: 537777 - DNA, 133 bp, Homo sapiens
cacaacctatgggtagagtgtctctaaatttgggatgtagccagtcccaaacggacttgtaaaagtgtcagctgggacagtgtttcacaaacggggatgggagaaagaccacagttctgaaagatgctgctcg

SEQ ID NO: 537778 - DNA, 313 bp, Homo sapiens
  misc_feature (216)..(216): n is a, c, g, or t
aattctggactgagagcccttcagcggtgcttgctcagtgtagtagcttttgctattacatgcccagtgccagctggcctagactgaagctccagagtcaaaaaacagggctaatgaacagtcgagaaaaaaacaatgcagacagtcttttaggggtgtgcagtattaaatcactttgaaagtgtgacgacttaaagaaaatcctcttgcctcatncaaagaatattagaaatacattaatttggtggaataattataatagtagctaccatcttttttttttttttggagacaggtttagttttgtcaccca

SEQ ID NO: 537779 - DNA, 131 bp, Homo sapiens
ccctctcatgcgtgactgaatgtagcttgtggatcactgctcagcgtcagctcagtagctgctgcgcgtacttgtgttgcttgttggaggtgtgtgtctccactcccgctgacggggctgctatctgcttc

SEQ ID NO: 537780 - DNA, 599 bp, Homo sapiens
atgtctgtgctcattcagaggagggggccagaaggcgacatcactgtacctggtaccgcgtgccatacacagagccatgcctatttggatagtggttctatctgagacaaccaaagggctgccacctgccatgttgcttgaaagaaccatatttggaggggggttcccacactgtgctgagggaggaatcagccattgactgccattaacaagagagcttggaacgactctggtgcataaacagccgaacagcatgctaactggatgcacaagtagatgtacaagagtatatccatgtcaggatggcgcaatatttgaactgtgcatgtcagagctagcatatatgtaccagttaatgtccaatgaccaatcctatcacaccttggaccatacaatgaagtctggcggtgctaaaagattgcaagcctccatagataacggcttgaccaaactgaacgtcagatatttaaagagatatcaagacttcattgcgacacgtaactgctaagtctacgtgaacttgccattacaatgacagctgcagaatgacttttatgactgaaatgcttactcctgactattaaagcttaatcaagctt

SEQ ID NO: 537781 - DNA, 149 bp, Homo sapiens
agactaactgagaggttagactcaagccggtttgtctcactcccaaaatccacaggacattttccattatccacccagttcaagccgtgtaggagggctttcctcatgtacagactattacaataacggccaggacgagtcaaccgacg

SEQ ID NO: 537782 - DNA, 225 bp, Homo sapiens
ggaatttagggggatgggtttttggggccaggggggttttttttccggcccttggccctttccccccgggggggccccccgccccttttggaaagggcccttgggcaaggggttggtagccggttttttcccctgcccctttttttggccccctgggggccgtttttccccctcccccggggggggggggcttttttgggtccaatttatttttcggggggcccg

SEQ ID NO: 537783 - DNA, 174 bp, Homo sapiens
tgtgctgggactcccctgcatgcttaacacacctggttcatattcatcatttcagtcagcagcacatggtccacaatgtatgtgtccggctggtctcgaactcctgaccatcaggtgatcctgccatgccttgtgcctccccaaagtgcttggaattacagtgtgtgagccacc

SEQ ID NO: 537784 - DNA, 767 bp, Homo sapiens
  misc_feature (121)..(121): n is a, c, g, or t
  misc_feature (177)..(177): n is a, c, g, or t
  misc_feature (194)..(194): n is a, c, g, or t
  misc_feature (197)..(197): n is a, c, g, or t
  misc_feature (200)..(200): n is a, c, g, or t
  misc_feature (205)..(205): n is a, c, g, or t
ggtttttttttcctctaggcagagaagaggcgatggcggcgatggcatctctcggcgccctggcgctgctcctgctgtccagcctctcccgctgctcagccgaggcctgcctggagccccnagatcaacccctttcctactacaccacttctgacgctgtcatttccactgagaccntcttcattgtggagatntcnctnacatncaagaacagggtccagaacatggctctctatgctagactgtcggtggaaaacaattccctgtcactctgaggccaggatgtggggcgttatcatggtgtcctggcagcctggaccacaagagcgcccacgcagtgcacctatgaggttcagagttcttcgacgaggagtcctacagtcctcctcatggaaggctcagagtgaataacgaggacatttccatcatcccgcctctgtttacaggtcgagcgtggaccatcggggcacttgtgagacgggccctgggtgtccactgacgtgtgctggctgcgcgtgtatcggccttgtgatctactacttggccttcagatgcgaatgagccactatccagtgcctgagcgtgcggtaccccagccctgctcttgctatccttcattcaatgcatcacaggagctgggactgcacaggataacatgtactctccccagattgtaaaactctgtaagaacgctgcttgtaatctgaatcccttgttgaaactctgaaaacatgcataactaagatctcttctccaaaaaaaaaaga

SEQ ID NO: 537785 - DNA, 445 bp, Homo sapiens
  misc_feature (16)..(16): n is a, c, g, or t
  misc_feature (196)..(196): n is a, c, g, or t
  misc_feature (211)..(211): n is a, c, g, or t
  misc_feature (221)..(221): n is a, c, g, or t
  misc_feature (320)..(320): n is a, c, g, or t
  misc_feature (330)..(330): n is a, c, g, or t
  misc_feature (363)..(363): n is a, c, g, or t
  misc_feature (397)..(397): n is a, c, g, or t
  misc_feature (406)..(406): n is a, c, g, or t
ggttctgtaatcccangctatcaggaggcaggagaatcacttgagtctgggaggcagaggttgcagtgagctgagattgcaccactgcactctagtctgggtgacagagtgagaccctgtctcaaaaacaaacaaacaaatacctcactgcatgaggccactgagatttggggattgttgttacagcaccagaacncaaatcatcctgacngctagggtgncctaactagggtttcttaccaaaagcaaaggcatttttaaagttcgtgacatttaaacaaaagagcaaataccaatatctaccactttgtcaggctaanaaacccaaanaaagccaacagccagaagttaaaataaacagancattaggttgaaaatagaactgtcaaaacaggcncaattgacntcatttagtgattgcaaagaacatcaggcaagacacagg

SEQ ID NO: 537786 - DNA, 290 bp, Homo sapiens
  misc_feature (39)..(39): n is a, c, g, or t
  misc_feature (42)..(43): n is a, c, g, or t
  misc_feature (50)..(50): n is a, c, g, or t
  misc_feature (61)..(62): n is a, c, g, or t
  misc_feature (65)..(65): n is a, c, g, or t
  misc_feature (67)..(68): n is a, c, g, or t
  misc_feature (107)..(107): n is a, c, g, or t
  misc_feature (140)..(140): n is a, c, g, or t
  misc_feature (186)..(186): n is a, c, g, or t
tatccggccgatcatgtctgtatctggtatagcgggggnctnnagggacncactggccccnntanannattaacgaggtaaagttgttccctcaagaaacccttttncttgaagcaaaagagtaaacacggcccagcggnggaaccagccattccttgacaagccagcagcctgcgtcaggagaanggctcctcgccaacccacccacacgctcgtctcacacaattcaatgtcacacttctgcctcttgcaaaattgctggattttttctaataaacatagctactgac

SEQ ID NO: 537787 - DNA, 699 bp, Homo sapiens
  misc_feature (514)..(514): n is a, c, g, or t
  misc_feature (601)..(601): n is a, c, g, or t
  misc_feature (694)..(694): n is a, c, g, or t
tgtccgaaactgacatgaggcaggagaactcttgaacatgggatgcagaggttgtggtacgccgatatcgtgccattgcactccagcctaggcaacaagagtgaaactccatctcaaaaacaaacaaacaaacaaacaaaaaagtgtgctggggcttggataaccacaactgacaacctaaattattgaggtagcaaactgcctagaagaggtagacatttgcggccctgaaatcaggacccggcggtgagagacaccgcctgcgttgtttttacagttttattagccacatccctcagggaatctcaccgcaggtctcaggagctctctctaatcttgttaaccttctgcgcctctcctcccggagtacaaactaatctttcttaatgcaagaggacagggcagctttggaaaggccgtcaccagacagccagcgttccccatcctcacaactggaccttggagagctttggtgtatggaaaccggctgccctggaggcgggaggtgaaacgngaaaccctgacagacggtgtcactgagcttagagctcatgtttctagaaaaggcaacagatgcaggtctgatgatgaagcttaattngggatgtgctgagcaggaattatttaaaccaatcccttgatgaatttgtctttaaggaatatgtcctttctctcgtgagtcactcaggctccnggaca

SEQ ID NO: 537788 - DNA, 285 bp, Homo sapiens
  misc_feature (238)..(238): n is a, c, g, or t
cactcgtggagatgggcgtagcactgcgacatgcgatgaggaaagatcggcacagagggcagctaaagactgctgagcgggtcggagggctggtgcgccaccaccgaagctagtgcgttctgcgtgcccactacgctgcccgcagtttaagggcctacggtccatagagaacaccaccatcatggccagatggaagggtttaattagtacctgctagcagctgtcctgcctggtgaanggtggcctggccagcacacttactgcgagggccagcctggggcttta

SEQ ID NO: 537789 - DNA, 240 bp, Homo sapiens
cggatctgatgctggtgttgtgagacacagccgaggcgcgagagagtcaatgaggcatgagtccaagcgagtcgttcaggacgggcactgagaatgtctcctcggtaggcatccagatgtggtccgcagaggaagcaggagactccgtgacaacaggtagccaatgcccccatgacagtagcgggcctgctcgcctgggccaatgaactcctctggccttgtcggcgacgctatctcgtt

SEQ ID NO: 537790 - DNA, 492 bp, Homo sapiens
  misc_feature (76)..(76): n is a, c, g, or t
  misc_feature (81)..(81): n is a, c, g, or t
gtttggattcggcatttataaaaaaaccccaaatccggaaagggtgaaaattgcttgctggggaagagggctctgnccccnggaaactctcctccccaagagatgccaggagataggagaacctgtctgtcttaagtctgaaatggtactgaagtctccttttctattggtcttgcttattttataaaaatttaacattctaaattttgctagagatgtattttgattactgaaaatttctatataaactgtaaatatattgccatacagtgtttcaaaacgtatttttttataatgagttcaacttaaggtagaaggcttgggctgctagtgtttaattggaaaataccagtagtaaagtcttttaaggagttttcttaaggaggctggctgaatattcctttgttcaaaagaagttttagcatttttcataagaaaacttactctgtctgaccactgttgcttaggaaaccattaaagaattccaatcta

SEQ ID NO: 537791 - DNA, 368 bp, Homo sapiens
  misc_feature (24)..(24): n is a, c, g, or t
  misc_feature (43)..(44): n is a, c, g, or t
  misc_feature (157)..(158): n is a, c, g, or t
  misc_feature (176)..(176): n is a, c, g, or t
  misc_feature (316)..(316): n is a, c, g, or t
  misc_feature (338)..(338): n is a, c, g, or t
  misc_feature (346)..(346): n is a, c, g, or t
tttaccacttgaatgtgtagctcncaatcttgttaaaatgcannttctgattcagtaagtcccgaatatgacccaagagcccgtattattaacaagtttccaggtgacactgatgttgcctggcctacagatcttgacctgagaaagaaggcagtgnngaagggaaacctagtttnagtcccaggttttccactgacgtgctctgtgacataggccaagctgcctcctgagtgcgggttggaggatagaggccttctgtaaggctcttgtgactctaaatctagactctgtggagggccatggatgcctacggtgngagcacaactggctgtttggcnctttctcncatattttcaccttccaaccgt

SEQ ID NO: 537792 - DNA, 128 bp, Homo sapiens
gacgacagcgcgactcccaggtgcatgccaccatgccagttagtttttttgtgtgtttttagtagagacggggtttcaccatgttggccagactggtctccaactcctgacctcaggcagtctgcccg

SEQ ID NO: 537793 - DNA, 113 bp, Homo sapiens
aaggatccccctcaacgactttatacttctaaaacagatcttctttaatttggaggtgagggactactagcttgtattgaaagcagttcgtctcttcttgtgtattaagcatt

SEQ ID NO: 537794 - DNA, 339 bp, Homo sapiens
  misc_feature (209)..(211): n is a, c, g, or t
  misc_feature (243)..(243): n is a, c, g, or t
ttcaataattggtcccctcgggccagaaggggataaaaagagttttattaatgggggtatgaaaaaacaaggtaaaatagaagaaataaggcccttgggtattcatcaggcagtagtatgactaatttgttccaaattaatctatgtatatttcaaataaagtagaagaagaagaattagaatgtttctagcataaaggaaaacccccnnnttattaagtgatgggaatctcaagttacactnattttatctttacaaggcatatgaatgttttaaattgtcatagtacccccaaaatatgtacatgttatgtatcaataaaacacaaaattaaaaaat

SEQ ID NO: 537795 - DNA, 1249 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
  misc_feature (1132)..(1132): n is a, c, g, or t
  misc_feature (1139)..(1139): n is a, c, g, or t
  misc_feature (1144)..(1145): n is a, c, g, or t
  misc_feature (1148)..(1148): n is a, c, g, or t
  misc_feature (1210)..(1210): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaanaaagagnactgnnaanaatagcagttcgtggcacactagtacaaaacataaatactctcaggggggccctgcccaaantcggcctattgggagcttattcacattcatctgcccgtt

SEQ ID NO: 537796 - DNA, 1266 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaaaaaaaaaaaaaaaaaaaaaaaaga

SEQ ID NO: 537797 - DNA, 465 bp, Homo sapiens
  misc_feature (285)..(285): n is a, c, g, or t
actactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgcgatacaactttgaaaaaccttttaacaatctcccatgtatgggctctttttttcccatacgaattgtgtacacccgtgccgcctccacccgggatccccctttaaacagtgtacacctcggaccacantgaaatgtcctctatcctttctctactcaaaattggttctctcctccgacttcatttccgctgcgtccttgcttgtcgctgttttctgcctgaagacgtgtatcataaagagctacatggtatggactatttatttgtaatttgacataaagtttgaagaataacgatctcccaacgttc

SEQ ID NO: 537798 - DNA, 1644 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
  misc_feature (1218)..(1218): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaagagaggggggggcgggtttaataagtgtttctctctcggggggggcgcgaagattttgtgctgcaccgcgttttttttagagaagggggctactattatagggggggtagtatttatagaagggagggaggggacgcgggtgttatataaacaacggctttggtggtggggagaaaacatgatgctgtagtggtgtgaagacatttttgaggggggaaagcaccccacttatttttgggggggggggaagcaaatatgtgtgggagaaacaacttcctacccagagagtatattaacggtccgcgagggggaagtaatataaaaaactttgggagggtgtttaggagtggttgagacaaggtgataattatcgttgggtgaaaaaattttgtgcggaggagaatttattgaa

SEQ ID NO: 537799 - DNA, 1136 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcactcccttgggagactgttgataatgacatagctaaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537800 - DNA, 513 bp, Homo sapiens
  misc_feature (32)..(32): n is a, c, g, or t
tctagaggatcccccaacgcatgtgccgctcncccaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537801 - DNA, 725 bp, Homo sapiens
cacggtggctcacacctgtaatcccagcactttgagaggctgatgtgggtggatcatctgaggtcaggagttcaagaccagcctggccaacatggtgaaactccatctttactaaaaatataaaaattagctgggtgtggtggtgggcacctgtagtcccagctactcaggaagctgaggcaggagaatcacctgaacccgggagccagaggttgcagtgagccctgatagtgccattgcactccagcctgggcaacagagcgagactcagtctcaaaacaaacaaaccaacaaacaaacaacaacaacaaaacccaaaagtccaggtccagtggctcatgcctgtaatctcagcactttgggaggccaagacaggcggatcatctgaggtcaggagttcgagaccagcctggcaacaaggtgaaactcagtctttactaaaaataccaaaatcagccaggtgtggtggtaggcacctgttaatctcagctactccgggaaggctgagacaagagaattcactttgaaccccagggaggaagaggtttgcagttaagccaagagatagttgcccttgggacaccagcctgggtggaccacgagtggaaactcccggtctcccaaaaaaaaaccgttaaaacgtctggcttgctgggaaaggccctttccttaaaggctggactgcaaattccttaaattctaataaaattggcctgttaagggat

SEQ ID NO: 537802 - DNA, 1141 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccaccgccatcaagacgaatgggtgacctggtgaacctattgtgcgcaaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537803 - DNA, 944 bp, Homo sapiens
  misc_feature (32)..(32): n is a, c, g, or t
tctagaggatcccccaacgcatgtgccgctcncccaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggcgaaaagaaacccgggggggggaatgggggcccattgttgttagaaagggggcggccctatggagggggcttttataaaatgtagatgaggaggaggcggcggtataacaaacgattgtgtaggggagaaaagtgaccgagcggatgtcgtaggaacaaaccccacttgtggtggtcagacaactttggcgcataaccgaacgaagtttacagcgcgggggaaatagtagatcaggtaatgtgggcgaacacacttatatcgcgcaaaaagtggttgtgagagatagaatttg

SEQ ID NO: 537804 - DNA, 195 bp, Homo sapiens
ttctagtccagagtgacaggcacaggccacgcgcactcccttacaccctggctgagctgctttcacaccatacggcccgcgaaggggggttgcatggcctgcaaagcctgaaatatttacagagaaggagtgctcacccctgcgctaggggcaaagcccaaagtgtacccttgacgcaagacagaaaaagctact

SEQ ID NO: 537805 - DNA, 416 bp, Homo sapiens
gggatcccactcccttacacagcgaaataaacccctttttaaaataaatcacccagtctcaggtattcctttacagcaacacagacagactaagagagtcataccccaagtatttcttacttattcagtaactgagtaatgtttagaaatggaagaggagacagcaccagagttggtaagaacaagctgagcacaggcaaggagggggctgacaccatgaggctgggaggctcaatctcgggtgtcggcggacaggtgctgaggggctgtgttgtgtgcctggtctggtctttaacactttcacagaaaagaaaaaacatacagagaagcccatgcagtcatgcgctgcagtcaaacagggcaagaagaaagatgtacagggataccaaatccttccaaggtaagaggcacagaaa

SEQ ID NO: 537806 - DNA, 811 bp, Homo sapiens
tcttggtgctggcccccccatcgtgttgtgctctcctgctggcgtgtggcacgctcgctgtttggtcgtgggtgattatatgatgtaccttcccggttggtccccctgttgggggggcccccccacggcgtttggcgccccgctgatatggccgcctgttgttgattgtggaggatgctgttcttcgctggagtcggtgtccccgcgtctcttatttttaaggtgctgtgttgctcccccacctctttgtttttgtgtttatccccaccatgggataattatggccttcggggtttacgcgcgtgtatagccttgtgggggccgccttccgagggggatatatctttgtaggtagtccgcgtcgccccctcttttgtttgttgtttttgggttacccaaagtgttccttatatgtggaaaggcgacattgggttaccaagattccaaaggaaccttaatgtgaatgtttttggtaccaaccttatagaaaaggtaaaggaaacccccaaccaggccatgccactcccttggtgaccagggaagtcaccccacggctatggggaaatagcccgaagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537807 - DNA, 416 bp, Homo sapiens
  misc_feature (70)..(70): n is a, c, g, or t
  misc_feature (77)..(77): n is a, c, g, or t
  misc_feature (79)..(79): n is a, c, g, or t
  misc_feature (83)..(83): n is a, c, g, or t
  misc_feature (85)..(85): n is a, c, g, or t
  misc_feature (92)..(93): n is a, c, g, or t
  misc_feature (98)..(98): n is a, c, g, or t
  misc_feature (132)..(132): n is a, c, g, or t
  misc_feature (134)..(134): n is a, c, g, or t
  misc_feature (149)..(149): n is a, c, g, or t
  misc_feature (153)..(153): n is a, c, g, or t
  misc_feature (161)..(161): n is a, c, g, or t
  misc_feature (274)..(274): n is a, c, g, or t
  misc_feature (287)..(287): n is a, c, g, or t
  misc_feature (294)..(294): n is a, c, g, or t
  misc_feature (298)..(298): n is a, c, g, or t
  misc_feature (323)..(324): n is a, c, g, or t
  misc_feature (326)..(326): n is a, c, g, or t
  misc_feature (328)..(328): n is a, c, g, or t
  misc_feature (332)..(332): n is a, c, g, or t
  misc_feature (335)..(335): n is a, c, g, or t
  misc_feature (371)..(371): n is a, c, g, or t
  misc_feature (388)..(388): n is a, c, g, or t
  misc_feature (401)..(401): n is a, c, g, or t
ctttttcccccccggttggggggaatgggtcttaacaagttgtgtacctttggggtctgggcccgggttntagcccnanggcngnggtgttnnctggntgcaggggtcccaggaatttccccccaaaaagtncnttttttgggctttcnggcnggggcccngccggggccccccccttttttttttgaccagctttttgggggtggcacccggggggtggaaaaagggggccccctttttttgcttggtgggccccggggcccttccgttggcntttccccagaagncctttgnccgnttggggggttaacccccccctgtcnntntntttnttnttttgggggggggggggggccctgttttttggccgnccccctgtccccccccntggtttaactccntgttcccccccgcca

SEQ ID NO: 537808 - DNA, 884 bp, Homo sapiens
  misc_feature (372)..(372): n is a, c, g, or t
atcaagctggccatgtcaccaaggtcctgggacaggatcggttctcagggtacgagtgcacgcaggtgcgcgtggaattcatggacgacacgagccgaatccatcatccgcaatgtaaaaggccccgttgcgcgagttggctgacgttgctcatcccgtttgtggagatcagagcgagagagcctcggaggtatagcagctagacgcttggcatgcctcgctggcgtcttgtgattgtctgggttcagaccacattggtgccagatagggcaattggtcctagtcaccaatctagctccatttattttttagtactcgccatcatcgttatacctgaaggaatgacttccccttttacaagtaacacgtggntattgagtgcttatcacagttgtacaatgaacagagacataacaataacaagcaaaggggagcggacgcagtgtcccgaaaagcataatctcgctgaggaaggcgtgtcccacagaagatctataaacgagttataacgcacgggggaataacttatttgttgcgcaaatggggagaggcgccactatacctaggaggacgactcgactcattgtgaataatggcccataaaagccaacacgtgagcctgctcgtgcggatatgtaagcacaacgaggtgatcgggtgcacccgcgggtgcaaaacacagcggaggcaaatagccattgtgaggagaaaactcaattgtgccgtggaacagggagacccacctgtatttgcaatctgccacgggagcgttcgttggccccgctctacttccttggggtacacaaatattttagcgcataaccaaggagccttgtttatccaaagggccgtacaagacgggggagcacatcattatttaacca

SEQ ID NO: 537809 - DNA, 574 bp, Homo sapiens
  misc_feature (32)..(32): n is a, c, g, or t
  misc_feature (563)..(563): n is a, c, g, or t
tctagaggatcccccaacgcatgtgccgctcncccaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaacaaacaaaacaaacaaaaaaaacacaaacaaanaaaacaaacaa

SEQ ID NO: 537810 - DNA, 569 bp, Homo sapiens
  misc_feature (32)..(32): n is a, c, g, or t
tctagaggatcccccaacgcatgtgccgctcncccaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaaaaaaacaacaaaaaaaaaaaaaaaaaaaaaaaaaga

SEQ ID NO: 537811 - DNA, 366 bp, Homo sapiens
  misc_feature (104)..(104): n is a, c, g, or t
  misc_feature (134)..(134): n is a, c, g, or t
  misc_feature (170)..(170): n is a, c, g, or t
  misc_feature (208)..(208): n is a, c, g, or t
  misc_feature (225)..(225): n is a, c, g, or t
  misc_feature (256)..(256): n is a, c, g, or t
  misc_feature (276)..(276): n is a, c, g, or t
ctatcaactgaggcgattccgatagagactggcacaagctttgggctaaggacacccgcccccaccctcatctagaaacaatctctctcgccagacttgatggntcacgcctgtaatcccagcattttgggagnccgagtcgggcggatcacaaggtcaagagatggagnccatcctggccaacatggtgaaaccccatctctactanaaatacaaaaattaacnggggcgtggtagcacacacctgtagtcccanctacttaggaggttgaggcnggagagtcgcttgaaccagggagttggaggttgcggtgagtggagatcacaccattgccctgcagcctaagcaacagagcaagattctgt

SEQ ID NO: 537812 - DNA, 253 bp, Homo sapiens
gtgtttgccttacatgtggtcactataaaggtgaataagtagttgcaaaagcttaattgagtgtgtaaaacacctacacatttgtgtaggtgttttttactgcccaaaaatggatagttgttgattaatgtatgctttatattaatatctcctataaagtattaattaattttaaaataacgacaatatttagtatattaccataaaatatatcactatatatgcgaaaaaccttgccaatatgggtcgacgc

SEQ ID NO: 537813 - DNA, 298 bp, Homo sapiens
ttgtctcataagccaagggaagaccaagttccattgacaggaaggtgtactacgttataatctattctctcaggtcagagaagacggatgcgacagagtaaagaacattggtgacgcttaagtaaattgctttaagttggatgttggaagcaatatgcaacatttgagggaactaaaggatggtgaaaaactataatcaaaatttattctttccagaagtttggtagttgaaaggagagaggtggacggtctctcaaaaggcacattagaaaggtgaaagtggttcagactggtcctg

SEQ ID NO: 537814 - DNA, 878 bp, Homo sapiens
  misc_feature (73)..(73): n is a, c, g, or t
  misc_feature (113)..(113): n is a, c, g, or t
  misc_feature (190)..(190): n is a, c, g, or t
  misc_feature (199)..(199): n is a, c, g, or t
  misc_feature (878)..(878): n is a, c, g, or t
cttatccctgtaacacatgtgccataatatacaaacttcaaatgtagctctcttgaatattcactggatcatnaggcataggcatgatgcgtgacgtgcatctctcatccacngttggccaggactggtgtccagattggcaatgcctgctgagagcatctactgcctgagaacacggcatccccaaagncccccccgnaatttgggccaaaatatggcaaaattcaggccgcacaaacagcggggagtggggaaagaccaaataaagaagggaaacacgcctaaggctttcatacagcacgcacaggacaggggcgggaaacacaggcgaggaaacgcaggcaaactattcgggggaatctccgtttcccaccctatatgtatgttcccgaaaaaaagaccaaagacagtcctctgtattatttctccatttttctgcaccaaacagcggcttctagacaacatggagaaaccccatgggacgggtgggaccgacgggccccattttagggggggcgccccataaacaattgacgcgtcccacaaacaccaggtattgtgccccaccccggaggaggtgcccctgcatcggctttcatgataagagaaacattttcggggaaaaatcccacaatctaagacttccaaattagggaactgcaacacgttttcccgcacctggtgcaacccgttaacgcgtcaccagaacttccttttcgcgagcccctgacaggacaagcctcaagttcaaccagaggcaaaagggaaagaagcactgtccttgaccctaaagataaaccttaatgaccccccggaaagggggacaaaccgttaaacaaacccaaattttgggggccaaaggggaaagcaaattccan

SEQ ID NO: 537815 - DNA, 716 bp, Homo sapiens
  misc_feature (173)..(173): n is a, c, g, or t
  misc_feature (194)..(194): n is a, c, g, or t
  misc_feature (261)..(261): n is a, c, g, or t
  misc_feature (479)..(479): n is a, c, g, or t
  misc_feature (505)..(506): n is a, c, g, or t
  misc_feature (519)..(520): n is a, c, g, or t
  misc_feature (539)..(539): n is a, c, g, or t
  misc_feature (545)..(546): n is a, c, g, or t
  misc_feature (591)..(591): n is a, c, g, or t
  misc_feature (602)..(602): n is a, c, g, or t
  misc_feature (641)..(642): n is a, c, g, or t
  misc_feature (646)..(646): n is a, c, g, or t
  misc_feature (649)..(649): n is a, c, g, or t
  misc_feature (653)..(653): n is a, c, g, or t
  misc_feature (655)..(655): n is a, c, g, or t
  misc_feature (673)..(673): n is a, c, g, or t
  misc_feature (677)..(677): n is a, c, g, or t
  misc_feature (679)..(679): n is a, c, g, or t
  misc_feature (685)..(686): n is a, c, g, or t
gtcttccgtgggcggcggcttcgcgggcttggagttcgcgcggcgcaggagtcggagccgcgggctcggacctgggggccccccggacgtggacgggggcggcggcggggccccggactccgtcggcgcacatccccgtcccagcgcagagagccaccccaggaaaagccggntggacgaggtcatggctgcgntgccttacaagcctgtccaccagccctctccttctgggggcccagttgcagcttcagcccagagccnggcctggagccctggaatggaggccctggtgcgagccccaggcagctacagcagcagacagcaacagtggagactggggatgggacctggccagtgaccagtcctctccgtccagcccgtcaccaccacactgcaccccaccgaggcagcccacatttcatgtaatggggagcccaacctgagaaaaaggaagagcccaggccacagtgtcatgtccnagtgtctgtggaagagctgcgggaanngtgctgagcaggnngtcggcgatgcagagacanaatcgnntggtgcacctgggaggcaggcagagctgatcagagtgatggtgangaggattctantacacagagctggatgtaaggtgtggacacgctgaccgnngggntgncaancntgactccagtgtccccanggcncnatgcgnntgcttccccgcggaagttgcagagtggtgg

SEQ ID NO: 537816 - DNA, 650 bp, Homo sapiens
gtattttttagacaaagatggactggctatatagtattagtaatgaagcatctttgcttcactaatttctttaggtggagacgtacatttccttgaaaatttgagagactcaataaaatccatagagccagaggcaaggctaccctaggcctggatccagatgtctgttactaaatagatttttttttttttgcattgtaaaaggaatagaagactttctcagttctcatttttttttccatgttaaaatcacttcatgctgtttcactgaatacaccctgacttttgagtcttgtgaaccattttcagcattttttctttagttgtaaagaatctttctctagcttctgttgacatggctaccaaaccttcactctggagcagcttctttcatgtgagaactgttcttcactgaatgaagctcattgttcagatacctttgttttgctgctgaggtgttttccctaccttggtttggtatttccttctctttagatgcctctgtttcacagctgtctttccaagccttcagggacttgtggagagagggagggaaggtgacttgtggatcttaaatgatgttcatctaatcatttaacttaaccaaatcccctttagttaaataaatggtgttctattaaaaaaaaaaa

SEQ ID NO: 537817 - DNA, 284 bp, Homo sapiens
  misc_feature (104)..(104): n is a, c, g, or t
  misc_feature (182)..(182): n is a, c, g, or t
  misc_feature (212)..(212): n is a, c, g, or t
ccctccctgttttacactggggacagcagaattttctccccgtcttccccttcctgccattttccctcccttgaaaggttgacaatggacaaccttggggcagntgagccctggccgcctcctggctggaaccatgagaaggaaggtcaggacttcccacagtgtccctgttgaaaaccgcngttaggaaaataaaagtttttttcatgggnaaaatttttttctgtgaaaaactaaaaaatagggtcccccgctttaataaaagaatcttttgaaaaaaaaaa

SEQ ID NO: 537818 - DNA, 512 bp, Homo sapiens
  misc_feature (173)..(173): n is a, c, g, or t
  misc_feature (194)..(194): n is a, c, g, or t
  misc_feature (261)..(261): n is a, c, g, or t
  misc_feature (275)..(275): n is a, c, g, or t
  misc_feature (301)..(302): n is a, c, g, or t
  misc_feature (315)..(316): n is a, c, g, or t
  misc_feature (335)..(335): n is a, c, g, or t
  misc_feature (341)..(342): n is a, c, g, or t
  misc_feature (387)..(387): n is a, c, g, or t
  misc_feature (398)..(398): n is a, c, g, or t
  misc_feature (437)..(438): n is a, c, g, or t
  misc_feature (442)..(442): n is a, c, g, or t
  misc_feature (445)..(445): n is a, c, g, or t
  misc_feature (449)..(449): n is a, c, g, or t
  misc_feature (451)..(451): n is a, c, g, or t
  misc_feature (469)..(469): n is a, c, g, or t
  misc_feature (473)..(473): n is a, c, g, or t
  misc_feature (475)..(475): n is a, c, g, or t
  misc_feature (481)..(482): n is a, c, g, or t
gtcttccgtgggcggcggcttcgcgggcttggagttcgcgcggcgcaggagtcggagccgcgggctcggacctgggggccccccggacgtggacgggggcggcggcggggccccggactccgtcggcgcacatccccgtcccagcgcagagagccaccccaggaaaagccggntggacgaggtcatggctgcgntgccttacaagcctgtccaccagccctctccttctgggggcccagttgcagcttcagcccagagccnggccgtcatgtccnagtgtctgtggaagagctgcgggaanngtgctgagcaggnngtcggcgatgcagagacanaatcgnntggtgcacctgggaggcaggcagagctgatcagagtgatggtgangaggattctantacacagagctggatgtaaggtgtggacacgctgaccgnngggntgncaancntgactccagtgtccccanggcncnatgcgnntgcttccccgcggaagttgcagagtggtgg

SEQ ID NO: 537819 - DNA, 153 bp, Homo sapiens
gccctcaaggatttccaagccgatgggggtgtgtgactccttgggagggggaatccaggagcccaaacggggtggccggcaggcaggcggaaaggaggcgcgcaggtagaaggttactacgaaattgcttccatcaaacctgtggctgttgta

SEQ ID NO: 537820 - DNA, 167 bp, Homo sapiens
ttaacgacgttgatctggcggggtatctgttcaacgtgttttcggttggctggatcttggaggcattgttgagtgatcttcgcaactttgctgcccacacggctcaggccaatctcggacgggcggtcgttgaactcgttggctgtctgttggctactggatttatt

SEQ ID NO: 537821 - DNA, 545 bp, Homo sapiens
tgcccaggtgagtgcagtggcgtaatcatagctcatatgcagtctggaactgctggacttaagctatcttcccatcttagcctcttgagtagctcggactacaggtgagcgacagcactcccagctgttatctattttatatttagtagagagagtcttgccatgttgcctggattcaaggaatcctctctccttaatctcccaaagttgggattacaggcgtcagctcattgtgcttggagaaaagtctatatattattttatatcgtcttagagatttctatggctatttaatacagtatgtaagtctgctcactagtattggaatacgcatgatggggcgtacttcctagtatacatgggggggagattattagtagtatataaaaaagactggggtttttctatatataatttggtaataggatatttgatgttattaagagtaagaagatatacaattgttatcgagaaacagaaggatatattaaggtaaaataactgggggtacttcaaagcattgtgtatgtattagcaatcttgag

SEQ ID NO: 537822 - DNA, 253 bp, Homo sapiens
tgcaccggtgtgtggttcattatgtagaaaaagaccttgcttgtgctgtccaggctgctcttgacctcctggaatcaagcagtccttacactttggcctcccggagtgctgggattacaggtgtgagacaccatgactggccacttcacactcttaagtaatatatctgaacaggtgcagcggatcacgcttgatatcccggtgcaggtcccggtccaggtatgggactaccggtgcaggtatggggagatac

SEQ ID NO: 537823 - DNA, 158 bp, Homo sapiens
gtccaacatcgggcgccgtgtgtagaggacatggtaaataataatctgaagtacgctgatacgagatctactgtggaaaaacaaaggatatcgtcaaagggctgaggtctgtgcagactttggcagacgaatcaaaacaagaagctctgaagaatgac

SEQ ID NO: 537824 - DNA, 354 bp, Homo sapiens
gaccgcgtcgtctgctctaatattattaactttgatggtttttcagtaaggcactaaatgccattgccattcttagaatctgtccaccctagatacataaattctggttaataaagcatcaactcaaattttaataataataataataataatacttttaccccttccataacagcaccatctattaagatcacgttctcagacattatcgaaagacaaaatgacctgtaatgtctcaatagaaaatttaatatatcacgtttaattaaatatctatgacacttccggaaacacagcatgcacaatgtaaacaaataaaataccggtgttgccaaaacacgaaataaattgata

SEQ ID NO: 537825 - DNA, 216 bp, Homo sapiens
  misc_feature (17)..(17): n is a, c, g, or t
  misc_feature (81)..(81): n is a, c, g, or t
cgtaccggattagatangacggtgaaaaggggccagaggtcttctggcttaaagggacacaatggattgcaaggtctgctngtatcgctggtcaccatggtgatcaaggtgctcctgtgctccgtgggtcctgctggtcctagtgggccctgcgtggtccttcttggccctgcgtgtgaaaacgatggtcgcacgtggacatccgtggggtggatc

SEQ ID NO: 537826 - DNA, 80 bp, Homo sapiens
ccgcctactactactactactgctcgaattcaagcttctaacgatgtacggggacatgtaaattgatcacgggatacaac

SEQ ID NO: 537827 - DNA, 873 bp, Homo sapiens
gccaaggcaggggttccggggccctggggctgaatgtggcgccgaccctatgcagtgtctggcccctctgctgcacagaagaaaagtggccttgtgaggtgcagagtgtgcaggctatgaccagggccctgtggcaagtcagtgccaactcactaggggagggccacgctgtgggctgtgcagtggtcagtgggcttcagtgtgtgctctgtgggtgacccacgagaagccatcttgagaacagtgtccactggtcaagccagtgccaccctataaaaggctggatgtgtgggccaatgggcatgagccgtccctgaggtggcaccgatggccagagctgaggcacaagctagaggccctggactagtgcttgactcccggcagacacagagcgctgaccttggcttgccgagccccgcgcgttcctaggactagcagggagttgccttgccagaaggggcaccacatgggccaccggtcctgcaagctttctggggcaggccgggccttaccttggctattgagggcaaggggggtgcgggctacaggtggacggcaagaaggacaccaagtgcaggagggcaacacggacagtgacgcggacggaacgcccgacaacgaccaggcagcgcagataaacccgtgggccgagaacaaagagcaagaagccacaggaagacaaacaaagaagaccacacagaggaaagacacaagacatacactggcaccaaaacaaacgcgagtatgcagaaataggagcaacaagcactgagtgcacgagagggcgtcgaaaagcacgaaggaacacaactcgagaacaagtagccacacatagggaaagcagcacgcccacacacaaaaggcacagcgacg

SEQ ID NO: 537828 - DNA, 149 bp, Homo sapiens
  misc_feature (85)..(85): n is a, c, g, or t
aaactaggaaaactgtgtgtttaacaccagtctacaacacaagttgaaacacctgatctgtggatcatgataacacttcaccatnttcagaacaccctcagttactaatcacttaccctgatgactcagactcagagaagaactctgat

SEQ ID NO: 537829 - DNA, 805 bp, Homo sapiens
tcccccccctgttcgccaccgaggtcgccgcgtaaaatttctccgccgcaaaccccgccgcgatgcgctacgtcgcctcctacctgctggtctgccctagggggcaacttctccttcccccagcgccaaggacttcaagaagactctttggacagcgtggggtctcgaggcggacgacgaccggcctcaacagggttactcagtgagctgaattggaaaaacctttgaagacgctctttcgcccagggtatgggcaagctttgccagtgttccctgctgtgggtgggggcttgatacccgctctctcttgcttgccccagggcttcttgaaggcccctgtgcttgcttggttctctcgcccctgtgcttgcacgcaaatggaagaaagaaaagattgaaaacgaaggagggagtctctgaaaaatgctcaggattgatgcacatgtggagatttgggcggccctttgtggactaaaattctcctgttgcctcccctgtgcgaaaatttaaaacggccttttttacaccactttcaaaaaacacaaaaaaacaacacaaaaaaaaaaaaaaacactctggagggcgacaatctatatatgtgccgcgggagcgcgccgagaaacaaaagagagcgtttacactgaaaacacgggcgcgcccaatgtgggcgcaacaacaaaccagtgttctcccaggaaccacccaacgcttctttgtttgtgtcccaaggggtgggcagaaaaactcgagcggggactccccaaaagtaggagcacgcagaataaaaatccaaaacaacgcaggt

SEQ ID NO: 537830 - DNA, 196 bp, Homo sapiens
  misc_feature (53)..(54): n is a, c, g, or t
gatgcaaggcagggtgtgattgcaccagcagtctccgggttgacttgtggggnntacactgggactcatcgagataccgacgccagaaacgggagctctgtacgcacaggaaccttccacggctgctacatgtactattttcagtatctgagcaaaacctactgcgtggatgcaactagagagacaaatcgccggg

SEQ ID NO: 537831 - DNA, 494 bp, Homo sapiens
ttcaactgcggttactgagacaaaggacatcatatattataaaaggtcaggccgggtgtggtggctcacgcctgtaatctcagcactctgggaggccaaggtgggcagatcacgaggtcaggagattgggaaccatcctggcaacacagtgaaaccccatcctcactaaaaaaacaaaaaaaaaaaacaaaaaaatttagccaggcatggcggcaggcacttatagccccagttactcaggaagctgaggcaggaaattggtgtgaccttgggaggcagaccttgcagtgagctgagataacgccattgcactccagcctgggcacaattgagcactgagtgaacgagactccgtctgcaatcccggcacctcggaaggcagaggttagagaataattcgcggtaagaagctggagaccagcccggccaacacggcaaaaccccgtctccaccaaaaaaaaacggaaacccagtcaggcgttgagaggtgcccc

SEQ ID NO: 537832 - DNA, 1075 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccagcccgcattcagccacctgcccagccgccgggcggagggagcaggctcaggcaccgagactgctgagccactggccgcccgggaagaaggctgcgttctgagtcggtcaccgaatatgtccccccttggacgggagtagcgcaacgatgtgcaggccagctcaggaagtaacgctgggagcttctagaaggtggagcgggatccaggaccgtgggagcttttccggagaagcctacctctcctgtgttgcagctgatgggagcaagacgctcttctcccatcagtgcctccttgcctgttttctttcatacctgaattcccatctttaagctgtggatcctgatgggagcaagactggcgcatcttgctcccatcagagacaaacaaacttttgtttcctaggttgagggtctaattgatac

SEQ ID NO: 537833 - DNA, 301 bp, Homo sapiens
ttatgtatcgtgtgtagtagagatcagtgggtcagaaactactcctgaccactttgtttccttttgagccgcgtcattaggaggcaatctgtatacaactagcacaggtctcctgctgttccactggctcacccacatgattagcagagtgcaccgaaaaaatctaaaacttctattatagaatcatgctgagcacaatgatcagagaggttgtgactttgcaaaccctattagatgcagggggcctggagactggcgttctccaaagggctcccaacgccatctctcctctgatttctgt

SEQ ID NO: 537834 - DNA, 165 bp, Homo sapiens
ctgcggatcggattacgatccgcagcagcggcgctttccactgttccatctagaggtgagccatgatcgaggtcctacgctttccaacattcaggaacctgttcgctgcgcaggttatcgcgctgatcggcacgggcttggctaccgtggcgctctctcttttgg

SEQ ID NO: 537835 - DNA, 834 bp, Homo sapiens
  misc_feature (74)..(74): n is a, c, g, or t
  misc_feature (77)..(79): n is a, c, g, or t
  misc_feature (83)..(83): n is a, c, g, or t
  misc_feature (99)..(101): n is a, c, g, or t
gggaacatgttatcacactcatgaatctgctaacctcaacgtgggcattttccttcacgatatccataatccanacnnntctnacttggaaaacccctnnnatgcaatggagtgtgcattacatttggaaaaaaatgtgaatcagtcactactggaactgcacaaactggccactgacaaaaatgacccccatttgtgtgacttcatgagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttctcagatatcagaaccagactgtatgactggagagcggctgatgcatgagtgtcatacattggaaaaatgtgatcagtactactggactgcacaactggcactgcaaaatgccccatttgtgtactcattagcaatacctattggcggtaagcatcagattggccacgtccacct

SEQ ID NO: 537836 - DNA, 272 bp, Homo sapiens
agtctgacacttgagcagtcgaggctgatgggatcgtctaaagttgacctggaggaatatatctttggacaatgaccgcctgttacacagttcattgtgtgagataagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaa

SEQ ID NO: 537837 - DNA, 1129 bp, Homo sapiens
gcagcacaagagcaagttccgagtggtggtggaagaggtgcaggttgtagagttgaaagttacatggattaccaatgagtttctgtccagggggcacggacgagctgtcagacccgccacctctctgtacatacacccgatggaaaacctaggacagtggtgcaagcgtctctggatgctttgacgcatgctacagctggcagcattggcggagcgctggtctggtatcgtcttcccagcgcaaggtcagagccatgccagagattgcctggtgcacatgtccagcaacatacaactagcgccacaggggcgagggcgtctatgcgccacagaacggtgacagcgcgctgttcgaagacagcatggtatgtcgcggactcatagtcatcggctccccgagacgacccagtggttacccgggaccagttccatggcaagagccatgacacagaagggggaatccaagaagcacgcagcgaagcgggagtctgcacagaacctgaggagacgcccgatggctctgacagtccagtggagatgcagagacgagggtgcagaggagccccacgaggcaggagaggagatgcgcaccaattccgtgataaaaagaaggcagagatgacaggctgcaatcggaagagacaagacgcagatgatgagcgctgatgatgaacacggacgcaacagtacggtgacctactactgacaaaatcacaacttgctcccagcagcggaagcgacaagagccgacaacaggagcatccagttgacaatcaaggactaaagagcgaaaaaaggagcagaagaatcaaataaccgaaaatcgaaagcggagaacggaggccatcgaggtgtacccagaacaaccaggcgagcacgatggagaagcagagcgcgacgacccagcgaccagggagcaaaccacggaaacagaagacaaacagaacacacgagaaacgagacaaaaacaccaagatgcaacagaagccgaggacaaagaaaaaaaacgagaagggaaacaacagcagacaacaaaaacacagacagccaagagaaaagaaaaaagaagagaacaaaaaaacaaaagcatacaccaaccgacagcaggaagcaaaaccaccaacccgca

SEQ ID NO: 537838 - DNA, 496 bp, Homo sapiens
gcggccgcctactactactactactgctcgaattcaagcttctaacgatgtacggggacatgttggggtttcctttaccttttctataagttgtaccaaaacatccacttaagttctttgatttgtaccattccttcaaataaagaaatttggtacccaaaaaaaaaaaaaaaaaaacaaaaaaaaaaaaaaaaaaaaaaaaaaaaaaaagaacagatagaacatgcatgaacggggggggggggcggacaaaaaaataatcaagacgggggaggacgaaagtaaagaggacgacccgacgaagtagaaacaaaaggggagcacaaaagaagagcgaaaaataaaacgcacagagccgcggacgcacaaaacacacaagcgagagaagaaaaaaaaacagaaagagggacacatacgcggagaagacgacaccaccaacggggggacggaaaacagaagaaaaaaaaaggcaaaaaacaaaacaacgcaccggcaa

SEQ ID NO: 537839 - DNA, 349 bp, Homo sapiens
gacgcagatcgttcgactgagcagcatggagaaatcctgtttctaccagaaatacgaaattagtcgggcgtggtggtgcacgcctgtagtcccagctacttgggaggctgatgcaggagaatcacttgaacctggaggcagagggtgcagtgagccaagatcgcgccactgcacttcagcctgggcaacaagagcgaaactccatctcaaaaaaaaaaaaaaaaagaagggagagggcaggggcagacttgaaagtttatctcaaaaacccttctactgagtactattgggccacggatcttataacaaaacagaattgtcatgacttttcagggcatatcataatcta

SEQ ID NO: 537840 - DNA, 313 bp, Homo sapiens
cagcttataagtacgaaaatatcctctctatctgtatccaagccaaagctattttaaaaacatcaataaaaaaatctaagttactatactatgcattatactttgtatagccatggacattcatgcacatgtcatcaaacttggatcccatatttacatccaatagatggccaaacttttacacaaaaacgatcaatttattagaaaactaaaaataatgtagaatagctagcttgttaaaacagtccattagccttacctcttcagcagatacaaataggctggaatcatttacgtttcttttcttttttct

SEQ ID NO: 537841 - DNA, 87 bp, Homo sapiens
  misc_feature (52)..(52): n is a, c, g, or t
  misc_feature (75)..(75): n is a, c, g, or t
atgccccctgtagtcccagcaaccagggaggcctaggtgggaggcttgcttnagtccagggaagtcgaggctgcngtgagccctgat

SEQ ID NO: 537842 - DNA, 346 bp, Homo sapiens
acaaccaatggatttcctggagactatatcccatactgctctctctgacgaagttattctgccagtgttatggtagatggaaaacgcaggtgaatctgggcttatgggatacagctggacgagaagattctgacagattacgccccctatcctatccgcccacagatgtgtacttcgtttgcttgactcttgtgaagtcctcgccttcttcggaaaatgtccgtgcaatacgtggcatcctgagtgtgcggcagcactgtcccaacactcccatcatcctagtagggaactaaactctgatcttaggggatgataaagacacgatcgagaaactgaaggagaagaa

SEQ ID NO: 537843 - DNA, 484 bp, Homo sapiens
atacgctaggaagaattcatctggcccgctggaaatgacccagcatctgacggattgcctgggccagctgtatcgctacgggctgggcgtgagctatgtcgaacgcgaacacggtggcgagattccgtacaccatctacgtgatggaggacgcgcgctcgatgggcgcgcaactgcgcgtgttccgtggtgcggtgtggttctaccttgtgcagcgccggtgtggttttgctggtattgcaagccttcattctgcaatggagcctgcgtacgctgcggcgggtcatcaacgagttgacgaaggtgcagcgcggcgagatccagcgcatgagcgagcagcatccgcgcgaaactggagccgatgaccggaagcatcaatgccttcatcgagagcgaacgcgacaacctggagcgtcagcgcactaccgctgtgcgatcttgcgcattgcctcaagacgccccatcgccgtcttgcgcacccacac

SEQ ID NO: 537844 - DNA, 202 bp, Homo sapiens
gacgcagcatgtcagactgtagaatatgatatcagcaccttgctgactctcttttcggactcagcccgcctgcaccaggtgaaatagacagccatgtgggcacacaaagcctgttgctggtctcttcacacggactcgagtgaaaatacacacgcacacacacacacgaatggacatttaccccactcctgcttttgtgcta

SEQ ID NO: 537845 - DNA, 394 bp, Homo sapiens
  misc_feature (31)..(31): n is a, c, g, or t
  misc_feature (76)..(76): n is a, c, g, or t
  misc_feature (184)..(184): n is a, c, g, or t
  misc_feature (213)..(213): n is a, c, g, or t
  misc_feature (235)..(235): n is a, c, g, or t
  misc_feature (281)..(282): n is a, c, g, or t
  misc_feature (337)..(337): n is a, c, g, or t
  misc_feature (368)..(368): n is a, c, g, or t
  misc_feature (385)..(385): n is a, c, g, or t
  misc_feature (394)..(394): n is a, c, g, or t
tcccccctaatctggcttttaatgttgaaanaacccaccccctgcccaaccaaaagggtcttcccttcccaagccnactcaagaacaattttaacttctctcctcccccatgttcccctttttttctctaaaatcccctgacatcaagccctccccaactcctaagagggactacccatgagantggggttctgaaggcctccctatgggganagttccgttcttgaagtgtcantgttggggaatatctgtgcctatgaggcccatctcaggtttggggnncccccagtccctatgatcagtgttggagtacccccctgggagagcctagtttctntgagcccaggccctcttttaactacctttgnataggtgttatccctgnatttatggn

SEQ ID NO: 537846 - DNA, 221 bp, Homo sapiens
tcccgttcttccctctattctttctcttccacttgtctctttccattactgactatgtatttaattcctctttcttcctaaatcttattcattagtcccattctccacatatttactggctctattcttccccattacaacactccctgttaaattccctcttccctgttacacaccgattgtccccacatctttggacacccccagaatcccaggctctc

SEQ ID NO: 537847 - DNA, 959 bp, Homo sapiens
ggggacacttggtcctattcactgtgtggagattagtcctgatggagaactctagtggccagtggttcagagagatggaacatatgagactaatggcgaaactgtggtaggaaaaatcgtatggcttaggaaatgtgtgctatcctgaagaagatagtggtgagctggtaagaagcgaagggattggttgttccagagacaacagaagaggagctagggaagaaattgttccagagaattcccgattgcctcttgccttcagctcctgatgttaaggctgagcgtcaatcatatgttgcagttagtatacaactgactaaaacaagcaagcagagaaaagcatcagccttccagagttactgtctgcttaaggcagaaacagcagtcactactgaggaacctgagttagctccagtgctggaacaactaactaacttggtgtcacctgtaagtgaaaactcaagtgtcagatgaagggaggtggagttatcgctcttatagtacagtggcctgttatctcattaatgaatatatacaagccaatatccaatgtctattattacatttagggttcttgtagctgtttatgttaatatggcgaagaagactgtattggctgatttgggctgatcttgaagcagaatgctgtatttcgagttcagtcgtgagaaacggatatgctagagtagctggtttgagttctcgctcatgtccccgggtcctgaaacttattggtttaggttgctaataaatggctttaatctccaaaagacgaagtggggtttttgcgggcgggaagggcaaaaggccaggctgggatcagagcggttggtagcgggttagtggcaccaggaggaagaaagcggacgctcatggcgagagaagtgggccaaggaggacataaaaacgggtggagacaacaatgtaagggagaaaagggaaaacaatatctgctggcg

SEQ ID NO: 537848 - DNA, 240 bp, Homo sapiens
tggtaccggcacgagcgcccaagtgaagcaactgtggaatgtaagccctctctcggcaagaagaagtggaaacagccaggcgtggtggctcacacctgtaatcccagcactttgggaggccaaggcaggcggatcgtgaggtcaggagttcgagaccagcctggcaatatggagtaacccgtctctacgaaaaatacaaaaactggccgggagtgggggcgcacgcctgtaatcccagct

SEQ ID NO: 537849 - DNA, 337 bp, Homo sapiens
cacctctggcgtctctctctccggctttcaccacgggatgcacctgctcctctctctctctctctctcccttgcttatgcgtgcaatgcgacctgctctccctttgccttccgccgatgcgtaaagagctccctgtaggcctccccagtaagcagatgccacctagcttcctgtacgagcgtgcagaaccctagagccaattaaacctcttttctttataaactacccagcctcaggtatgtctttacagcaatgtgaaaatggcctaatagcaccacaacgctcacctaacgctcacattttcccggcaccaccgtaggtgttatcattcaattta

SEQ ID NO: 537850 - DNA, 845 bp, Homo sapiens
ttatattttatgcaattttaagtatggttccattattaacgtttaaaacaaaaggatttccagttagaaaacaaggcacggaccacgataattcgctttgtattgtacacagttatacaaaatattctaaatacacatttggggttcaagatgatggcgaaataagattaacgggacagtacataaggaaagaaaatattttaggtatatttagaagcaatagaagaggtctatacaaaacaagcgaatgggaataaaatttttcattttgaaagtatggcgaacaggcgccacaggttggtaacaaaaaggtcttggcacagttcctcacgagggccattaatagctaaagcaagaaaggatttttgaaaaaatagtggttcacacaaggttaccacggggtacttacgtgttgcacagttggtcccaaaataagatcttacttgggagtccacagcaaaaacctagagggaaatataaccaagacaatttgaaacatccattctggtgtcaaaaaactcatggggcctttattttactccgttcggaaacggtcacacacacggtgtttctaccaaaatattggccgggcacaattatacaaggggatggatatctccgaaaagacacccggtctagtaccagaccggtcaggggaaacccccacaggggtgggcttacaagggacgaagggcctccagtgggaaggaacctgtctaaccaatgacattcaagagggcccatcggagaactcaacccggtataacacgtgaacggggcagagggatggctggacaaggggaacaggacaaggaatagacggaggagagtgacacaacacaggc

SEQ ID NO: 537851 - DNA, 259 bp, Homo sapiens
agctgcattctgtagagtcgagtctagagaatcccctgcgtatcatgtcatatcaacgtctagcgactggtagccaggagaatagttagactcggttgtgactagcctgcacgtctgagatgggacgtataattttacatcggtctcgattgcaagacctcgggggttcaagcaagcctcccacctcagcctcctgagtagctgggacaataggcatgagccaccattcctggctaatttttaattttttttctagaga

SEQ ID NO: 537852 - DNA, 103 bp, Homo sapiens
tccacgctggaaccctgctacgtggcgagggggttgagaagaaggtggatgccagggaggaggaaagcatccgaaacagttgccgcatccgaagcagttgccg

SEQ ID NO: 537853 - DNA, 363 bp, Homo sapiens
gaggatccctgtccaaggctgagtgcagtgacgtgatctcggttcactgcagcctccgcctcccgggttcaggcaattctcctgcttcagcctcccaggtggctgggactgcaggcatgtgccaccacgcctggctaattttttgtatttttagtagagacagggtttcaccacgttggccaggctggccaggctggtctcgaacttctgaattcaggtgatccacccatctcagcctcccaaagccctggagttttttgtcgttgttgttattgttttcagacagggtcttgctctgttgctcaggctggagtgcagtggtgcaaacacagctcaacataactcactgcagcctcaaactct

SEQ ID NO: 537854 - DNA, 1339 bp, Homo sapiens
  misc_feature (407)..(407): n is a, c, g, or t
  misc_feature (454)..(454): n is a, c, g, or t
  misc_feature (470)..(470): n is a, c, g, or t
gtaccgcggattgtgtccgcactgttttacaccagtcccctcactgtggctgagtgtgcgggcacagatgataggtcacagcaacctgattcagtccttactgtggctgagtacgtcagggcagatgacaggccaccacaacctgattcagtcctcactgtggctgtgtgtgggggggcagatgacatgccaccacaatttgattcagtcctcactgcggctgagtgtgtgtgggcgcaggtgacaggccaccacaacctgaatcaggattcagttgggctaccagccagtgccataaggaaaaccattctgggactcttgagaggggcaaagaataatttgcatgtgagagaaacgttaatagtttgtggccagaggacaaactgtggtttattaaagactgctgnaggttcctactatgcttctcatcaagaggtggaatctaatcaccttncccccttgaatcatgnctggtctcagtgatgagtacaactggacagtgtggcaggagagatgctctgggacttctgagggatgatcatgagagaccttacagcttctgcctgggcctcttggacacacaccctgggagaagccagacaaacctgactacctgatgctaccagactggaaggaagtccgtgctggccacaaagagagggctgggtgcctgctccgtgtccccagccactagagtccttctgggtgcctgcttcacatccccagccactagagtccttccagatgagaccagggacatcatgaagcaaccaacccacaccgctctgtccagtgtcttgacccagaaaattgtgacatgtaaaaagaataaattcctggtttaagccagtaaggttacgggtacattgttacatctcagataattaaaaccttgaaaaactcatgagagatcacaagtagaaccttgatctgaaacatggcatgtggcgatttatattgagtattaggttaaaaatgcaagaatggagcatagttaatattttacattaaagctaaaaccataattgcctacttaaaattttcagttaattaggttgtcactttttgttcttaaccaagaaatcaactagttttagtccataaacagttagaactgatgcacacatccgtttttccttactcattttaaacagctatctgaaataggaagtgtaatgtaatctttaaagaatctgaaaacatgacagaaatgtttaaactataaacatatattgtatatgttagcatattgtatacattgtatattaacataagctagaatcattgacataaatttatataaacaaaaggtataaaatatgataatgttcttcttgta

SEQ ID NO: 537855 - DNA, 300 bp, Homo sapiens
catttccataaacttccaagcctcctttcttgtgatgatgtaaacatgagaattgctgctggcgaatctttggcacttctgtttgaattggccagaggaatggagagtgactttttttatgaagatatggattctttgacccagatgctccgggctctggctacagatggaaataaacaccgtgccaaagtggacaagagaaagcagcggtctgtcttcagagacgttctgagggctgtggaggaacgggattttccaacagaaactgttaaatttggtcctgagcgcatgtatattgat

SEQ ID NO: 537856 - DNA, 166 bp, Homo sapiens
tgtgagtcatgaagaaggtagcgatgatgtgtgagctgacagttgacgaaagaacctcctatctgttgcatatagaatgtgattggagctagaagagcctcctggagaataatcagcagcattgaacagaacgaagaaaactagggaggagaagactagctagtaa

SEQ ID NO: 537857 - DNA, 278 bp, Homo sapiens
caaatccaaacagtgccttactcttaaaagagatcctggtcccactcaaaaaactcaagatgagctcctcctctgaaaggtctttattacattttctgccacataagggatattcacaggttccaaaaaacatgggggcttaacttttggggggcttcagcccatgacagataccaaaacttaaaacccacccattttaacccccgggtttaaaacccctaatagattcccctttcttaaagcccacagcccccttaataaaccccacccagaaccct

SEQ ID NO: 537858 - DNA, 144 bp, Homo sapiens
gctgggcgagctgcttctgatgctgcgtctgatggcttggctcctgagcctccgctgctgcccatgccccaactccgtcgccctccatgtacaaagaactggttgttagaatcgatgaagccaggcttggtgatcttggttagt

SEQ ID NO: 537859 - DNA, 764 bp, Homo sapiens
tgcccctgtgcgccatggctgtgcagcctcaatggactgagctgctgtgctccatctgcctgagcatctaccagtgaccctggtgagcctgggctgcgagcactacttctgccgccgctgcatcactggagcactgggtgctgtgcaggatgtgctgcatgggctgccctgctgactgcccctgagtgcctggcgcactgttctgcctgagccctgcgctggctgcccagcctcaatgctggccaacatctgtggatgcgctacatgctccttccctgctggactgccatcctcaacgctgctgcctgcgccgctgcgaccctgccaggcgcacgacaaggtcaagctcttctgcctcacggaccgcgcgcttctctgcttcttcttgctgactgagcctgcactgcactgagcagcatcaggtcaccggcatcgacgactgccttcgactgagctgcagagggagctgaaggaccaacttcaggcccttcaagacagcgagctgggaacacaccgaagcgctgcagctgctcaaagctgacaactggcggagaccaagtcttccaccaagagcctgcggaccactatcgggcgaggccttcgagcggatgcaccggctgctgcgtgaacgccagaaggccatgctagaggagctggaggcggacacggccgcaacgctgaccgaatcgagcagaaagtcagcgctacagccagcagtgcgcaggtcatgggggagccagatctgcaagaacggtggtgaacaa

SEQ ID NO: 537860 - DNA, 233 bp, Homo sapiens
ttactggggcgcagtatcgctggctaacatatgtcaatccagcaactttgggaggtcgagacaggcggatcacgaggtcaagcaatcgagcacatcctggccaacatggtgaacactcatctctcattaaaaacacaaaaattagctgagtgtggtggccagtgcctgcagtcccagccacccgggatgctgaggcaggagcaattgcttgaacccaggaggcagaggttgga

SEQ ID NO: 537861 - DNA, 279 bp, Homo sapiens
  misc_feature (37)..(37): n is a, c, g, or t
ctgagctatccgactagccgacaggagacgaggcgtnacactgtcctgcgtaatcgcccagctggaggcggggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccagctgtggggctagatcggggggggtacctgagc

SEQ ID NO: 537862 - DNA, 264 bp, Homo sapiens
tcatcaatcctcatctttcatgtttttgattatagctatctaataggtataaggtgaggtgatactgtggttttaatttgccttttcctgatgattagtgatgttaaggattttttttcatatacctgtttgacagttgtatgttttcctttgacaaatatctgttgttctgcccatttttaatgaggttgttttctcaatattgggttgtttgagttctctctatattttggatattaacccattatcagtatgatgtaaaaa

SEQ ID NO: 537863 - DNA, 195 bp, Homo sapiens
gggagaattccagatctcagtagactgattacccccaaacttaaaaatacttaacttacccctatacctacagtgaatgtactaccttaaggaacatggtatggtgcatagaaacctggctgcccaaaacgtgctaactcaaagtcacccagtcaggttcagagtggcaaattttggtgatggctaacctgctgc

SEQ ID NO: 537864 - DNA, 426 bp, Homo sapiens
gtatgtaagcgatctttgttctcagcacggacataacgccgtaaggcctggaaaatgccatgaggccgtggcgggtcaaactgcaaggcagccaggtagttctccaaagccatccgacggcggtcatccagcatagcttccactcgggccaggtgggtctccaccagcagctgcttcggatgggtggttccttttttaaaactttaaccatgggttggaagggccgaatcaaaatctgcctctttgctttggggagggtcttaacttgaaactttggcttttcccattccttttttaccctggccattcgggtggggggccgaaattccaactgctccttaaccttttggaaacaagcatgctcattattatctggagagggctcgaaatacacatcaacatcattggttggcaaaagaattggag

SEQ ID NO: 537865 - DNA, 115 bp, Homo sapiens
gtgaaagtttgttatataggtaaactcgtgtcatcagggtttgttgtacagatcatttttgtcacctaggtacccaagtactcaaccaattatttttcccgctcctctgtcttct

SEQ ID NO: 537866 - DNA, 579 bp, Homo sapiens
  misc_feature (365)..(365): n is a, c, g, or t
atattgcaactgtagagatctccatagtagagaacagctgggcacccctagagcctgttcacctggcagagaatctcaaagttgtgtacccacacagcattgcccaggtgcactggagtggaggagacgtgcactaccagctggagagccagcctccaggacccttcgatgtggatacagaggggatgctccatgttaccatggagctggaccgggagcccaggctgagtaccagctccaagtccgagctcagaattcccatggtgaggactacgcagaacccctggagttgcaggtggtggtgatggatgaaaacgacaatgcacctgtctgctccccacatgacccaacacgtcaacatcccntgagctcagccccccatggaacctgaaatagccaggctctcagcagaggattttggatgcccctgggtcacccaattcccacattgtatatcagttgttgagccctgagcctgaggagggggctgaaaacaaagccttcgagttagatccgacctcaggcagtgtaacactgggaactgccccactccatgctggccagagtatcctgcttcag

SEQ ID NO: 537867 - DNA, 142 bp, Homo sapiens
  misc_feature (7)..(7): n is a, c, g, or t
ctggtanatccttgcagtcggatttcacgtggatgatgatttttgtccggttctaactcccgaagcttcggcgatttcaacagactccagaaccatctgaaagccactggtaacccaggctccccgagactgctcgccaaat

SEQ ID NO: 537868 - DNA, 386 bp, Homo sapiens
tcgatgcatctgtgctccccccactacatctaagttctttgcatcttctaattcaaacttcaagaaagaaaatctaattgaagtcactcctccctttcaggaggagtagtatgtattctggggcctttattgagcttattaattggttcccattggtaatagggaatcccattaaattcatctggtgtagaaaacaggccaaaagaatatctatctggttaggggtgaagtggaagctggaggttggcagatacattgacacatgtagaacatgaaactagttaatttttaccaaatgagtgaaattggtctctgttctgtggtcaggaccatttgaaaaatctccatagaggaagaatcaagataaatagagagagccgagaacc

SEQ ID NO: 537869 - DNA, 1194 bp, Homo sapiens
  misc_feature (283)..(283): n is a, c, g, or t
  misc_feature (316)..(317): n is a, c, g, or t
  misc_feature (324)..(324): n is a, c, g, or t
  misc_feature (333)..(333): n is a, c, g, or t
  misc_feature (350)..(351): n is a, c, g, or t
  misc_feature (494)..(494): n is a, c, g, or t
  misc_feature (946)..(946): n is a, c, g, or t
cgtggctaggcgaggacccttcaatccaaggatgtcctgtcgatcaggattcgccttggagcactactaaggcatttctagcccaataccactaggcgccgtcgtgcattctgctgtcacgtgttatatcacgtggtgagcccgtgtgacctacagcactctgggaggaaaggtcagagagtgcgcattcgcgtgacgtgcatgcgtcgctctggcctcgcaacgtttcactagaagtgccatctacctgttggtggctggaaaatgtagaataatgctcganccttggggcgtgccctgacgagaacaagcgtgnnccctccntccgtgcgnaagattccgcgcgcagnntcgccacgtttccttctcctcccctcgcgaagccccacagggagccgattcgggtgggcagcaaacagtgcgaaccttcctgggagtggtgcatgcaaccgagcgcgtgtcctataccattacttcatcatgatgtccgttangttcctcaacatgctgaccctgactgggctcggttccggtgcttgaaccaaaattggccggggtggttttccatcctctttcgggtggggtgttccactgaagatacccctttcactagttttgcgagcgaaacttttcctgtgttcagtaagccttacgtagtggacgagtttggcctacgtgtggggtcacacaaaaatggcgcgtggcggtgttgcccaaattacgtttggagttcggcagttattcacgaccaattcattataaaagcaagggggggccgggacccagggtccctaagctggtttttggcaaacacgcgttttgtggacactcacctttttccccaacttatatatgtccctctctttaacagcttaacacagttttgtgtgttgttgtgtcaacacacaaacagtgttcgtcgcacattttaagggcgcctaagggntggttgatggtgaggcctccatgggcgccgtgtggtgaaaattccccttgggggcaaacctttttgggggggaggggcccaaagggttgggcggaaaaaggcattccgggtttggaaagtagtccccacagcaaggttttcccaagcaaccaaaggtccctgggggggcacacgccactaagatcgaaggaaaccccgtaaattatcggttttttctacccgacgatctggagagtcagaaaaaaata

SEQ ID NO: 537870 - DNA, 105 bp, Homo sapiens
ttgtaatgggcacagaaattaagtaactgactgtaaggacagccaactagtaaagtgggagaacaaagactccaccctggcaccatgggctccagagttctaaag

SEQ ID NO: 537871 - DNA, 151 bp, Homo sapiens
tacaggatgaaaatctggccccattcagtgcattcattcaggactgtcagcagcttatataatgttctgtgggttcagatcaagtaagttgctgttctgggtgagactcactgatttcagataatgccgctacggcattagccaccaccat

SEQ ID NO: 537872 - DNA, 317 bp, Homo sapiens
ccccggggtcgccttacgtgtgtagcctgctgggatctagctctgggaaagagcagccccttgagtgtgacagagctgtgggccgatagctttaggagccacatatccctcctttgatgtccaggatcagttcgagcctggtcccccaggctaagaggagacgaatgaaagaatcttgctgtggtctttcctcgttaaaataacatttcgggggagcacctgggctgaggacctatccatctgctccttggtccgctcgaagcacctacgggcgagctgctgctgtctggcgtcctcactcaccatcagctccccgt

SEQ ID NO: 537873 - DNA, 1659 bp, Homo sapiens
  misc_feature (1659)..(1659): n is a, c, g, or t
ttcctccatgattggcactgaaaatgaccagcagagacgagggcgtgattggatctgtacatctgctagacacaattgaggcaggctgagtgatgggaaggatctaccgaagtctgggatgatttgaccacccaacactgacgcaaccactagtgagaatccgctgatctctatctaataaaatacatgatacattagtctggcaaatccctatgcgtcactataggcgatgtgctcagtaaggtcgcgtggatggatctacttgtacatatcccgcgagtgctgaatagtgttagcaacgtagatactagcagcattctaatgctcaatctttgcaccatatatacaaggataacataccccacaaacgcgcctgagaacgccatgaagctagaagcacaccaagtgtttactgcacaagaaagtgcacacactgcgagacaacagtccctaaatgcacctgaggtgtgtactaacgtctaacaacaggccccttcatgttgagagagaatcgccgagtgagtgtgtgcgaagcccatacattgtcaagtagctaagcagggttggctgccaccacaggcacgcaacgaggttccccatgggtgccgaataaaaacgtcgtttccgccgtcggattctactacagctaggtgacacgatgtcactaattattttaccagaagagttacctcggccaccactatccattattagtcaagacaacgactcttacatccccaaaatttagaccaccccgatggacaagggattctcccaagtggcggcctatataacgaccccacaaaattgtgttacaaccattagaggagacttatcggaaaccagcctaccaacattcgactatacacagtggtggggtaaagactcacttccccaataggaaccggctttgcccttattagacccacttatgcactacactataaccttgacataatcattcttaccaacgcagacacctatattggggactacaacagcgtattcgataccgcacacttcacagagatagttacggcccacaattatctcaacaacacagtatttaccccacctgacatgaagaacaaaaggagatacagtacccataaccgtgacaacggccggtctgtgactacgcagcgagcgacgataaacggtatcggcacgatgcgggcacccaaaatatttttgctcaccggacttgccgtacgccagttcttgcttcgcctagtggctgatgaaaagcaaactttctaccgttgtacacacggtggcacacgcacaacgtggcactccggagaggcacacaactacagccgccctcgagtggacgagagcgaggaggggctccaccagtaggagagagccctctacagccgaccctagcaaggggcgaaaccacaccatgagcggagacccccccacagagttgcagggtaggggatacaacacacccatacgtgagcatgcacgacaaaaagttgccaccgcgcagctcacaatatgaagacagggggacccacaccaaaccagaggacagcggagaaggaaccacagagacgacaaggaacaaacacaccgagctacaacaggacgtgagcaggagaggcagacagacgagacatcgaacgcagcggacgacacactaacagccgn

SEQ ID NO: 537874 - DNA, 102 bp, Homo sapiens
  misc_feature (62)..(62): n is a, c, g, or t
ttttttagggggggggggcaggggttttttttttttaacaaaaaaaaggccttttagttaanctaaaattaaaaaaaaaggccctttccccttggggcccta

SEQ ID NO: 537875 - DNA, 636 bp, Homo sapiens
agcggagtccacttccggtactatgcagcggtgacaatgggagcagcgctggtgcggcgccgggaggcagctgacaagctgtttgcggcttcgcttcatggccgctctccctgccccatcctgggatctgtggtgagagactggaggagcccagacagacggccacggagaccagtgagctggacgagcctgagacggacgaaccgtgatgacgaccgactgccatcctgcacgtgccgcacgacactgatgaaaaggctgggacagactgtgtcattcccagatgggtgtgtgagctgaagaccaatctcaagacaccgaggaccaccggagagcacattggggcttaagacacagccgtgaccgccggcaaacccatccatgatgcgacaacggcaaggccgacagattactcaggcgtggggaccacgaacttggacacaatcaaataactgtcggacaccaccggtgaccgatcaggcgtgcaacttgaggcaaagcacaaacacccccgccgaggacggcacagcggacacagcggcccgtccccgatacgcgcacggagcgatgacgcaaaccacaatgggaaacaacaggccccgtcctcgccaggcaacataccaccaatccaaacac

SEQ ID NO: 537876 - DNA, 443 bp, Homo sapiens
  misc_feature (177)..(177): n is a, c, g, or t
actgtggctccttctcagatgtagaaagtccgtgatggggaacactcattacacagtggtgtggacagatgaactttgagtgaagtcacgtggaggatttgtcctccgtgtgtcgtccgtgatacatacaagtggttttcttgtttgtccttttgtgagacaagattcagtgctagnctaatgggctacaaacggaccaggacgaaacgatgcaccaataggcaccagacagcccaattggagttgacggagatgatggattcagtcatccaccccttgtgaacctgctctccaggccttgagacgttgtccagtggagaggaactggcactacatgtgccgtcttgaagaaactgggacccagaaggccagggctttagccctggacccatatatggcagtgagtctgttgtcaggctcaggctaggatcctcacatagtca

SEQ ID NO: 537877 - DNA, 845 bp, Homo sapiens
  misc_feature (398)..(398): n is a, c, g, or t
ccccggtctccccctcttttttaccccccatattggggcgctccgctggtccccatgggtctttgggatttgttcctccgcccttgtgattatttcgggccgcgcgatccttctttccacgttgccgctccgggggtttttaacccgcggcgagctggttattataccccgcgcgacgcttttgcccgcgcccgctttatgttgcacacgcggaggacctcgtgggttttataagggagagaagagtgatttctacacgggcgctctcctattgttgtttgcgccgaggcgccccaccagagcctggggagaaaataatatgtttgttggtgagacccaccatttggtggggtggttttggggtggggcgcctttagagaacaaccacgggtgtggtncaaacacgcggttgccttgtttatataggcgagaatatttgtgaatttaataagatgtaataccctccgtgtgtccctacccattcgtgttataacatcctaacccccacagatgtggcctgtattagaagtgaaagatgagagatctttgttccaatctgggaaccacccccgttacaccccctcttttgttctgtgtcttcgttttcttttttttttttgtacacttacaccactattttatggatggatttagatggaagagtgttctttctgctccacacttaatgtttgggttcccgatcccttccaacctggttctatattttctttttacatttccaaactaaccctttttcacaaatggggtgggggggggaaaacccatttaaccccgtcccccaaaataaattttgggttaaaaaaaaaaaatattccctttgttta

SEQ ID NO: 537878 - DNA, 272 bp, Homo sapiens
ccaatgtgaagatcgggggtcaagtcacagtgctgaattactttttaaaagaaaaactatcaaaaatagcttttaaaaacacatcctcaattacattcagaaaactaggatacctgctacattcattctttcagcagaaggcactatgcacaatgcgagaaaaacagactttaaacgagcttagactaatccgtctgacattaacaggcattctatactaccttctgacacacagcaaaacgcctgggagattgtactaggcaaggagacca

SEQ ID NO: 537879 - DNA, 253 bp, Homo sapiens
  misc_feature (96)..(96): n is a, c, g, or t
aagcccttgttgggaactgagaagtgtatatggggccaagctactggtgcagaacacagagacagcagcccagtgcaatcgtgtcgagcattgganagcgccatgtgtggacataggaggaggaatattccatcttgggagaaaccacagcatgggttttttcctactggtgtgtctgggggaatgacggcacagatctgttggacttggtaataaaaatagggttccccaacttccccaatttctgtgtcct

SEQ ID NO: 537880 - DNA, 325 bp, Homo sapiens
gcgagggccaggctggtgttcagtgtcacaatcacaggtgacggcaaccttgacctcctggactcaagcaagggggggtgagcccccagagagtgagtgggactacaggttcacgccaccatgcctggctaatttttgtatttttaatagagatggagtttcaccatgttggccatggctggtctcaaactcctgatctcaagtgatctgcccaccttggcctcccaaagtgctagggttacaggtgtgagccaccacacccagcccagatttttgtttcttttctttttccttttttttttttgacacagccactccctttgtt

SEQ ID NO: 537881 - DNA, 149 bp, Homo sapiens
tggaacagaaaaaaaatcaacagattaacaggttatttaatgtaatttgtagtggctacacattaataaaaataaattagtataaaggaattacacatgaaaggatgaatatcaaagatgggttggtcatggaaaggggtaccgagctc

SEQ ID NO: 537882 - DNA, 1272 bp, Homo sapiens
gagctctggtcggcttctctatgctgcatcagaggtatgattcttcctctttccaccattgagcgacatgtctgggtgggggtatactgcgagggctaggttggagcccaagccattccagatgcccaaccatcgaggattcgtgcgagcccctaatctgccttccggaaagcgtggatcgccgaggctgcgtcgggaccaagtaggtcgcggactatggtgtcgcagcggcacacgcaggttgcgtgtcaccttggtggtgattcccgaaaggctcaagcgagacattttacgcttcggggccgccgacgcatgcatggtacgacatgcacgccaaggcgcaaggcgcgcttcttggccttaggcatcggccttcgcaagaaggtccacaagagacgacgcccggaggggaaactaatggttcaaatagtttggaaagttgttagagcgaggttgactcaaagtctggtggcttacggtattgttctttgagccccaaggttgtgccttatactccacaagcgtgcacgctttcttgtccacgagtagtctcaattcccaaagcttcgaaagccatggattccccaatggcacgacgggaacggaagacctgtggccacctgaacgggaccgttacgattgaaagaactgggaacgcctagagggagacccgagggccctggagaagggcgaccaagaccctttggccacaggggaacggaaagccaacctagggcggttcggacggaataggtgacaatggagcctcggagtcgcccgtggacacccgtacaccctggtgtgtagaccttggcttgaagcccaattctcagcgaaaggggctgctttacgaccccccgggggcggccacaaggttgagcacacaaatggcgactgcgcacggagcgtcgcttggaacttaagcgattaggaactcccaatttgggcgacagcattggacacggtgtaagctacccgcccctggttgtcaaagaaaggggccttaagccggtgtgggggaaaccaaccgctgttccggactccgaaggtattatggacaccccctgtgaggattaaatatggctcgtaacttggcctgtggaacaattggctggacatacgaagggggccaattttgggcctataggccacaggaacggagcaactgggcttagaacagccccttttggatcccaagaggggtgaaccaaagcgcgatataggggacctttgtctttgagacccattcacacttaccatagatccgctttc

SEQ ID NO: 537883 - DNA, 396 bp, Homo sapiens
actctcatctgaagagatatatgaatcgactctgcctctggcacctacactctctactcagtcatagaacatgccacttagacgaacccaatcctctgaaatgtgattgatgtggacatcacgtaccctgcaggaatatgctccctcgagtgtcttgtccccagcagcttaacactccaacatacaggaaattcagccacctgtcccgcgagcttgagaagaggccccccaccgtggtgtccaatacattcaaagaccctgatcctctcgcggattgctatctgcatctacgatctgtgaatccggattggtgccaatgtctccaaattcagttttgctcctaggacgattatatctcacctggaacatgctgctaatgctggaactcatgtatgc

SEQ ID NO: 537884 - DNA, 122 bp, Homo sapiens
ataggcgacatttcaatttagaggggattgtggaaaaccttttttttttttgggaaagggattttgggctctgtgtgcgccagggttggagtgggcaataatggcgaattctcgcttcattg

SEQ ID NO: 537885 - DNA, 597 bp, Homo sapiens
ggctcacacctgtattggcagcattttgggaggccgaggcaggtggattacctgaggtcaggagtttgagaccagcctgactaacatggtaaaaccctgtctctactaaaaatacaaaaattagccaggcgtggtggcacatgcctgtaatcccagctacttgggaggctgaggcaggagactcgtttgaacccaggaggcggaggttgcagtgacctgagatcgcaccactgcactccagcctggggaacagcagcgaaactctgtctccaaaaaaaacaaaaaacaaaatttctttcccctctttgaattatattattttaaatgtcactggccacggtggctcacgcctgtaatcccagcactttggcagcccaaggaggccgcgccacctgagcgcaggagttcgagaccagcctggccaacgtgctgaaaccccatctctactacacatccactaagcttgcctgtgctgctgcatgcctggaaccccagtacttggcagcctgcgcaggttgctgcaccccgaggcagaggttcgaatgagcccagttcgcgcaattggcatccaccttgcccaacccgcgctcgctccct

SEQ ID NO: 537886 - DNA, 300 bp, Homo sapiens
agcggagtccttcatctacgagagctgaaaaatgtgtccggatcctgctcaaaaccgaagaaagttttatttaatctagaatctttcatccatagtatttgagaaaagtgatctcaaattacacaaggatgacctgacaagtccaaggcagtggaaactactatagaacctttttactttataaaggcttccgttgcatgcgaaaaacacctgcacaaatattctggctttgacgtttaactgattaccacattaacctcaacacaggcaatcatgttgcaggtgtgccttccggcggga

SEQ ID NO: 537887 - DNA, 158 bp, Homo sapiens
gccgatctagaggatcccactgaacagcataaaaatgtatctatttctgaagaactaacttgctaatcgcggatattttccttgatatttggttacattgctactggttattttcaacaagttactattcttacatcacccacagatacagggggtac

SEQ ID NO: 537888 - DNA, 159 bp, Homo sapiens
gatcatactgattcgcaaaccttggagcattccctctgaactctagcacatgacatgattagcctctctctccactgtctcttcaaccatactttttgggaagttcttggccaaggcaactccaaggcaaagagaaaaaaaaaaaggatttcagttaga

SEQ ID NO: 537889 - DNA, 88 bp, Homo sapiens
  misc_feature (20)..(20): n is a, c, g, or t
tgaagacctacgaggctgcncaaggctgggccctaccaggaggctcgcaggcagctgtctctcctcctggaccagcagggcctggggg

SEQ ID NO: 537890 - DNA, 395 bp, Homo sapiens
ctggagagttgactttggtgcaagcacttgttggtcgcttcaacatccatcctctcatttcatccacacatcagtcttataaagttggcattatcttatgcttattttaggaatgaagaaaggggggtgggtacccaacgataagtagctttccctaaatcgtttcgtgaataagcaacagagcctggattcaagcttgggctgtctggcccagagcctaccctgagcacgtgccatgttttgcatctcagacagagagacagagggcgcccatcatagctgcccaccatccaacccagctcatacacactcggcatgttcatgtacttccttccatacttataaacccacattctccccgtaataaaatcccaagttttaaataaaaaaaaaaa

SEQ ID NO: 537891 - DNA, 500 bp, Homo sapiens
ccggcgctccatctggccttccgcaaaggggatgtggtcctggcgcagctcctgatttggtacggggtggacgtcatggccccagatgcccccgggaacccagcgctgacctacggccggcaggcctccagccaggagtgcatcaacgtgctttttcaggacggctgcccccacgagtgtgtgtagtatttgttttatttggctgccgtctccctggggccaaaaccaaatggggaaaattaggataactccggatttccaaagggaatccccaattccgctaatattagccttttccggaccttttgttaactaagtgaatacccaaaaaggtggttttttttggccctaagacggattttatgtccctttgcccaggggggtttgttagtttccgggcctcctgggccccttgccccagtccccccgggttttgttttttgttttttgattaaatgtgtggaaacattttttaaataaagttcattaatatgccttta

SEQ ID NO: 537892 - DNA, 344 bp, Homo sapiens
  misc_feature (219)..(219): n is a, c, g, or t
ctgtgggtccattaacctttttttccttataaattacccagtctcaagtatgtcttcattagcagtataaggacagactaatacgcagtctcctctgaataagtgtgttaatgaagatatgacaataaaacctgcctcagcctcccgagtagctgggattgcaggcacatgcctcaattcaagcctcccgagtagctgggattgcaggcatgtgcccanggcaaggttggttttgttttgttttttttttttttaattttgcgacggagtttcgctctgtcgcccaggctggagtgtagtggcgagatcttgggtcactggatgctcagcctcctgggttcaca

SEQ ID NO: 537893 - DNA, 531 bp, Homo sapiens
cattgacattttcactatgccctgaacctgagagcatctggcaggtaggggggtaggtcctcacacacccactggctcacccatcagtgcacacgcgtgcgcatacacacattttgttttgacgccctgttatcactggcctgaggaggcgcacactggcaagaggattgcagctagccttagtgactcacttgtgtgcaccagccatgaagagcccacgcctgtactccccatcactctgctgtccctgagaactgtagatcatgcgcttgtgagcgaagccgttccctctgcaccagctgattgcatagcgaatatcctatcctggaggtacgcatggagaacgtgacagtgctgggtgaggacgtcatagttaatgatgagctctacctcaacggagccagcgtgctgtcccacatgtatattgatgagacagtgccagagcctcgtatcatcatgtgaggggatgcaaagaggcttgccgagccccagtttttccatcaggtgagtgctggactgacacatcaggcc

SEQ ID NO: 537894 - DNA, 1199 bp, Homo sapiens
gggctgtggccggtgccagccatcactgcctgttgccgggatgccgcgtggtgtacatcgcgccgcctgagctaccagtccccggtgagcgctgatgtggacgcgcttctttaatgggctactggtgaagatcctggagtgtggatctgaagacacggatatggtttctgtggacgctttgactgactctgcgtgatgcagatgatgctgttctatgaactgaactggcaaagaccttatgctgcgtgacgcgacgtaacttgttgagcattggcccgcggccccacgtgcgagcatgcccagcttacaggattctgcgacgcacgctggactactggcttcatacgaagaaccgtggccgagcactaaatactggaccctccctaactccgcgcaccacgcacgctacaagcaccatctactctgcctcgcgaccgcaactctcaggtcacacggttcccggcttgccaagagcacttagcgccaaccaacccctacacacggacttactaattgccggttccaagccccacgccgcacgcacacggcttgaaacctcatacctgccacacgaacttgccccttccacgcaaaccggcgaaccctgccaccacacacacttgccaacagccgcgcgcctgcacctcccgcacaggttaccccggtaaacttcttctaattctccctggcaacttaccttggaccacatacgaacggcctttggggggaaacacacaccgcacttccggggccacttggcgccacacctcttgcgaacaccgcgtccaaccactggcgcccaacgccacaccaccgacgaccctccccgcaacatccaacgccctcttgacaccagcaacgcaaaaggccacccaggcggttaaacccccagggtaacgcgacaccaggcccccggcgcgatcccccttaaccgttcccgcaccgtcacacagcgcccccggtggacaggcatcccccacctcgtcccgacaggggggcatccagtcccgacgcatcacggtcgcgacaaccgcaccgagtgcaaacagcttttacccccccgggccaaacgcgcaacgcccctgcacaacacggccccgccgacacccgcccctggagcccagccccgcacgcgccacacacacaacgccgcactaggcagcccaagatcacccatccacagccacaaggactaccaa

SEQ ID NO: 537895 - DNA, 161 bp, Homo sapiens
atagcgcatgtgtctctcttatgaagtgtctgtcaatcctgtagccacattctaatgagattatttttttcttgtaaaatttgttgaagtcccttatcagtatggacattagatctttgtcacatgctttgttgcagaaattttctcccattctgtagggg

SEQ ID NO: 537896 - DNA, 337 bp, Homo sapiens
tggggaggggggcagccacgcagactccgggagccctttgccgcagcggggctgcgcgccctaccccagctaggccccttccccgcagaggatgtgcctctgttgtcctcgcgggaccaccggaccccgctgctctatgccggcttctccacgtccagcatctatcagggctctgcggtgtgcgtgtacagcatgaacgacgtgcgcctggccttcttgagaccctttgcacacaatgaggggcccatgcaccagtgggtgtcataccaggggcgcgtgccctacccgccaccaggcatggttcggagcccacgcactcctgctacaacccacttca

SEQ ID NO: 537897 - DNA, 555 bp, Homo sapiens
tacttccacaggcaagtgtgattatttaaaaatatgcagaacttatttcatctgtgctttagtaaataactgtatacagtgttctaagttgaaaagaactcgaaaataagctaataccaaactatacacctgatgtattagcaattcaaagaaagctgctttctgtgacagtcaatcagcatatattcaaaaaatgacacacaatccaaaacaagatgcatgttcatatataacagggacattgtcaagtttccttgctagcattcaaaccccatgcgtttaatcccatgcaaatttcccttttcaattcatcatttcagacagcaagcatgccaaatagtctccaggatctacttaagcaacctttcccaaatccactagttacactccccttttcaggaactaagcaggtattcgggtagctgcttcctcctctgcatcagctcggtttgcattaatttctgcaagtgttcggacaaaccgtgcccattcatcatagcggggaacagcaatctgctctcccacatcgtatataacactctgtcctacacactc

SEQ ID NO: 537898 - DNA, 904 bp, Homo sapiens
gctgcaatgcctccggagcgcacgtcggcagtcggtcctcgttgacgaatcaccgactctctccccagctgtattttcaaaatgtcgctttctaacaagctgaagctggagcaaactggacgtgtaagggaagcggggcggctgagagtcgacttccatggtcctcattaagaacaaaccggattataaacaaccgcaggaattaggtgctgtgcccacgcatctaattcttgcttggacgatgggggccactcgggtggcttattaagcaacctaaggcgggctgatggttggttcccctgtctgtacaaatattcttatagagcccttggtgttgaactccactctccttcttggggcaagaatgttgcttggttgccttgagaagacagtgtattgggcccccaaagtgtgggaaaagagctcgtgtgccaaaccccacatgtgtgggggctctgtgtactatctctgtgtgggttaaaccttcgcgttttccttggtggtcaggggacgacacagggcaggggagacacgactgcttctggtgaaccaccagtgatatgaccgagagccgacaacatataaaagagatatccgacgcacaccttattccaacacccaacgagggagggaccaatctgccacaaagaaaagggaagcacgtgctcacaggcctcgcaaaagaagccacccacagtgtcacgccgctgggcacggcacacactggcgcgaccaaaggcgcgggggcggggagcacgtaagaacagggagtgaacaacaaggtcaacgaagctgcgaatgccaccagagaaccatcccgggcgaccacggcgagagcaaaaacgaggacagaaccagcatcaaagaatgcgaggaaaccagtgcagccaaggggggcacgaaa

SEQ ID NO: 537899 - DNA, 928 bp, Homo sapiens
gtcggttactgcaagctccgcctcccaggttcacaccattctcctgcctcagcctcccgagtagctgggactacaggtgcccaccaccacgcctggtagtgtgtataagtagagacgcagtttcaccgtgtaagccaggatggtctcgatctcctgacctcgtgatcccgcccgccttcggcctcccaaagtgctgggattacaggcatgatgccaccgtgcccggcctacattcacttctaaagtctatgtaattggtggtcattttttcccttttagactacataaatggttgattgggcgaggaaaacttattctggaatattaccggtggtgacaaaggggccaagtttttttacccttaaacgtgcaaacagttgaaaccattaccaaaaataaggactaatttcttaaagagtaactcagtaattccaacacataacacgatttggatctacgcagcattaagtggttgtgagtgtctagccaacaggacaaacctgtgcttgaactcccccatgaaggtcctggtgtatatgtttacaaatactctcattatagtccacacttaaattaaggcctttatattaggccctctaatttcaggaaatacattcttactatccatatttacctgatttatcatcagattcgaactccgtgcatgaattatgttcacttcacacccttttacactgtgccgctggctcatgcacgttggcggtcctgctccaacactggggcggttctgtcagtaccgttaggtgggcctctcaacagagggtcctcgaaagggggcttttctcctttaaaccatggacgagttaagcggccttgacagaatgttcacctaacaggcgatgttgtcacaccgaacacggagagttcgacaggcgctaacagggccattctttccaacacggcgcga

SEQ ID NO: 537900 - DNA, 286 bp, Homo sapiens
agacctggatgtggccattcttgtgggctccatgccacgaagggaaggcatggtgagaaaagatttactgagagcaaatgtgaaaatcttcacattccatggtgcatccttatataaatacgccaagaagtcagttttggttattgttgtgggttatacagccaataccaactgcctgactgctttcaagtcagctccatccatccccagggagaacttcagtcgcttgactcgattggatcacaaccgagcttaagctaaaattgcttttactcttggtgtgact

SEQ ID NO: 537901 - DNA, 770 bp, Homo sapiens
gctgggcgtgagtgcaggaagtggaggtgtttgctggcgccggtgtaccatggagcgtgggcgaacttcatgagctaccagcctcaataggggcacagaatctgtccccgaggtatgatgaatgaggaggagcagaagatgcgtcggagacaaagtggtacgtcgagaacgcggcctgctatcggtgaatgaagaaatgattgtggtggaggaagcggatgatgagaaatgaaaggctggtgcagattattgacagatgatgggggaagaggaagacggaagaggaaggaagccatgggactgaaagctcagattgacagataactgaatcgatcatcattctgaaagagagattcattattatacaatagccaagaaaattgcgggagttagggtttgcacattaagcaggttcaacaatagaggggtccgtttgcgagattccgagacgctggagcctatacaatgagaacttcattcccagagaaagaagtgccatcgtgtgggtgaccacgactcagtgcccgaggacccgtgatacgcgacgcgttcggtgggtgcgaggcgtgagagtgcctggtagcaaggttctgcgtgtctccgcgggtttgcactccggggaccccccaataaattacccgggcatgatggtcccaatcaggcctagggagctctgagttctggctgtcacgcggaaatttaaaccgaagatttcattagacgactcacttccaatggaaacacgtggaaagagggggatgcacgcacat

SEQ ID NO: 537902 - DNA, 101 bp, Homo sapiens
aaccgtagggcaggtgatagagcgccgttaggaccgaaagatgtgactatcctggcaggcgaagaagagaaactctggtggaggtctgtagcgtggtgttg

SEQ ID NO: 537903 - DNA, 439 bp, Homo sapiens
  misc_feature (54)..(54): n is a, c, g, or t
  misc_feature (57)..(57): n is a, c, g, or t
  misc_feature (60)..(60): n is a, c, g, or t
  misc_feature (374)..(374): n is a, c, g, or t
tctgcccttccctttctccctcttgctccacttgctcctggctccgcagttctnttnttnatttgagtctcattacagctggttgtatgccaccatgtggttgatgggatttgaactcatgacctccggaagagcagtcggtgctcttaactgctgagccatttcaccagccccctgaatatattctcatacaaaaaaaagggggaataataaacctatataggcttaaaaataaatttgatcttgacaatcaagacaatatgattagaggtgaataaacagaacataattacccagaggagaaaaagtattcattctgactaccttgcagtttcctgggcgaagagcatttaaggaatgtgtccggatggaangagctcagataggtccagtgtatcagcgagaagaacttgctttacagctttctctacccaattct

SEQ ID NO: 537904 - DNA, 368 bp, Homo sapiens
aaaatagagaagtgttgttggaataaaatttttattcagattttatttcataatattatatatattcattttaaacatgtttctaagacaggtctcccaacttttgtatgtatttatgagtgtggaaacacgtgttaaatgtgagactttttttttttattgttaaacagagggagttaccttacaaggacatcgacatggatcttaaaattctgttccagaattcagaatgttaagtgtaggtatttactgatcattgttgattttttttttctagtaagattattgttagacagttttggtaaatagggtgatttttaaattttccacacttgggctagattctataataaagttttcaagaaagt

SEQ ID NO: 537905 - DNA, 1023 bp, Homo sapiens
ttctggctaggacgcaggtcgagtcaccagagctccagacgatgtctgtctccttcctcatcttcctgcccgtgctgggcctcccatgcgtggtgtcctggtcaatagcgtacagctgctgcagttcaggtccaggacatggctgaagtccctcgcacgaccctctcacgtcagcctgtgccagtctccgtgggactaactgtctcttaacaacaaattgcttgcttagtgaactgtgatctagggcaagtcccgcatcaggcaagaggcgcttggagtaggctaggtgaaggacgatgactggaccaggtccaaaggtgggtgatcaatggattgggatagcagtgatctagctgaaacagtctgaagtaaccagtcagaccgcaggacaacttatcctaaagaaccgagtatctactcctgcgagcttagatactcctgtagaccgtacgccagacggtaacacctgggcctagtgttaccttgaactggtgaccaaggatggaacccacgtatagcctgggaagcctctattgacttgactgtggcgctcagcgcacacccgtgagttgcaccagtactacctcgaggggaggtgcgataccgcacccgaagcccgtgtattcccccgctctgatctccttgttgtagaagttctccgcgatcgagcatagcgacgctagcgttggcaccgattgcgcgtttcgtcgcgacagtgtactatccattgcccgaactaccaatcgacgttgtctaccggtggaatagtacacatgaagcaacctctagacaatacagataggaagcccgaggagcttccgcaatcaggtcgctgcagcagagggcgcaccgatgacgacagtcacgctacagcagagtggctagcttcgcgcttcccaatggcaccgtacagtgcaggggccaccagaaacgaaaccactgtgcgtggtggcaaaggtccgagcacccacagacggacaacagagacaagaaacgtgccgttcttcaagtgaatatgccggc

SEQ ID NO: 537906 - DNA, 297 bp, Homo sapiens
gtgcctcctaacaaagccgctaagatgaagaatgggcaaaatcgccccaacgaacaggcagcctcgggagcccgttacctggctcgcgaacagaagggagagttgccaatatggatgtgacagcggttcccattaacggtcacagatactctcaagttaaaaccttaaaagttttctcaaaccaatgtcccctccataactcggccttccaaagaaaacatccttcaaataaaatcaaacaaatattaaaggaatgggatcattattgcattctttcagcccaaataaaccaggaat

SEQ ID NO: 537907 - DNA, 884 bp, Homo sapiens
gggcctacggcacggcgtcaggctctgcagcgtgttcctgcctggtgtgtgggtgagggaaagctaagtccgctaggaaatcgccttatgtcacctcgcactcttatcctcaatgaaagaagtctgaagatcgagtgtcctactaaggtgatttaacctgcatggattgggagatactggagcacggtatggggcagaagccttttgccaggtactcagaagttcacatatcaaatatatctgcccgcatgcgcctgttaggcctgtgtacattaaatatgaagcgtggctatgccttcatggcttcgctatttatcgggctttcaccacattcacaggaggatgaatctgggattaaaccaggcagcagaaaatatggacagctttgattgagtcaccgacgtgaagaagtggccctgccttctaaacagacttactttgggaggctctcctcatggggaggagcctttagtcttcatatactgcccttaccaacacagacagaaactggcaggtgtcactgcacctcacggctggtggcttccacttcggggcttcctttccacagggtcctctcggggttgcgaaccagacgatattgcatctcagtgccacggggatgggaacccttggtaccctgaggttggtccctacggggaaaccaagaccatggtgatcaggcaaggcgcctgttaactggaagttgatgcaaggcgggtccaggaaagggggacgccaggagcctgaaaatgcgacccatgagggaccgaaggcgggtaagcacagaagggtacaaggaacccacgcgccgggaaacagggggaaaagtagaaaacacaaaccaagcccccaaaaaacacgccgacagaagagacaaacaggtc

SEQ ID NO: 537908 - DNA, 400 bp, Homo sapiens
gactccccggcacgatctttgctcactgcatgctctgcctcccgggtttcatgccccttctcctgcctccgcctccctgagctcgccttagtgctatctcggtgcccgccacctagcccggtctatattttttgtatttctagtagagacggggttccaccgcgcttagcccggatggtctcgatctcctgacctcgtgatccgcccgcctcagcctccccgaagtgcctgggacttacccggcatgagccctcggtgcctggccttttatctggaatttaaaaaattagccggtctattttttgcccgccttaagctcttaaggggattgttgcccgcttgcaccatagtgactctgccttcgtgtgtatgtcatgagctctgcaaggattcgtgccgg

SEQ ID NO: 537909 - DNA, 321 bp, Homo sapiens
ggctgtgttagcacaacctagggtcagttttgcaggtggtagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctggctctaacaattgttcatacaataattgttcattattgttctcaacttggggctctccccaacctggggacccttcctta

SEQ ID NO: 537910 - DNA, 947 bp, Homo sapiens
  misc_feature (947)..(947): n is a, c, g, or t
tgtatagggtagaggcgacaaatctaccgcgcctggtgatagctgtgttgtccaatgatagaatcttagttcacgtttaaattggcccacagaaccccgtctaaatccccttgtaaagttgaactgtgtagatccaacagaggatcagctcttttggagcgactaggaaataacctggtagtaagagagtgaacaaagatttagcaagccataggtaggcctgaaaagcaggcagcaagttaagaaagcgttcaagctcgaatgacccactgagcataaaaaatccgcaaaatatataacatgaagtccgtcgacacccaaattggtaccgaagtcgtatcagcctatagaagaagtaccattgtcgagtataagtaacatgaagagattgctcgctccggatagagcctggcgtcaggattaagaaggcactggaacgtgagcaattgtaaccaagcctcaattgatctacaaatcaaccaaccaagtcaattattaccctcactgtccaatccagctagaagggcatgctcataacgggaaaggttgcaaacagtacagcggactcgggaatcttacccccgggtgttaccaggaaagatcacgttctagcatcaccagtattagaggcacgtcgtggccagtgacaccatgtttcactggcgggtacctaaacgggccaggatgcataagcactgttccttaagtgggactggatgatggccccgaggttccgtgctcttacttgagccgtgaattgccgccggaaagcggtacaagagagggaacctatggcttatttaggggacaggccacaaaagcgggctaagcacaggggaacgggggggcgggaaccacccggggggtaaaacgagggagaaaggaagaggggccgcagagcaatacaaaaagagagggcaagaaagaaatagcacagcgcgacaccn

SEQ ID NO: 537911 - DNA, 1060 bp, Homo sapiens
  misc_feature (1)..(1): n is a, c, g, or t
naaatagttagatacatagcaacttatgtggtttcggtctcacccgttctcgttgcctggtctcttattcctgcatggtccacgtctttgtacacaactttcaaccgtgtctcttattcgtgccgggtcattttaagcctaggctccagtggtatagaacatagttgcctatgggctcactcacagcatatggcattaagcagactatgcaggttcttgtccaccagctttggatggattttcctctcggaccttatgactgcctctagcctttccaggtgaagtactcaatgagcaactccatgtgcatacaggcgatagaacccccagcctttaagggaataaccaatgcacccattccaaagggcatgaagaggaaccacctcagatatgaaccactatcaggaaacgataagccagtcatcataaacagctcttaggaaatcaaaggaagcaagaagctaagaaagtctgcaaagcaggaagcaagaagtgacatagagtccagattaggcacctgactcctgccccacagagcacaccacgaaacaacgtgtctctcagtcaatttctggggaccctgagatagacgaagataatctagaacctataagtaagaaactgagaagcaatcgaactactgaaagaacaagcagcaactggaaaacagctagtattaataatcagttggagataaattcagaaagaaacagcccttctccaggagctggaagatttggaattgggtatttaaagattcacggggaagcaagttgatgatccagaaatcaggcaaacacatcttgctgttaaacccattggtatacagcagaatattcctggcccacacttaatgtcaatctataattttaaccatttatcctagattctagtaagtgtaaaattatttaataatgtctattaaacttgatatttatatcttgcatcctatatcatgtcaatatgtgatatagaaaagagatacgtgaattttttagctaagctgacagattgtaacacagtgtcattcttttgagaggtaactcttacatgtaactat

SEQ ID NO: 537912 - DNA, 176 bp, Homo sapiens
gcggacagctttctaaagtagtgagtaggatgtactcgtttcaggtcatcatctcagtgaatgtttcaataaagatgaagaaatgtgtgtgatctttaataacacatccctatagaaagtggataaaagatataccaaacctgtaatacagatatatacaaatataggggcctttt

SEQ ID NO: 537913 - DNA, 416 bp, Homo sapiens
  misc_feature (416)..(416): n is a, c, g, or t
cagaaatcaaattggcgagagcagttgaagaagtgacgttattggtacctgcggcagagcgagatgacagcctgacgaagatgcagctgatggagctagcgattctgaatggcacctacagagatgccagcattagatcaccataccttgccttatctgttgcagcaacagtccaggctgctccaaggatcattactgggcctgcgccggttctcccaccagctgccctgcgtactcctacgccagctggccctaccataatgcctttgatcagacacatacagaccgcttgcatgctcaacggaactcctgacccaactgctgcaatagttcctccagggcccgaagctggatcgctatacgccctatgagtacccctacacagtggcaccacctacatcgatacttgagttccn

SEQ ID NO: 537914 - DNA, 468 bp, Homo sapiens
ttccccaggcagcatgtgaggctggggtggcactcgacacaggacagcaggcaaggacatgcccccctccaggctgagggtcttgggagcctcccctcccagcccctgctgtggcctccccctgggccctggcatgggaggagttaagctgccgcgggcaccttggcacattgcgctgcccagagtgtccggctccccacccccactgcttttcttcctttttgcctttttccttcttaattaatcatacgctgctgcccaatttaaatatggaaatgcccaggccgaggcgatgcaattattcatgagggccgggcggctgtccggggctctcgggctgtggggagtaccgtggcatcgcctccgttctgatgtgtgtgaaattatgtgcacaaaaggcgcctccttatctgggagtgtgaactaaataaataaataagggcttttgtttgtttgccggctcctgca

SEQ ID NO: 537915 - DNA, 155 bp, Homo sapiens
  misc_feature (2)..(2): n is a, c, g, or t
  misc_feature (152)..(152): n is a, c, g, or t
cnaggcgactcagaggatccccgccgccgtgtttgtcactccgacctgctcactatgatgccggatggaacctttgggattgacccccaccaacaacctgaaccgctttgtgtcaggctgctaccctgctgtgagtgggggtacccgagccntca

SEQ ID NO: 537916 - DNA, 378 bp, Homo sapiens
cacgaggggacctggaaaatgggccggcatgtcgccttgagctcttcggagagggtgccgtaggtggcctcggaagtgagaatctgctccgggcttgccatatcgctcaggtaggcggccaggttcacggtatcgccaaagatgtcccgcccctcctccatcagatccccgtaatggatcccgatgtggagtcgcaccttctccccggcacagggctggctcgccgcctgccgctgcaggacgccggccgcgcggagcgcctggtccgcggagggaaagacgctcaaggcggcgtcccccaccgccttgaccagccggccgccatgctcctgggtgacccgggcgctccgctgcacgaaggcttccaccaccgcgcgg

SEQ ID NO: 537917 - DNA, 134 bp, Homo sapiens
gcccccaaccatcaccacggcggccccccagcgcgtgctcagcgctccacgggctggctgcctgctgcacgccaggccagggcgctgatccacgcagtgtctggcgcttcgtcaaagtgctcggcaaggtcagg

SEQ ID NO: 537918 - DNA, 318 bp, Homo sapiens
ccaatatccactgttctgcagcctccgctgttgatacccaggcaaacggtctggagtggatctccagcaaactccaacagacctgcagctgagggtcctgactgttggggggaaactaacaaacagaaagacaccacaccaaacccatctgtatgtcacatcatcaaagacaaggtagataaaccacacgatagggaaaacagacagaaactggaactttaaatcaggtccttctctcaggattgcagctctcacagcacagacaagctgacagatgcttgcgatggaagagctcagtgtcactcactctaggagagt

SEQ ID NO: 537919 - DNA, 322 bp, Homo sapiens
aattcccttttttccaattttaaaattttggcttcaccccttgcccccaggaggggttgctcccgcatgagcttttggccttccatagattttatttttcccggggggccaggcggagaataaatggtccccccaagccctttttttggttttggtttttcccccctgaaggggggggtgggttttcctttaggtttggacccgggctttttcccagttggaaagttttgcctttttaagggcccttgttgtaagggggggtttcctaacccctccccgatgcgattttccctttgttgaatttgttttaccccttggccca

SEQ ID NO: 537920 - DNA, 797 bp, Homo sapiens
ttttattaacatagtttctcatggcacactcggtgttgaaaaaagtggtctagcagtggtctagttggcttcgactgagtgcggcactggtcctggtttatccatttggagacacaagtcgtaactatgttaaaatcctccagagttcagggagtgaagcactcaaattccagcctacaagaaagaggttgagggccagacccagggaaagagatgatgagatggacaaatgcagcctcctgaggctgctgtgcatgacccccgctgcagccaaggaggcttccacactgaaccaggaggctagcagactcataggactggcacataggggaggagcaaaaccaaggcatcggccaaaagcatccaatgtggagctgaactaccacatttcagggcctgcaaagagaaaattagtgaggatattagtattgatgcattctttcagtgcagagggcattaaaacctaggattaactggcctcttggggccagaagactaattctgagaaaataagaaagggatgggaactagatttacctccaaaccaagtgttttctcctttcaatttgccgtagttaataaattaatattgctgttttactaatagttatatgacaataaaaatgcataagctagcacctggtaggcttaacaaaaaaccttttttagggtattgttaatcttcattggtttcattttaaacattttaaatttaggccctggcaagtacgcatggggttgaaaggagaaccactgaagtttgagggaagtgccagttgcaacagcaatgtgcgaat

SEQ ID NO: 537921 - DNA, 490 bp, Homo sapiens
tggccaggagtaagtttagttttggcattttaccctcttggtttctgtccttgggactgagagggcggtagggaagtaattagccttgtgaatagaggggtcaagggaaacacaatcctcggtccagggacatagaagagggggaaccaagagaggacggccactggagtggggggcgggatgcttcacccggtggtcggactggccacaggcagctggtcagaaccagggggccccggccgggtggacggtgggcaattcccacaggggggtcgggaggtgggagtgggagggagctgtaggaggagtgtgtggtagggggaagagctagatggagaagaggaacctaatcagacttaggtgggccacccttatgagggggggatgtggatcacactcgggtgtgacaggggaggggcagaagagcgatgcacagtgcccaggcatgaacagcagcagttcagagggcggggggaacctaggcatgata

SEQ ID NO: 537922 - DNA, 493 bp, Homo sapiens
tgagaagccacatgtgattgagattttgtgtatttaaatgttctcaattcagtgaagcaaacttcgagttcagcaattattataagctggttatagatgtacaaagttttgtcttatgtagtgcgccatttataacatgaacttgttcaccactagcattgtgtagtgaaaattaaataatagaaaacaaagcaaatgacatgaagaaaaccaagcaatttaccatttaggccaccacacacacgcacacatgcactctatacttgtaaaacattgactttcatcttccacctattgtaaaatcatttaagatgcagcaaccaaagtgacatgcttttggactgaacgtttttcttaactattaccactactaacactttaaaccactgttttagtcctaaaacaaatgtgttgaaaagattttgtattgtgtaatgtgtttttttttaatctttatgacactacaataaacctgtttttatatttgctttta

SEQ ID NO: 537923 - DNA, 294 bp, Homo sapiens
  misc_feature (156)..(156): n is a, c, g, or t
  misc_feature (240)..(241): n is a, c, g, or t
actctacaggatcttacccggcacacttggcaggcgcagagtagaaccagtgactgcctgaaatctttgggctccaggatgacggctccctctctgtcatcctcccacactctcttctgcccatcccttcttccatggatgggaggatcccgttgnacccgtgccgtctttcttgagctttgtaactggtaaatagagtctgcaaagattcctgctagagcctagaaagattttgctctnnttctttgcgtggtagctatgtgtgtgttcccggggtcctgggtacctgagctc

SEQ ID NO: 537924 - DNA, 110 bp, Homo sapiens
atcagctatgtacgactatctacattatatagaaatatagactctagttacttataacacacatctttttcccttggataaataactcataaaaatatctagtatacatg

SEQ ID NO: 537925 - DNA, 390 bp, Homo sapiens
agaaaactgagctagagacttaacttttgcccgccatttgatcctattacgaaaacatgaatgcaaaaccgacacccatgtccgagcttattcttgttgcagtgaaacttctagttccacagactgtgcatgctgccttctataacccagtgtagctgcatcagcctgtttatcaacgctcataccaactaaaattcatgcttacctactgtgggagaataactgtaaccagccttaactcatactatatcatttggcatttgataatggatatattctgattgtcatatcaagaccgaatactgaatgtcatcccattctttatgacatcctttcatggaattggtactagagcattgcttgcgtatacattgacttgtgatagtcatc

SEQ ID NO: 537926 - DNA, 184 bp, Homo sapiens
cgctggagtggggctggcaactctttgtaaaggaagttctttcagtaacgatgcccctgcttgtctttgtctcttttttgtttaccacggtacccttgtttgttacccccggtacactttttgtttcccctacgcttttttttacacactttttttatatccctctgggaaacagtcattcata

SEQ ID NO: 537927 - DNA, 135 bp, Homo sapiens
agatgactctaaggatcccggctttcgatcttcctggtcgatatgcgcgaggggtcggaagggcatgacgatcaagccgatccgcacgatgatgaaccattcgacgaccgaggtgttcttcgacgacatgcgcat

SEQ ID NO: 537928 - DNA, 157 bp, Homo sapiens
ccgggggccccaaaattgtttttgggggcccccggggggtgggggggggaatttggggggggggggggatttttggggggtttttttttttcccctttggttccccccctggcccctttttttttttggggggcccccctaggggggtcccccccca

SEQ ID NO: 537929 - DNA, 399 bp, Homo sapiens
cataatgaaaatgggcaccggacctccctgaaggacaaacgaagccttccattcatcccgaagttcatcgaagctttggcaacagcctgataacgggagcgtgaaggtatcatccttaggtaaaatcagatcaataccgggaaaggcagctatgtagagtaggccgttaaataacaaggactttagtacacggaggcatttaagtaagatagcaaacatgctggatcactgcggtgtaaagccaggtccagtagaactttaatcggtcaccacaagaaccttaaatatcggctgcaacattggtatgtcatgatgcaacatgtaggtcggaatccctattgttgacatgaactatagaatacgctatcgctctctctctctctctctctctctctctct

SEQ ID NO: 537930 - DNA, 793 bp, Homo sapiens
aattggcttcattcagagaggtgctgcaggaattgtcgtgtggcaccgtgcttgggaccgcagatggcccgcccatggagcagctgggcttctctgctcaggtgattatcctggaccctccggcccacattagcgcccgggtatgcccctgtgtattggattgcccacaccggcctcaccttgcacgcccagtttgctgagctgaagggaaagagttgtgtccgcccgttttggtaaaagctggagagatggccctcaattcttgaagtctggtgatgctgcccttgttgatatggttccctggccagccccatgtgtgttgagagcttctccagactatcccccctttgggtcgctttgctgttcgtgatatgagcccagcaccagtttcggtgggtgtctatcgcggccgtggaccagaaggctgctggagctggccaggtccacccagtctgccccgaaagcctcacgaaggctataatggatattatccctctatacctgccacccccaccttcttcatcacgtggtggaagaacggttctcacgaacctgtttgtttccattggccctttaagtttagtagtataaagactggtttatgatgacccatgcactcgtaaaccctctcacgaaggaaaggagaatagttttgtggacccctttggttttcttttttgcgtgtggccgttttaagattattagatttttaaaatcagtactttttaatggaaaccacttgaccccaaatttgtcaccagaattttgagaccccattaaaaaagtttaatga

SEQ ID NO: 537931 - DNA, 104 bp, Homo sapiens
gagatatccacttgactcctccgagagctggtcaaatcacaaactggtccttggttgaactttagtgagggtcaattcgggctttagtgagggttaattgggcg

SEQ ID NO: 537932 - DNA, 156 bp, Homo sapiens
cttccttcctcctactctcactcctgaaaatttagctaagaatataaaccatttaaatcattggaatccataaaggaaaagattactctttgactacataaaatatacgactcatatgccataagtctttacaaagtcaaaagatatggcagactt

SEQ ID NO: 537933 - DNA, 1058 bp, Homo sapiens
gtgctggcttccccttcgccttctgccgtcatttgacaggaaattaggatgagcacgagcaaagtcggtggtcacaagggagcagccaggccagtcctgcttaaactcctgctgttacatgtttgcgattgaactcgtagcaagctgccgatggaacacaacctgcctccggcacagacgccgatcttcaatcccttctccccagcaccggtgacagccctagtcatccttcaaggcccagttcaaatgcctccatctccataccatttcagttcgtggttggggataggagctcccgtcgcgatcgtcatctttctgctgcagacagattttgtttccctctgtaaagttggagtgcaggggacaaggctctgaacatagcatttaagtgacagagatggttgtggtcatgtcccagtatgtatttatctatctcctgctccagtaaatgtcacactccccggggcagcgagggtgtcaccatctcggtgtccccacagcacctagcacagtctcccagacgatccagggcagacccttcgcatgggaacgcaagtccctgtttgtccgggtcactcaggtttacgcctattgtcctgtaattatttatgcaccctcttttgctgtcataggtgttgggttggaacagtcaccctatttagcacacacctattaagccaaagcaccttagtgtgtaggcttccctcacccaaacctgttcccaaaggtcctttctcaccggctactttgggggccccagtaatcttcccgacccctctggtcagggccagagtggggagcaagtgtctaaagcaaggccttcaacaaggtcccttccctgagagactcagtttgtgacgcttgtgattgtgaagctcaaatggattatgtgactccacataactctgcaaactgtggtgcgccctattattgccgtttaacttgtcagtgtcggttctgcacccctgcaggctctgtaggggctggagaagaacacttgatttggaatttcggtaatagccagtgagctaagaaccacataaaataatgcagatcat

SEQ ID NO: 537934 - DNA, 270 bp, Homo sapiens
ctaaggatccctcccaggataggatactggcagttgtgtggcgtgtgcacactcgatcaagatctgttgcagctccttccatcctcttgcagaatgtagcctttcgggcatgaacacgggtatagctcccttcgtgtgtttttgcgagataaagattgcagcgattctgggagccatggttgcaactcgtgcagactctacacaaggaagtcccatgttatatcttggacgtgtacccagattttacaaactgcagatgatatgatcctt

SEQ ID NO: 537935 - DNA, 179 bp, Homo sapiens
aattgagctcggtacctgacacactggggatctccctgttcggggctcctggctagctctgcatgacttccgtctgccagctctcctgatactcgggatcctcaggacgcagtgtcacattcacctgtgggcagagggacagtgtcagacacccaggcccaccccagagaccctccatg

SEQ ID NO: 537936 - DNA, 1129 bp, Homo sapiens
gtggaagaggtgggggcgggacgggaggggcggcgagcccccgggagcctgggcgttaggcccgggcgtggcggggccccggcggcctggggggtctcctgggcccccccccacccatggagccctgccgccctggatggtctggtctcagatgactgaacttgggcacctgagctgcccctgtgttgtccctcgtcagtggacttgactgcctgctggggtgctgacgctatgcctgggtctcctgtgcctctccgcggggatccagatgccctcctgtggggcttgcttggccggaggtgtctgaggcggctgcggccatggctcacctccggggattttgccaaccagcttaaaacaaggtcccctgtgtaggatgacatacattgccacgatccttgcggggagattctgaagggcctggattatctgcacctccgaactgcaagaattccaccggaggacattcaaaggcctgccaaccgtgcttacttctcggacccaggggttgactgtgcacgctggcggaccttttggggcgtagacagggccagcttcactagaccacgccatgacttcctcgacgggaactaccatttcgctgggtgcacctctccgttctgggatgtggcacccttgacgtgtccatccacaggccagcgtctgtgcctacacgactttcactacgggcatgactgatccttgtgtccccctgggtgattcaacaggcacgtccgtagcttggccaaaggggggaggctctcagcgaaacatttttgaccttcctaatccccattagcgtcctgttcctagtttcccttgattttcccaaaggaacatcatgacccaaccccatacgtgggtatggtggcccagtcaacaagtgaacgtgcgccccttcaaagggaagttaccgctggggatggtgccttgccttctaaccgatatgtacccccccaggaatttccatggggctcacgggtcctgtggaaggatctcgttgactgcacccacagtttctcttttcctattgccttcacgccactgtaagtgccccttcgtttcctttacacggactcatatttcgaccgtgctaattacacgtttgagacgtcacgctgtgcgcgag

SEQ ID NO: 537937 - DNA, 350 bp, Homo sapiens
  misc_feature (79)..(79): n is a, c, g, or t
  misc_feature (145)..(145): n is a, c, g, or t
  misc_feature (156)..(156): n is a, c, g, or t
  misc_feature (310)..(310): n is a, c, g, or t
  misc_feature (318)..(318): n is a, c, g, or t
  misc_feature (347)..(347): n is a, c, g, or t
tgccttttgttgtcatgcattttgagttgaagtgttcctttcctgcctttgtcaggcagttacccttttcaagcaattnaaagtgacaaaaatactgtaatcccagcactttgggaggctgaggtgggtggattgcttgaacccnggagttcaagnccagcctgagcaacatagtaggacacagtatctataaaaaaataacaaaaattagccagacatggtggctcgtgcctgtaattccagctactctggaagcttaggtgggaggtattgcttgagcctgggctgtcgaggctgcagtgagcctagntcatgccnctgtgcttgagcctgggtgacagagagtnaca

SEQ ID NO: 537938 - DNA, 927 bp, Homo sapiens
  misc_feature (123)..(123): n is a, c, g, or t
  misc_feature (138)..(138): n is a, c, g, or t
actagttctagatcgcgagcggccgagcaggcggagcggctacgaacgacatggcctccgctatgaaggcggtgacagagctgaatgaacctctctccaatgaagatcgaaatctcctctctntggcctacaagaatntggttggtgccaggcgatcttcctggagggtcattagcagcattgagcagaaaaccatggctgatggaaacgaaaagaaattggagaaagttaaagcttaccgggagaagattgagaaggagctggagacagttttgcaatgatgtcctgtctctgcttgacaagttcctgatcaagaactgcaatgatttccagtatgagagcaaggtgttttacctgaaaatgaagggtgatactacgtatacagcgactctgctagggggtcccttcatttccagaggtcgcttctggggagaagacctgacaggtggcccgaagcgttctgagcgctgtctcacaaggagaggctttgcactagtcagcaaagaggctgatgactccccacgcatcccatcgcggtgggcctggcctcagccttctccgtgttctactatgaagatcccagaattgcagctgaggcaagcctgcctcttaggcaaaccacgccttcgacgcatgccataagctgaggcaggaaaaccctaaaacgagggatacctataaagggacaccacgctgatcatgcagacgcgcggagaacaaccctccccctgacaaggaaagcaggatgaaaggccggcaagcgacccgaggacctccgtcccgcgacatcagccagcgacagccacaccagatcaacacggcccaaccgaacgacaagacacagcagaaagcgcgacgagcaaccaaacacgcggagagggcaaaaacgaccacaaacgcaggaagaaacaacaatcaaagatacaa

SEQ ID NO: 537939 - DNA, 296 bp, Homo sapiens
actccatcaagttgtatttcattggatatatgtgtctgcactacagaaattaacacttttcatatacatggcatcatagaacatgtaaaccttttctgtgctgctactagcttttaaaattgtaattttaaatacttgaagatgatttctcttggttaacgcataaagacattgcatttatattacatggccatttcccgataaaacactagacatcaggtggtttcaatattttgggtattatgcttcagatttcaaagacaccttggagcatttaaattttgggcgtcacgggg

SEQ ID NO: 537940 - DNA, 105 bp, Homo sapiens
ccttcatctaataactgcttattatcatcaatgattccaactcagatgggacaaggaaaaacttgaaccactaaatttgccagcaattccagttaacaggcttac

SEQ ID NO: 537941 - DNA, 1125 bp, Homo sapiens
  misc_feature (76)..(76): n is a, c, g, or t
  misc_feature (82)..(82): n is a, c, g, or t
  misc_feature (84)..(85): n is a, c, g, or t
  misc_feature (90)..(90): n is a, c, g, or t
  misc_feature (104)..(104): n is a, c, g, or t
  misc_feature (111)..(111): n is a, c, g, or t
  misc_feature (449)..(449): n is a, c, g, or t
gacccatgacctgcaggagatgaaggaagagagtcggcagatgatgcgggagaagaaggtcaccatcctggagctnttccgntnncccgnctaccgcagccatnctatcgntgtggtgctgcaggtgatcccagacagactgatctggcagtcaacagctggtcttctagtgtactgccaacgacgcgatctctcgagaaggcgggtggtgcatgcgagccatgtgtaatgccagccagtaggcatccggatatcgtgtcagacagggccattcaactgctcaggtgtcgcctgatattgatgagtggaagctgagcagagccgtgctggaccctgacagcctcagtagggccttcgctgggcattggcgtggattgtcgccatagcttcatgagccatcgcgcctagccacctgctcggagacagactagcccgtggatgttcctatncttgaccatgcgtgcgccactcttgggctctcagtggcctctctgtggaacgtgggctcctgtgccccattgccactggattcagtcgttggtctgaacctcttcaggccagggtccacggttcatgctgactattgccagtggcgggctttcagtccaagttggactctcaagagttccactcgagggcagtgctgcgatcccagatatgtggaagcaaagtgatgtggaacccgtacgatctctcatcagtctttcacctagtgcatccgtgggtacctgattcttatcactactgctacctaactttcaagaggttccttgagcaacgttaaggccggaaccttcggatcgaggatcggttccgggtgcccggcaagggggggagccagtccaagagttgactaggacaatcctggaggagcttagtcaatcaccttggagtagcttgattcccaaagtgtagagtccgcccccaaatttacacccaggccccgggcttggtccccaacacagacctaaaggatactctctgcaggaaactaacaggatcaatggattggcaaatctacaagaagctggacagacagtacgcggcgactggtgctggggacacctttctctccagcaaccaatagatgcccaaagaacgtgtagcgcaggaaagggcacacga

SEQ ID NO: 537942 - DNA, 862 bp, Homo sapiens
  misc_feature (473)..(473): n is a, c, g, or t
gaagggacccgtggtctcagctacagcacagatcaccatcatgaagtttctcacgttggctctggtttacttgctccttggtcctgagatgtcaagcagccagaagtcgttcttttctgttgccgttccgacggagagcttttgagtgtgtggcttcgtggatcatgtgtgatgaatgcctactctgactagtgtatcagacatccaacttaacatcggcttcagatcaaagtacttccattgcctcggggagaactatgaatgctgaccaatatatggaggaccctggcggctagcctgggccgcatgaaggtgatcagcactgctgagataagatccgagagattcttttcgtgccgagtgtgatgctgcatggactctacttgggcctcagatctagagtctcgtccagaatgacactggcgtgcagaggagattggcggtagtaccccgactcatgttccggacctgcntggtctgccgtgagaaattactgaggcttcctcttgcattcttgactctcagtgagatctgggtcgtggaggagcactacagggtatagtggagtaacatagatgcggggggatgaggtgtaatcgtaaatggtgtattttactaaattattgaacagtggatagattaaaaggcatttttggtattctgtaattgcatatagtaactgtttgaaatggcccttttagtgagtgcgtgggagtaatctaagtaagtttaatatgaccagttattatacagtgttcatatggaatgattcttggcattacgaatgtgtgtgggaattttcgtcattttcatagaaaagcggggtgtgtacctctggttttttcttactactacttctgtg

SEQ ID NO: 537943 - DNA, 143 bp, Homo sapiens
ctaggcaacatgtatactgatgtaaactaggtatttgtgtaatctaatgctatgtagcaacagtcatctggtatttggttggcgcgcagagattttccataatcatcaagacaagtgtatgtactgtgatctaaatgcaatca

SEQ ID NO: 537944 - DNA, 294 bp, Homo sapiens
ttttttggcccccccaggggtttccctgggccccttttgtaaagggccttggccccggggcttttttggcgggggtttttttaggggttttcccaggcccacgggggttcccctcgggggaaaaactggcccccagaacccccgcccctgttttcccaagggattcccggtttttttggtaattttgtggggccggttgtttttgggtttttttttgggttcccctttccggggcccccaattttggtttccgggggggttttttttgttaaggggttttaaatttttacttta

SEQ ID NO: 537945 - DNA, 102 bp, Homo sapiens
ggggtctagaggatccgacagcatcctaaccagaggtggggtgacactcatctggactcagacatataagaagcctatataaatcaagacaagcaacaaacc

SEQ ID NO: 537946 - DNA, 468 bp, Homo sapiens
gagatacatagtagattctggttattagtccttttacagatatatagattgtcaagattttctcctctgtgggttgtctgtttactctgctgacttccttgtgccgtgcaaaagcttttagtttaattaagccccaactattatctttgtttttattgcatttgcttttgggttcttggccatgaaatccttgcctaagccaatgtctagaagggtttttcattgttatcttctagaatttttatagtttcaggttttagatttaagtccttaatccatcttgagttgatttttgtataaggtgagagatgaggatccaatttcattctcctacatgtggctagccaattatcccagcaccatttgttgaaaagggtgtctattccccgcttacgtttttgtttcctttgttgaagatcagttggctgtaagtatttgagtttacttctgggttctctattctgttcc

SEQ ID NO: 537947 - DNA, 212 bp, Homo sapiens
attagagggcagcacgactgctcacgtgtcgacggaacttgtacagggaggcatgcaccgcagtggtgaatacacgtcgacctggctccatgtatacaatattgggacatcatcaaggatctcatatatctaaggaacttgtataggaagttatgcatggccgtcgtgaatacacgtcgagctggaggcatgcatgcatactcttggtactg

SEQ ID NO: 537948 - DNA, 391 bp, Homo sapiens
  misc_feature (145)..(145): n is a, c, g, or t
tataaaatagctattatataagctataaaatagatttcttgtgtattttatgtaatatacattattgtagaatatctattattaattttcgggggcttcaatggcaaaagactttggggccaagggttgccgcttcgggtaaggngcaaaggcaaaggggtggtgggggggcgtgggttggtgtgtgtggcggggggtgtgtggggggggtttgttgtggggtggggtggggttggcggggtcgggggtttgttcgttaattagtcttatctaatctcttctgttttttcaaatgaaatctagaataattttaacaagttgcaaaagcaacctcattcgtattttatttggatctcatacctgtaattcatgagaatgaaaaggtattctt

SEQ ID NO: 537949 - DNA, 259 bp, Homo sapiens
  misc_feature (61)..(61): n is a, c, g, or t
cgggtaagatcgatggcgctgaggataggaggatgaaaaggaaaaattcaaagacgctggnatttttttctgtttctggttaattgctaaaatctacagtgtgctgaaggtggagtaaagtatttccgggggaggagggcaagcacatctcccttgcccttgaatatctgtatatctatatgaacatcaattgagatatatatgtgtgtgcccctaattacataattttaagcatatatatataaaaatgtaaaatctc

SEQ ID NO: 537950 - DNA, 111 bp, Homo sapiens
atactctaactgttatatggccggagggggcctggtgtgttcttgtgaaaagggctggagcagagtgagcaacgacggacagtagtgagaggaagtcagagagataggagg

SEQ ID NO: 537951 - DNA, 417 bp, Homo sapiens
ccccttcacaagtgttgccttcatccctatggcaagagctccaccagcggcggcgagatggttcgtcccgttcccattacttcgacccccagtactttgaatttgagtttgaggcttaaaaagctggatctcctgccgggcgtggtgggtcatgcctgtaatccccccccttttttttttaaggcaggcggatcccctgaggtcaggggtttaagacccccctgccccccatggagaaccctcgtttttcctaaaaatacaaaaattagcccggcatggtggcccccccctatagtcccccctcctccgggggttgaggccggagaatccctttaaccccggaggcaaaggttccagttaactgagatcccgtccttgccccccctcctgagccccaaagggcaaaaccccgtccca

SEQ ID NO: 537952 - DNA, 1026 bp, Homo sapiens
tggcaaaggggaagtttaagggggaccatcacgggtgataccccatcaccagaagtcccaggtgggaggccccaggttcgggccgcctctcccagagagtgtggggcctgtggaagaagaagcaccagcaccaccttcccaattttcccgtggggttatggcttttggccccgtgtgtgcctcccaaccccagaggaaagctacaagaagaacgaggcgtgtccgtgtccccaacactctcccgtgggttccgtgggaacctccctgtgtccgtgagggcgctagaggtgagcctgtggggccagagagagggcccttccccgcagagggacaccacaccaatccttcttccctgtgtgtgttacccctgtgacccccacaaacaacgtgaagcgggaaagtgctcttgggtgctccctgtgtgatctccttctgtgcccgaggggcgcccacactgtgcagcgcgtgccaaacccccagagggagtccggggggtgtgagacaacggcggctctgaggaggcggggaggacaacgggggcggggcggccacaaaaaaaaacacgcatggtgacaaaaaggggaacgtggctggatggcattgcgcaaaagagagcaaccacgagcaaccacagcagtctgggagagcccaccccctgcgccaagcaactcatcttaaagaagcgagcacccaacgcattgaagaggcgagaggcgccacaaccacaataaagcgagggcattggagagggggaggcaccccagtgtgcccccccggggagcgcgacgcgcacactcggtgcaccacgatggtgagcgttggacgcacacacggaggggagacaaaggggacacacaaggacagtgccacaagggtagtgtaggacacaccaagagaagcacaccgtaggggtaggtctgatagacagggtagctcagggagccccccagacaggggtacccgtgccagagagccgacaaccaacaaaaaacgtccacggagggagagcgaacggtgagttaaaga

SEQ ID NO: 537953 - DNA, 725 bp, Homo sapiens
gtggatcccccgggctgcaggctcgtgccgaattcggcacgaggaagcctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccactgctgctgctaccggttctccacaccaactctcacggatgcacagatccctgtggtccgccatcgccgacacacacacacgtcgtaatgtggctaacgcttgactcacttaacactactcatggggcagggcggagggtggattgttgctttttgttttttgtaatttcctactagtatttgggtaactttgggggtggggagggcaatgtgggggcaggggaacatgtcattgtgatgacttttttgatattcattagaaacaatacatcctttctgagatatttacagtattattaaaaaatgaaaatgggttgactgacttgcataatgcacatgtttatggggcattccaaaggtgcacgattgggctgctaactattcttaaaaattatgggatagaaccttccgttgggctatttccaaggcacttaaaagt

SEQ ID NO: 537954 - DNA, 119 bp, Homo sapiens
gcctcctccgcatgcgcccaccagcggggccgggcgggggacccccgcggcgggaccgctctgttcgcgtgcggcgccagctctggcgatgatgcagagtataggggagccagcgaccg

SEQ ID NO: 537955 - DNA, 486 bp, Homo sapiens
ggccccgcgccgccggccggccgcagtggaggccggccccgaggaccggcggctccgggcccgccgcaatccggagggctggttccgcgagacctgcagctgtggccggcaggccctgtcgctgcggtggacaggtgtccaccacggcgctcgcagctaccaggacaatcctcggtcttccgcgagtatggacctatggcaagcgtgcgtgtgtgttggatcgggtgtcatccagtgcacggagagagacgagttctcctaccatggagatgatcgctcaacctgcctctctgcagcagcccaaaccgcgaaaggtgcttgaatcatcgggggcggagatggaggtgtcctgcgggaggtggtgaagcacccctcacggtggagatgcgtgagtccacgtgctgagatcgcatcgagggatgtcgatccacagttctccgaatagaagttcctgtccaggcactgggcataggcatacatcgtacg

SEQ ID NO: 537956 - DNA, 726 bp, Homo sapiens
gtggatcccccgggctgcaggctcgtgccgaattcggcacgaggaagcctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccactgctgctgctaccggttctccacaccaactctcacggatgcacagatccctgtggtccgccatcgccgacacacacacacgtcgtaatgtggctaacgcttgactcacttaacactactcatggggcagggcggagggtggattgttgctttttgttttttgtaatttcctactagtatttgggtaactttgggggtggggagggcaatgtgggggcaggggaacatgtcattgtgatgacttttttgatattcattagaaacaatacatccttttctaaaacttaccatctcattaaaacattaaaatccttttacttcttctcatcatcaacacctgtaattaccatgcaaaaattccaacattccgtacttcctcactcttcactttaacctttcgttaatgcgcacgatcacttcgccatatgaccgtcctcttc

SEQ ID NO: 537957 - DNA, 524 bp, Homo sapiens
gtggatcccccgggctgcaggctcgtgccgaattcggcacgaggaagcctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccactgctgctgctaccggttctccacaccaactctcacggatgcacagatccctgtggtccgccatcgccgacacacacacacgtcgtaatgtggctaacgcttgactcacttaacactactcatggggcagggcggaggggatgtgctttgttttgtattcctactaattgtaacttggggggaggctggggcaggacattatgaatctttaatcaaacatctcttctaccaacccagg

SEQ ID NO: 537958 - DNA, 518 bp, Homo sapiens
acgatggtgatcaagtcctctcatgttacaggaatccgtcgaggaccacttattataatattcagatgaaagaggcaaagccgtgcggctttccagactccttcactttctgcaggccaatttctgtataatctaaagttatactccaatccacaagaacctcttagtacatactgctcttcagaggactcatagtccttcacagcctcaccacagttttttccaaatttgtatgctatatccaagttccgtctgacgttcccactgtacatcatacccatcccagcctttgttctgacactgtatgactgtccggggtataagaatcactaccaggtgttcctccaatacatttcaatctgttgtgatgggatccagcctgtgtgagatggtgtacgcctaataggtgtttcccgcaagaaacaggtatgaccggaccaaacgtcagcgtcgtagaaactggaaattgaaagagcttgcgagagagagagaaaacatggataccagatgatgaaagg

SEQ ID NO: 537959 - DNA, 207 bp, Homo sapiens
aattttgccaccttaacatgtaatagcgtatttgtccaagatgtgaatatagaaactatagcttcagtgtctgctgtaataatattatttaagatgctgctgggcttttcatctttatgaactttatgtcaacagctactacttagaccatatctaaactgctaatgttgctgctactgctgttattggggggatcctcttagagtc

SEQ ID NO: 537960 - DNA, 205 bp, Homo sapiens
gattcatgcactccctgtctccatagctggccattgattggcacactgccatcgttggataagcatcaagaacagacatgaatgggtggttagagtgatatagttaacactattgagaccccttccaagccttcgcatgttaattatcccagtaatctgaacctttctctttaatcctgaagtcttagctataacctctttcctg

SEQ ID NO: 537961 - DNA, 873 bp, Homo sapiens
  misc_feature (694)..(694): n is a, c, g, or t
  misc_feature (873)..(873): n is a, c, g, or t
cttccctgtggtattaacgggttctgtgtgaccctcagatctattgcattgtcctctgttaaatataagaactatataaaacactttcagtaaggaagttgaaattttatctacttctattctagattctatgtgaaagtccagacacatctaataaaataaaatcacacttatataggtagtggcacatttctcaggggtcaaaaattaaaataactgaagaattgcatgatttatgtttaaagtgcagtgtatatgtgtctcatgacagagcaagactctgtctcaaaaaaagaaaaaaaagaaagaactgatggaagtcatcctacaaagggagcttcagcattttctacaaactttgaaacagaaaatctttttacggtgggatttttaagtactaattctgcttctgatatttttcaagacattaagtgaagagagtgaaaatgaaacataaatatgctacacttttaaatatctcactttttaaaaagctgtttgggctacagatggaatttcagtccttttcttatttgtgggaagggcttggtttttaaattgcacagcaatctgaccaaagagcagaaattgtgaatgggggtgaccctggaaggaatggtgtaaattcacctttatgtctttataagcaatactctgggaaaatacattgaacgggatggtttctctcaatgtngaataaaagtctgtgagtgaaggtctaaagggaaatatttgttttacaagcggagttggtgggcagaaacgaggtctgacaatgatactaaaatatggcggctccggtgagaaaatatagggagaggagtatttttgtgcaaaaaaaggtgggggatggtgggggcaataaaggagagn

SEQ ID NO: 537962 - DNA, 312 bp, Homo sapiens
  misc_feature (225)..(225): n is a, c, g, or t
  misc_feature (230)..(230): n is a, c, g, or t
  misc_feature (251)..(251): n is a, c, g, or t
attgctggcctggttctccttggagctgtgaccactggagctgtggtcgctgccgtgatgtggaggaggaagagctcagatagaaaaggagggagttacactctaggctgcaagccagtgacatgtgcccagtggctctgagtgtgtctactcacgagcttgtaagagtgtgagacagcgtgccttggtgtggcgactgagaggcaacgagttgttcctgccctnccctnttgtgacttgagagaaccctngactttgtattctgcaaagggcacctgccatgtgtcgtgtgttacgtgtagacaattgaag

SEQ ID NO: 537963 - DNA, 2642 bp, Homo sapiens
caccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccgaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgaggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaagggagtctggcttttactatctttcttaaaaaaaaaaaaaaagagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgcaaaaaaa

SEQ ID NO: 537964 - DNA, 518 bp, Homo sapiens
  misc_feature (250)..(250): n is a, c, g, or t
  misc_feature (376)..(376): n is a, c, g, or t
  misc_feature (413)..(413): n is a, c, g, or t
  misc_feature (429)..(429): n is a, c, g, or t
  misc_feature (438)..(438): n is a, c, g, or t
  misc_feature (487)..(487): n is a, c, g, or t
  misc_feature (494)..(494): n is a, c, g, or t
tgttgttgttgttgttagttttttccttgaaccatgtgaaaacaagttacagacatggtgctgcttataaacatttcagtgtgtgtttaagaccaaagatatcatcttatgtgatcagagtataattatcaaaatcaggaaatttaatactgaagaaatgctcttatccgcagtctaaattatttcataccagtaatgttccgtatcgctgttgcttcctgatctttcccttccccagcctccagtccangaattcatcctgcatcacacaagtgcatccagttgtcaggcccatcttggcgagacggggtctccctctgtcggcaggctggagttcagaggctctgcttctgtggtccagggtccaactcctggntccagcggtcctcccaactcaggctcctcaaatagcnggggccaaggggtaantgactccanacctgggcaaatttttgaatttttttggtagagacaggggcttgctaangttaaanaggctgggaaggcccatcttccta

SEQ ID NO: 537965 - DNA, 331 bp, Homo sapiens
gtctatcatactgggtaaggagagacaaaacatacaaaaagaacaggcaggcaagcatggtggctcacacctgtaatcccagtactttgggaggccgaagcgggtgggtcacctgaggtcaagtgtttgagaccagcctggccaacatggtgaaattccatctctaataaaaatacaaaaattagctgggagtggtggtgcactcctgtaatcccagctacttggggggctgaggcaggagaatcgcttgaacctgggaggcagaggtcgcagtgaggtgagatcacatcactgcactccagccaggacaatagagcgagactctgactcc

SEQ ID NO: 537966 - DNA, 138 bp, Homo sapiens
ggacacagacgactttacggaacgacgacgacttgaaaaccctcacctaacggacgttagacgacggtaacccggcatttcacgtaacgacgcctcaggcgctacgtctcacatggacagaagacatttcctgactcc

SEQ ID NO: 537967 - DNA, 212 bp, Homo sapiens
tctcacacatgcaaactataaggctgactctgaccagtgcagctcttagatgctcatccagacagagaggatggcatgatccatatgcagagatcaagctaagtgaatgtgagagagaaaaggagaaagaataggcctttggacaccctggaccaaccctccacccgcttcttgtgcccatggaggcctccagggaagttagcaaatccctt

SEQ ID NO: 537968 - DNA, 365 bp, Homo sapiens
  misc_feature (13)..(13): n is a, c, g, or t
  misc_feature (22)..(22): n is a, c, g, or t
  misc_feature (68)..(68): n is a, c, g, or t
  misc_feature (83)..(83): n is a, c, g, or t
  misc_feature (94)..(94): n is a, c, g, or t
  misc_feature (101)..(101): n is a, c, g, or t
  misc_feature (107)..(107): n is a, c, g, or t
  misc_feature (109)..(109): n is a, c, g, or t
  misc_feature (144)..(144): n is a, c, g, or t
  misc_feature (155)..(155): n is a, c, g, or t
  misc_feature (201)..(201): n is a, c, g, or t
  misc_feature (204)..(204): n is a, c, g, or t
  misc_feature (219)..(219): n is a, c, g, or t
  misc_feature (231)..(231): n is a, c, g, or t
  misc_feature (233)..(233): n is a, c, g, or t
  misc_feature (267)..(267): n is a, c, g, or t
  misc_feature (299)..(299): n is a, c, g, or t
  misc_feature (345)..(345): n is a, c, g, or t
tgaggagcctggntgagagggngtgtggtctgccctccttcactttatatatatggattccaggctanagctaaaaaaatttnttttagtttanaccaaanagaaananaaccctttaaaagcaagtttgtgtgttctcacggnaagttcagaanaatggtccctgcctgcagtggagaggaaggggttctgggggcccanaanagggcctactggttntcgtcccgcatntnttccatgatgctgatgaggttctccaggccaaanacgtagcctctgtttggcccatcatgcacggnggggtcatcccggaagcccttgaatgtgctgtgtgcaaagtcaatnatgcggacatccaccttggg

SEQ ID NO: 537969 - DNA, 612 bp, Homo sapiens
ctcagaggatccccgagtctctcccatcagttgtttttaagttttttctgcaacttagattactctgcttattcctgtgaaccaaccagtgatctctggcgtgctgctcacaagaaacaaaaggaatgggtaatgtaaaaatctggatcaatattctaattctgggcacatactggaatcagctagtaaccccaaatcagcttggttccaacagttgcccagttcatggaaaaccttcttatttaatttactggggatagttttgcttattttgctttactgttgaggagtatattgctgttgtactctttgtgtaggaatgcaggataagcttactgaatgttttcttaaactgaacaccttttaatcttccagatatcaccttttgttggagttatgaatagctctcaccatactgatgctttctgactgagctcctctctgaaccctgaatacaagagaccctaagagtcaggcaggaatatcatcgcccctattcaccctgaaaaagttacagaagatggatctttatttctttgtaacccctaggattaagggttctctaataaaagggatgggagaaatgtcagaggtgttctgatgggagcaaga

SEQ ID NO: 537970 - DNA, 1044 bp, Homo sapiens
ccccggatgaaggagatcagtggccagtgacatgtatcagacctccacatgccttttgcgccatcctggtccttgcactgggctacagagacggacacctggtcaacctgcattaatgaatcgggattgaaggagacatcatagctatgaggactgacacaggaatcagtctgcttctctgagcgggcgatacaaggatgacgagcacaatagtcctggagccgggaagtaactcacacacatcacaactacaacctaccagagagacaaaagcgaacaaagagagaacaacgaagaccaacacagccacacacacagggacacaaacagccaacacggaagaacacacacgagactagaaaccacaacaacaaggagacactgaagcatgacacatgacaagacaaagcaaaagccacacaccaaacaccaacagaaaaacaagagaagacaaggctaccagcccaatagacaacgaagcagaataaagacaaaaacaaaaaacaaagaacagacgagacacgaaccacgaccccgacaacacagccagggcagaccacaaaccacaaaaaacaaaaagagcagcgccacgacacacacacaagagaacagaagaacaccggcaacgacaaaacgaaagaaggaacgaaaaacacagcaacgcaaagcaggaaacaaagagaaacagacgcacacaaaacgagaaaaacacgacacgccaaaagaagacacacatccaacacaaacacaagacacgaccaagccaagagacggcagacacacctcagcacagcacaaaaacaaagacacaccagaacccaaacagagcacacaaacacaaaacaacacaacaaccaaacaagaaaagaagaaaagaaaaacaaaaaagccaacaaaaaacaaacaaaaaagaaaacagcaaacacccaacgcacacgaatagaccagcaaaccacacaaagagagacagcacacgaacgcgaagacacacaagacacaaccgcccgcaccacagacaacagcacaataaagaacgcacacaac

SEQ ID NO: 537971 - DNA, 806 bp, Homo sapiens
  misc_feature (9)..(9): n is a, c, g, or t
  misc_feature (115)..(116): n is a, c, g, or t
  misc_feature (118)..(118): n is a, c, g, or t
  misc_feature (128)..(128): n is a, c, g, or t
  misc_feature (144)..(144): n is a, c, g, or t
  misc_feature (171)..(174): n is a, c, g, or t
  misc_feature (195)..(195): n is a, c, g, or t
  misc_feature (221)..(223): n is a, c, g, or t
  misc_feature (241)..(241): n is a, c, g, or t
  misc_feature (267)..(267): n is a, c, g, or t
  misc_feature (269)..(271): n is a, c, g, or t
  misc_feature (285)..(287): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (297)..(297): n is a, c, g, or t
  misc_feature (306)..(306): n is a, c, g, or t
  misc_feature (316)..(316): n is a, c, g, or t
  misc_feature (329)..(329): n is a, c, g, or t
  misc_feature (338)..(338): n is a, c, g, or t
  misc_feature (344)..(344): n is a, c, g, or t
  misc_feature (349)..(349): n is a, c, g, or t
  misc_feature (353)..(353): n is a, c, g, or t
  misc_feature (438)..(438): n is a, c, g, or t
  misc_feature (454)..(454): n is a, c, g, or t
  misc_feature (459)..(459): n is a, c, g, or t
  misc_feature (689)..(689): n is a, c, g, or t
  misc_feature (759)..(759): n is a, c, g, or t
aattaacanatgtgcaagaaggcaataaaaaaagagagaaaaaaacccaaccaaggaaaggcgtgggggggcttagcaacaggggccagggcacacttagcactaattgagatgnntnggtgaataantacaataccaaacggnaggggttcggatgcgttcggaaagggnnnnccccgcctttcccctcaggcnaatgacaaacacaatacaggcagacnnnccagccccccccacttcnccgacttcccacagcccttatatctntnnntccacaagtctatnnntncntncnanacaacatcnaatacaaccntttccacagaacnaggaaatanatttcnaaganaganagattttacagaccccatcttttatacccaccccaacagtctaactctaaagagggtaaagccaatgactttcctcacaagagcncacgactaacgtcgcnttgcnatcaaaatctgtatttctgatccgttatgagcattgagacaagattcaaatattcccaaagaaagaagcacaatgcacgttgtgatcgcctattcagcaacagcgagcactgcatcccaaactctcatcccaggaattaaataaggtcagccacattcatgggcatctcctccactgtagtattgtagaaagtctcaatgtcacgaagaatcctcttgtcttcttcagtnacaaagtttatagccacacctttcctcccaaatcgaccccctctgccaattctgtgaatatagttttcangattggtaggtagatcataatttataacaaagacacttgttgcacat

SEQ ID NO: 537972 - DNA, 126 bp, Homo sapiens
acaactgtacctcccatatgctaccccatgtactgtaaatggcactacattcttctagtatgctcaagtcaaaaagccttgtaaggccgggtgtggtggcccacgcctgtaatcccaacattttgg

SEQ ID NO: 537973 - DNA, 822 bp, Homo sapiens
ggaatgcttgaaagactgcgggactgggcctgtaaggaaggatgcatccagtcccctctgccttgcctccggcgcctgagtcatggggtcgtggagaagggggcgggtggctgattggctcgctgccctgggggcagtagagggggcagtagagggggcagtagaggggccccgcctatctaggggagccgctccgttccactcaccctgcctagcgctggtacccacgggcctgggcaggaatgtttgtaccgcgctcctccccaggggccagagggcaggacgggccggggaggtactacactcttctactcctcgacatctccatcaagacaaggtgagagcggagcgacgcaaggctgcgacactgataacacgcaccgacttcgcaggaagggtggacagagatgggttggacaaccaagacagagacgaggacgaaggaggaaacaacaggacgaacaagacgagagaaaacagcgaacagaagacagagacgacagccagtaagaaagcaaccaacgagacaacagcgaataacaaacagacatagcgccggacggaggcgcaccagagatctcgaaacagcaggaagagagggcggaggcgcacgagtaggaagccacagcaacacggaaggcagcacacagggacaccaccaccaagcaacaaagcacaacagcaccgcacagacgaacacgaagcagaccacagagcgacagcccccgacaacgcaccacaaagaaacacaaaccgagaggacgcaccgcgacgaagaagcacgccacacgacggagccagccgcagcgcccgccccgaggg

SEQ ID NO: 537974 - DNA, 446 bp, Homo sapiens
  misc_feature (41)..(41): n is a, c, g, or t
gagcttcatccttggaaacgggtggcacctattatcccccntgagctgcaggagcggccccatcagtgagcctgattgaaacacactagatttcaggtcatggaaactgggcgttaggatccgtttccctggctgcagagagtggaaggtgtgatgtggaatatcccttctcccagcacaccccaattaatattgaagagtagggcaggagaaggtgctggaaaaaccgggtttcttggcacatgggggtgcaagcactgtggttgaaattggccatgtccaaggcacaccagacgatttcaggtcatttttagccctaaactggaaaggggtcaggggacaggtgacgtgggctcagcccctacaagctcccagcgggccctgtagcgagcgagctcctgatccctgcttttgagggaataagcaaatagaacccaaaataaaaa

SEQ ID NO: 537975 - DNA, 395 bp, Homo sapiens
gggctgcatgaattcagctcgaggtcacactgaccgagagtttcacatggaagaaagcccaacttctccctctggcgtggtacagacacttacccattgaatggacctgactcgaggaccctgaatcggcccactctctgaatgacaccaggccatgagctagagagaactgctcaatgaccatgatcataaactcactggagatctgatcaatgacgcggggctacagactagaggcaatggccccttgaacgacctgcgcactcatgtgcaacggatccaacacatgtgctgtgattccgctaccaacgtgctctcatcaagccaccttgacacatgtgagcgaacaatcgtggatgtgcacctacaagtctacagaggactatgcgttgcgt

SEQ ID NO: 537976 - DNA, 324 bp, Homo sapiens
  misc_feature (10)..(10): n is a, c, g, or t
aaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaa

SEQ ID NO: 537977 - DNA, 756 bp, Homo sapiens
tgaatctggagctgaaggaggaggacttctctgtgtgtggtggagccaggtgtcacccgcgagagccctcaacgcccacctgcgggacaagcgggctctggtttcccgtggacccaggcgcggacgcctctctctgtggcatggcgtgccaccggggcgtcggggaccaactgcgtgtccggctactgtgcgaccgatgctggggacgaagcgtgcgtcaaccctggacggttgcgtgcttgccgcgactgggtgctgtgcttggcttggcacaacggctgtgtgcctcggaggccccgggggcaattttcccgtggcgacatcgaatgttttggccaaggcccctgggccttttagctagaagcgccgttccgaacctggtggtggggcctttacagttttccgcgggtttgggcgctggccatatacccccgggaaagcgcgcgggcgctggaaaccccggcccttttggcgcggggcgcacgttctactgcaaatttttcccaaaagccataaaggggggcgcttcacggaaaagcagagccataaaaatacacgcgaccactttttttggtccgcgtgtgacccccaccctttttttttggccagcagaagaagccccgcgaccccctgctttttgggatgcgaccccgctgcccgcccgcccttttttttgcgacagacacggtgcggcggacgacgtccagagaaaagcactacaaaaacgctgctattttatcgggcgacgcccaacgg

SEQ ID NO: 537978 - DNA, 339 bp, Homo sapiens
gtcaaaggcaaagccagagtgcagtttggagcatataagatcaatataatctagcaagagcccaaccaatcctataattccattgtacagatacatgagaaaaatggctggtacacccttccaaaggaggatggctaattatgttgactgttgtatgtttggactaatgtggctttaaggaaaatcttccaacatgacagacaaaggctgtgagtcccctatcacagcagtcccgagatgtgagtgatagatattagagtggatatctctcatctcacatcgtagtataggtacagcctgcgcattgctgctcattagagatatcggcgactgcagcag

SEQ ID NO: 537979 - DNA, 2403 bp, Homo sapiens
gcttggaagagacgctgtttcattctgactgcactgcctttttctacttgaggtatacacgaataaggagccccgtgaatcatcctttagagaatctgagtatcgggaaagtgaaggctccaaaaaaccaactgcttttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcggttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaa

SEQ ID NO: 537980 - DNA, 340 bp, Homo sapiens
  misc_feature (165)..(165): n is a, c, g, or t
acgcacgggtgatgcggttgatggtgatgggagcaggtaatgtggcatatccctaaaaagaaggagccttgagctcctgaagggctgggccaaggtcagtgggcaaggacaggattatatccttcagctctggggccttcgggggtagtaaagaagagttcaccnttgagggacacatctccattacgcatggccctttccctttctgtgcctggtggacaacttgattcctcctgattttgtgtacgttctgacacaaagtgactacgcggtgcttgtcgttttttccttccactcatgacaggcacaggttcaacagacaagggcgaatgggggccag

SEQ ID NO: 537981 - DNA, 2808 bp, Homo sapiens
cagacatagggttgtggtgttgccagtccactgcaggtgctccagcccgcggcgcggcctgcgctgctgtctttgaggctgtagcacaagcatgagctcgggccccctccctgtgcaccggagacccagccaggtccagccggtctgtccatggtgccccaccagcagcatcgtgctgggcagtgccgcctgcagagtcatggagccttagttactgagcaggtgcacgtggggggcttggaaggccccactgcattaccatgccagctatcacacaccccgtgccagaggactgcatgtgacacggcttgattacgtggcactcgctgctgcaaagcaaagtcagatgtcatcatggaaactcaagcaccagtctttttctctgaattggaatatagctgtaagaatgtggtatgattctgttcctaaatgtgaattgattattatgttgaaacaggtaaaaaccccaaaattttcttgtcacgtgttcctgtgtctctttcgaagtgtgtcaccttaggtcactgtgtggacacagcaagggtggaggacgctaacttggcctttgcagtgatggtggggtgggacaggtgttctggggcacgaggggccctgagaatcccctgcctgggtgtgtttcttctgattctgtccctcacgtctctgttttctcccttttctgtgctccagagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcggttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaa

SEQ ID NO: 537982 - DNA, 610 bp, Homo sapiens
tcagggatgcccattgaaaagttatttcctgatgcccattagactgagatttgaagaccattccagccaggataatgaccatagtcccaagtcttgccagccttttccagaaatatgggaatgatccagattccctttagctcctgaccaccaggccgagcgaactcacgcacgatgggagggggattcttttccggtgtgctcaccacgctttatactggagtggcaagtggtcctgctcgtctatcacctggagcccgcccgggaatctgacaccgacctcctggtccaaccaggctgtggcccaatggacggcggaagaagttgtcctctggctggagcagctgggcccctgggcatctctttacacgggaaaggtttttatctgaacgagtaaatggaaggtgaggagccaagtcttctgacaccccgtggacattttagaaaaccgctttcttgagatataatcccggcccggccggtggctcacacctggatccccagccctttgggaggccgaggcggatcgatcatttgaggtcaggagttcccagacccgcctgacccatatgatgaaccccctctctactaaaaataccaaaaaaaaaaa

SEQ ID NO: 537983 - DNA, 2554 bp, Homo sapiens
gcttggaagagacgctgtttcattctgactgcactgcctttttctacttgaggtatacacgaataaggagccccgtgaatcatcctttagagaatctgagtatcgggaaagtgaaggctccaaaaaaccaactgcttttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcggttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagccatctttgttgttcgcggtgtctctgggctcaggcggggccctcgaggtgggaaaggggtgctgaccggacacttgtgcaggagggtgttactccagctgcaccttgagttcagttgtaacaccttgaaagtgggaggagggttctgtc

SEQ ID NO: 537984 - DNA, 999 bp, Homo sapiens
ccggtaccgtacgcccacaaggactggattctgaaggaggaaaatacgtaagcgtcagtcagctctctcctctcctcggcgctccgcaggcacttgggatggaaaagcatccgcgggagatgccggactgcacgctgctgccgactgcgaccccgtccagggcaggcccccgactctgactgtgccgtcagaggctccactgggccacgccatgtaaggtctatcacggggctggaaatttcctcatgtgacaagtatctggaaacatggctttctaaagtcagttggcttctcttgcttaatgttcttccctgggacttggtctgcctggctctccctccagtccctgtgcgagggtcagcagtgagcattctgactttgccttctctcagtgatgctttctcctccctccagtccctgtgcgagggtcagcagtgagcattctgactttgccttctctcagtgatcctttctcctaagagcacagccttgccctctccctcctggtgcttcatccatgagagttcacctagctgttttcctgagaaagactcctcagctgcctgtgtgacttcacctggaagacagggagaatgtgcccacaggtgactgcgaaggtccctgtaagtcctctgtgtactgtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaa

SEQ ID NO: 537985 - DNA, 961 bp, Homo sapiens
gaggaaactgaggcccatagaggttaagaaatttgctggaagtcacataccgtgatccaaggtccgggaggagggagaagcttcctcagggttccacagctaagaagtggagctcccaagtccaggcctctgactcctacctctcggctctgttggctccactgggccacgccatgtaaggtctatcacggggctggaaatttcctcatgtgacaagtatctggaaacatggctttctaaagtcagttggcttctcttgcttaatgttcttccctgggacttggtctgcctggctctccctccagtccctgtgcgagggtcagcagtgagcattctgactttgccttctctcagtgatgctttctcctccctccagtccctgtgcgagggtcagcagtgagcattctgactttgccttctctcagtgatcctttctcctaagagcacagccttgccctctccctcctggtgcttcatccatgagagttcacctagctgttttcctgagaaagactcctcagctgcctgtgtgacttcacctggaagacagggagaatgtgcccacaggtgactgcgaaggtccctgtaagtcctctgtgtactgtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaa

SEQ ID NO: 537986 - DNA, 568 bp, Homo sapiens
tttttttcttaattctttgattcatcataccattaagaaacaagaattagtcatgagcctcggttccatattcattacgtgcacatgcacatatataatctcatatcttcctactcttctagtaagcaattcctcttctaagatataaaaacctcagaggtagaaatttacctgtttatgtgcataaacattctgctggtttaaagcacagaatattttttgtaaaactgtactgttcgtcacacaggtttatatgtgactaaaattttcatgacaaatttgaaggtcatatatatatatatatatatatatatatatatatatatatataaaatctccttatatatattgggaaatttatgcacatgtttgtaatagtttttgctctagatagtagtaatttttccaccttagtgttctacttatatgcaaatggactcaacagttgctgtaggacaaaatctgtttatgcatgttaaatgtgacccataacgtatataattatgtatcttttgttagaaaacatgtggattgtgtgatgtgtgaattatatctcaaagccattaca

SEQ ID NO: 537987 - DNA, 1316 bp, Homo sapiens
  misc_feature (1312)..(1312): n is a, c, g, or t
gcttggaagagacgctgtttcattctgactgcactgcctttttctacttgaggtatacacgaataaggagccccgtgaatcatcctttagagaatctgagtatcgggaaagtgaaggctccaaaaaaccaactgcttttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcggttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctagaattctccaagcagctgcccaggcccgagcccaagccccgtccccttatcctgaatgagcccaaagggatcctctagancacc

SEQ ID NO: 537988 - DNA, 557 bp, Homo sapiens
agcgtaccctaattgctttggagctggcactgctgtggtggtagcagttgccggtggtagaagtggtggtggcagcagcaggagggaaggtgtagcctggtggcactgtcagtgtgcttcaacaggctagaggagcctgaagtggggctgggctcaagcgaactaaggcaagttgtgttgggtttaaggaccaagttggcgttggaaggcgtgaagttccactctcaagaacccccaggggggattgcaacaactggggtgagagaaacaatggtgggctgcgagtggaggccagaagaccggggcaagaaggcgagattcaggaattagcgggggcccggcaagttaagcgtgaaaacattagtgattcttggcagcactttgggggacttgggcccggggttggcttgggcgttgagaactccgtgaacttggaggaagtccaacttgggaccggggcccaagggcggcccgtgggttttgtcaacaacaacaatggtcgggcttcttggttaagttcttggttggaggattctgtgtgactttcatctttgatt

SEQ ID NO: 537989 - DNA, 110 bp, Homo sapiens
agagctggctattttacattctcgcattgcttgtgaactctcaacacatgttagactctcctagagaaggcgcagaacgtcagaggttgcatccttagcccccaagggta

SEQ ID NO: 537990 - DNA, 129 bp, Homo sapiens
cgttatgatacataatagttgtacatagtaggaggggttcctctaaaaaactaaaaatagaactaccataagatccagcaatcacactgctgggtatatacacaaaggaaaggaaatcaggctgggtga

SEQ ID NO: 537991 - DNA, 1253 bp, Homo sapiens
ccggtaccgtacgcccacaaggactggattctgaaggaggaaaatacgtaagcgtcagtcagctctctcctctcctcggcgctccgcaggcacttgggatggaaaagcatccgcgggagatgccggactgcacgctgctgccgactgcgaccccgtccagggcaggcccccgactctgactgtgccgtcagaggctccactgggccacgccatgtaaggtctatcacggggctggaaatttcctcatgtgacaagtatctggaaacatggctttctaaagtcagttggcttctcttgcttaatgttcttccctgggacttggtctgcctggctctccctccagtccctgtgcgagggtcagcagtgagcattctgactttgccttctctcagtgatgctttctcctccctccagtccctgtgcgagggtcagcagtgagcattctgactttgccttctctcagtgatcctttctcctaagagcacagccttgccctctccctcctggtgcttcatccatgagagttcacctagctgttttcctgagaaagactcctcagctgcctgtgtgacttcacctggaagacagggagaatgtgcccacaggtgactgcgaaggtccctgtaagtcctctgtgtactgtgtgacgggctttctcccacccaggctacagccccgttcccgagggtgtgcaatatcctctagcctttgttttatcttttggtatttctactcagaccagtgtaggttttggcccaagctaaataccttaaaactgactgaagatggagatgatgtgatgatggagggaaaggaatagatgatttatcctctcaaaagtaatctgaaaattcatgcaatgaaaacagacaggaaccagctggagagaggatggatttggcgcccaggtcacgctgcgctgagactcctcgctctgtctctctgagcgcagtgcctggtaggtgggtaacctacctcttctgtgtgatagaggtcatttctgcctcatggggctcttttgaggattaaatgagattgtgtagtgggcatggggtttggcagcttccctggcatgacagccatcatgggaagtgtggccctgagcgggggccagcccaccctccattgagcagacgcggcgccacggtgttttcagagtcccctaccagtaatggcaccagccctgtgttctggggaagaaaacagcagtgttgtgggggaccggtatccttttttttaacatactgaaaaaa

SEQ ID NO: 537992 - DNA, 792 bp, Homo sapiens
agaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcagcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgactttttttctgtctcatgtgacccatcaagattcacacagggctgtgtcccgggcagggctggagtcgacattcagggaggagatcacttgttctgggaacagagcagtgattggtttaattgaaatctgatagatcatcatg

SEQ ID NO: 537993 - DNA, 733 bp, Homo sapiens
ggggaagtgagggcaatgagctgttcagaggtggagactacggggtgcgccctggcggcctacactcaggccctgggtctggacgcgacgccccaggaccaggccgttctgcaccggaaccgggccgcctgccacctcaagctgtgaagattactgacaaatgcatgaaacatgatggcggtgcaaatgccattgaaaagtgatggtggggatgtcaaagcactctacctggctggatgccaatgcccctagatgaatgcttggtgcctgcctggaccagtgctgtccttgacctgcatgagatgtgttgatgcttggatgcccaagaacaaatgttttcgcagtgatggccttgctggaacatctgggggccagattcaggagaaggtgcgatacatgtcctcgacgtgatgccaaagtggaacagatgtttcagatactgttggacccagaagagcaagggcactgagaaaaagcaaaaggcttctcagaacctggtggtgctggccaggcaggatgctggagcggagaagatcttccggagtaactggggttcagctcttgcacacgtttactggaccatgggagagcactgcgctcatgctggccggcctctgggtacgctgggttgggatttagcgcctgagcattcagtcaccgacagtgccaacctgagcctactgcgaactcggcacgtcagatccctcctgggcgtcgaaagccaggtgtgtcc

SEQ ID NO: 537994 - DNA, 276 bp, Homo sapiens
attgcacgttggtatgtgtcaattgcatattggcacggaagaaaacgctttaattgggtggatggtagacagagacagcagaaagaatgagtatgcttgaattatggataatcttttttttcacattctcttttagttagtaattttttgttgcaggaataaattaactgggacatctgaggctgtatttaaaaggagactaaattaacttaaagaatggcacataaccgagcgtggcaaatgggaccggagcccaattcgaactcatggcctagc

SEQ ID NO: 537995 - DNA, 1275 bp, Homo sapiens
ggcgtgcgtggactggggaggctgctgctcacgctaccgctcctccgacagacagtgggcaaagtgctggcccatttctatggcgcgatgaacgcattggaggtgcaaggtgcccatgcacaagctgttcttggagatgctctgaggccatgatggactgagtgcaaggggtgggactgggtggtggttctggcaggacctgcctagcaatgcgggtcatagccccaagggcatggcggcagagagcttggggtctgggcagtgccacagccatgctggcagggccagtgcaatgccatcagcccctgggaaacgaggcccgacgacacctctcctcacccctcctagtggggtgtccagaagctggggtaacgtagtgtgcaggctcttggtgccacagttgctgccccattgcgaagcccacatacgtgcccccaagagtgtagcggcggcattgctggaagcccataagggggcattgcatgggattgctgtgggagtgctagcaatagcgtaatcgtcagggcacgggacagcgggcatggagcgcccaggagtcgtcccaggatgagtgaatgcatttggctgactggcttaagtccgtacgccccatacttcataagcagatctggggacgtcggaagaaggcaaacgtggcccaagatgcccccgttcgatgcctcctctcatccatttgccatttggggcatttacgtgttgccgcccttgaagtccaataatttccaaagcagaactccaagacgcccttgggaacccctgggggttggcacgtggctttcccgcaaatcaggttccccaaagaaggccttcctacaaggagggctagacagaagcgagcttcccttcctaaattgccctcgttccatgtattacactaaagcccgtattacttaaaattctaggggctgtcgagccccgggaagggcagcaccacggggacatgtggtggcccacggcccagaggggcgccccgaaagaccccttgggtgcgtgaaaaaccaagaaagacagcaacgcacaaacgggtcaacatctgggagggcgacgaaagaaaaacccggtctatggagcgcatgaacgccgtcctctggaggacacagcacgaccaatcgtaaagaccgaaggagccgaaccacacaacgacaccgcacacaccaagatcgacagcagagacgaaaaaccaagaaaacaacaacagcgcgcgacgcacgaggcacgcccgcgcagacagaagggaccgacgcaatacacaaa

SEQ ID NO: 537996 - DNA, 180 bp, Homo sapiens
gctagagacaggaggcgcaaactccccaggccattaggtgcttcagcgccgaagtcttgcacctaggcagcaccatcgcgaggtagacggctgcggcgggacgacataggtggacacgatagctagaggccagtagtccgtgatgcagtacacacctgtacgggctagtacgggggggta

SEQ ID NO: 537997 - DNA, 777 bp, Homo sapiens
gcttgtgagggctgggcctgggctggggaactgggctggggctgtggcctggatggctggctgtgctggctgactcgccttctctccgtgggctgctgacccctgatggcaacctggctgcagatgtggatgccctgctgtgagccgagtgatgctgtggctgtggcctggggactgcgactgcctggctgatggtgatgcttgttcctgtgtgactgcctgccttcccctgcctgctggactcctctgctcttctgcgacttgtctacgcctgctggcccagttccgctgatggacatcacgtggagtgctggccccaggatgattttgttgccacacccctggctgtttccagatgacccactgtggaatgggcatggtgaagcagggtgcttgctaggtgggatttgcttggttcctgtgtgcctgctgcctgctgctgcagaatgagcaggcacctcctggaccaggtcattcctccgggacatgcctgagctgggcctgaccagtgagtacctgggggctccttcacctgtcgcattttggcagttatggacgctgggtggagtgtgaccacagatgacctgctgcctgtgccttgcagtggagactctgtatctcccgctgccagagggaggatgtgttctggctccccttactggaaaggtctacgccaagggtccatggggtcctacgagcaactgtgggccgggcggtgcggatgcctggtggacctgacggtggctgcggaaatatgggactagagggcgtaaggac

SEQ ID NO: 537998 - DNA, 203 bp, Homo sapiens
  misc_feature (6)..(6): n is a, c, g, or t
  misc_feature (97)..(97): n is a, c, g, or t
  misc_feature (138)..(138): n is a, c, g, or t
  misc_feature (145)..(145): n is a, c, g, or t
  misc_feature (191)..(191): n is a, c, g, or t
tgactnccctttgatcacagagattagggaagcaggaaagattgcaaaatctaaaagaaaaaaaaaaggcttataactaagagaaaaagaaggaggnccttatgcccactctggtttgttacctgcatttttcatcanggatgtntcacatgtgagttctgtgaatcagtgctgagctgaattctctgggntattgcaacttt

SEQ ID NO: 537999 - DNA, 1063 bp, Homo sapiens
attttaatgcatagcagtatgttgaaaaatagaccagttctaaaaagcccatgataccttagctgttgatgaaaaaggatgatcatatatatagaacttgattagtcagagcatgggcattccaaaatacagccttggttcagtagattttaatgcttataaattagactgacggtcgcatacccgttatagaattggcaatatgcattgtctcacaaaattcaattgtgatacatttcaatgtatgcatgtgcgatatatgctaaacagcaatgccagcaaacatccattttcatgcaatagccaacatttggggttgatgtgaaccattttaatgtgtacatcattaggttttatagcttattatttatttttttagttatattaaaagggtggtaggatatatttacaattaacacgaaagaataatttagaccaaaatatgtgacacgttaagattaacagataacatataaataaacattaaatttgtgagaagtgggacggtcatcaaccatcagtggataaaaccgcaagggcgaggcaagatcgcaagaaaaagatgcagaaaatcaacaggacaaccactgtagacaacaccagtacgtgcgactaccgtgagaaatcgcaaaagacgaactatccatcgcgtgtgtccacacaaagcatgccccagaggtaaagacgtggagcacaataataacggccagccgaatggaccaaccaaacaacacgcgggcagtaaaaaaaaaaaaacagcgaagtatatatagaacaacaaagaacacacaggggaatataacaaccacaaaggaatacaacgaccattaagaggaggtgacgaacccatcacacacgcccttcccagtgaacacacaagatgtgagagaaatcaatgggaccgcttgaacacctacgcgacaccatcacgaaagaaaaagaggcgaaggggagaaaataatacacccgagaccgatagacaactcacaacaggaaacgccacaatggagcgcacaagagaataaaccaacaacacacaaagagatgaaaagacaaaagcaga

SEQ ID NO: 538000 - DNA, 290 bp, Homo sapiens
gggcctggagggcagaacattgagccaatgattattctgaggccgtaacatttcatgttgtttcctctgttgggtttcagacttacttggcaccagtcactgttttcttctttcctatgtctcccttttaaaatggaaatatctatcctatgcccatcccaccattgtattttggaagcacagaacatgtttgcttcactgctagagagcagtttacctcagaatgagtcatactttcagtctcacctatatctgatttagatgaaactctgaactggagattttcgagt

SEQ ID NO: 538001 - DNA, 177 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (50)..(50): n is a, c, g, or t
  misc_feature (101)..(101): n is a, c, g, or t
ccaattngncntgtgaatgtttgccttgtggcctaaagttaactgatcanattgcctctcttcttaaaccctgagcctggagaaaagtgtcaaacgcaggntctctctctattcgggttacttgaatttccactagaggagcagaaatgccaccaatgccaagtgccccacctgtgc

SEQ ID NO: 538002 - DNA, 399 bp, Homo sapiens
  misc_feature (6)..(6): n is a, c, g, or t
  misc_feature (17)..(17): n is a, c, g, or t
  misc_feature (49)..(49): n is a, c, g, or t
  misc_feature (89)..(89): n is a, c, g, or t
  misc_feature (156)..(156): n is a, c, g, or t
  misc_feature (256)..(256): n is a, c, g, or t
  misc_feature (359)..(359): n is a, c, g, or t
  misc_feature (375)..(375): n is a, c, g, or t
attgtnacatggctctngcaagtgatgataatagtgatgcttataatantgaggattagctgcactcatcagcctgtagaaagtaaaangtttccttttcgaaatttcctttcttgttaaagaataaatcataagtgttagaaataatagtttctnttaaagactaacttccttcaagcctcctctgctctgtgctaatgactcttcattaagccctatcctatgtagctgttagatataagggaataagtatatnctatgtccttgtactttaaccaagatatttgtgctggacatgctcacaggcacgttccagcttgcagcctatgccccttccttatttggaaatattattactnttctaaagtctttttngcaagcaactgcttcttttgccct

SEQ ID NO: 538003 - DNA, 356 bp, Homo sapiens
ataatagaagatatgggggaaaatcagctaataaaaaagggtattaacaataagacatacgtgtagaaagtaaagagtttcctgttcaaagttccccttcttgttcaaagaatgaatcataagtgttagaagtagtagtttcttttaaagactacctttcttcaagcctccttggtttgggctaataactctttgtcaggccctgtcctaagtaactgttggacatgctcacaggcacgttccagctcatagcctatgcccattccttatttggaaatgttattgcttccttaaacctttcataagcaacttcctctccttctttgttctcccccacacttacctatttaggaaag

SEQ ID NO: 538004 - DNA, 679 bp, Homo sapiens
caacaataaaaaaaaaaaaaaaaaaaatatgataggtagaactggtgttaataggagaggtcaggcgagcgctagttctgcgcgtggtatagtacgtgtacgataacctgcaaagagttctactgaggtggtccagagccagagggtcctatctcttcgtggcctcgtgactgtggatgctctgtgtgctgtgcaagatccttcagtgccttgtaaccagttgtgaccacagtgcaaatatactgctaggttccagtattcttggtgtggcaagaactatgaaacttgcatatctctatgagcataaagaacagtattcattatatattatatctacataaacttgtgtgagctaatgtagacctatatggatattctatcaacctgatgaagacactatattcttttgttgtgtgacacccataggccagtcaatgtctgtacaatgtatacaacagatacccagatcaaattactcattaaacaagatgattgaccttgaagtatcccgcctatgaagacatcttacagtggaatgaagaggcggatgaagagcattcaggaaatgacagtgatgggtcagagccttctgataagcgcaaacggtaagacgaggagatagtggagcaaccatgcggaggaggcatgcgaggagagtgggaggccggagaagagacta

SEQ ID NO: 538005 - DNA, 145 bp, Homo sapiens
agcgagcagtacaccagctagagggacaggaggaaagaaataaaagcaagaataaatgagatagtaattgcaatcactaaaaatataaaaaccagctgggcatggtggtgggcgcctgtaatcccagctactcgggaggctgaag

SEQ ID NO: 538006 - DNA, 217 bp, Homo sapiens
aaagataacaggagcaaaagagcagaaatacggtacagagtacaaaagtgacaacccactacagctcaggaataaacaaaacccccataatggaacaacaaataccatcctactcacttactactagcctactataaggccaccaaactcccaggactgaacccgaatcaggtatacaataccctataatataggtaacctactaccctagaaacta

SEQ ID NO: 538007 - DNA, 1193 bp, Homo sapiens
ccccaccccggacggccagcccatagccagccctccgtcatcctcgttcacctgcaccctcgtgactgcgcccaaggcccccgcctgccgctccagctgcctgcgcaggccgagccgcctgcctgcctgcctgctctctccttatgctcgcctgccgatgcacgacctgctgtccaccatcgccagcgtgctgccatgaacctacgcaccacggactcacgagtgcctgccaatcaacgctgccgagatcatacctggacgctcttacgccatctctactgtttacccttgttcacacatgctcattacgtaacatatattgcagcctgccgactgcactgatgcgctctctgacaccgaacctttcatgccgagacactacatcttactttcaacccaaatcatccatggacgcgagacgcgtgacacactagcctcgacgcaacacctcgagtagaactggctcgcgatccaaccacaaccgcacgtgcttgtgcaccgaaagtcgtatacactttacagccgactactcccactcgcacaatcccacgcacttggcctgcacttggaccctggcgcaacgaacgcccgtgctgcctcgacacctggcccacccggcgaccgttgcttgaccacttccaccactcactggcgactcacacaccacactgcgtccacactcacgcctcaccctaccaccgcgcaaaactctggctacccaccaaacccctcgcccccacaaccttggaaccacaacacagcactggaccctccccccccacctaatctgcttgctggacccttttccactattgccacctgcacagaccactataaccacaatggaaacattgaccgccacccacgcgtgacacacagttgccccaatcatcaagacaccacgcacccaatcttcgcgcgctctggaatcccaaccggctttggaccccccaaaaacccactaataggaccgcccaacaaacgcaacattagcggcgacaagcctctccctaccggacaacctcccattgagccacttatgcgccacccgtcgacaaccttacctcccttccattattcttcatcccccaatcgcacactcaaccctcctttgagtggaacacgaacacacgctacgcgactaaccctatcgaacaacgccttcaaacaaccataaccgaaaccactaaaca

SEQ ID NO: 538008 - DNA, 513 bp, Homo sapiens
tgttctagaggatacctcacgcccatgtcacacaaattttttaaataggctgggcgcagtggctcacgcctgtaatctcaacactctgggaggctaaggcgggtggatcacctgaggtcgggagttggggactagcctggccaacatggtgaagcgctgcctcttctaaaaatacagaaattagctgggcatggtggtgctgtcctctaatcccaactactcgggagactgaggcaggagaatggcttgaacccagttggtgaaggttgcagtgtgctgagatcacaccattgcactttattctacttgggtgacagagcgaaactctgtctcaaaaaaaaaaaattctattaaaaatagtgcgcttggccaaggcatgtggtggctcacgcctgtggtctcagcacttgggaaggctgaggcaggaggatagctcgagcccggacagtcaagaccagcctggacgacatggggaaaccccgtctctacaaaaaaatagcaagagtaagccag

SEQ ID NO: 538009 - DNA, 261 bp, Homo sapiens
ggccaggcatggccagcagatgaacgctgttcttagttcactaatgtaagccttatttaggaggaagtcagccagacaccttgtactgggcacgcgtcagactgtcagccagtccgtttccgtttcatttagccagccatcctaggtactagtaagtttagcgggttgactggtaggttgaaacttgattgtctggctaggttactaaaggtgcctcgctagccacttgtataaaaattaaacacatagaagaactatttt

SEQ ID NO: 538010 - DNA, 383 bp, Homo sapiens
gccggacctgcaaggttggaggagagatacgcgacaagaaagtggaaatcatagtggctgaacaatctcatattatgagccacattcatctacacatccaggaagcgtcaacaaactccagtgtaggatacacacaggaagattcgcagctgaacacatcatagtcgtcatgctgccccgaccgataaggacaaaatattgaaagcgacaagagaaaatcacttgtcacttacaagagaccctcagtaagattaaccgcttacttctcatcagaaacaatgaaggccacaggcaatggggtcacacacagatgctcctcaactgagggtgagcctatgtctaggtaaacctgctgtaagtttaaaacatcataaataaaaaat

SEQ ID NO: 538011 - DNA, 789 bp, Homo sapiens
gcttgatggtctctgagggactcaactttaggaactctgtccgttttgtgctgctgtcacagagtgcttgagactgggtaatttataatgaacaatcaactggctcacggtactggacaggtgccagcatctggcgagggccgtccagctgcgtcatcacatggtggaaggcaggaggggagccaccccacccttttataaccaatcccagccgttagggcgcagccttcatggcctaaccaccctctgaaggtcccactcgatactgttaaaaggcaatgaaatttcaacaggttttggaggggacaaacattcaaaccatggcagaaagtgtggaaggagcaataaccacactgaacagaatgaccatggtaattaaaccccaagtgaaaccatgacctgttttacatcatcctggagagaacagtgcagctccagtacttgctgagctgcagagacagggtccatccaactcgacagcatccagcagccactccaggccgccagcagacagatgttgggagcagcactgatagtttgggttttcgtttgtttttttaagacagggtctcacttgcccaggctggagtgcagtggtgtgattatggctcactgcagcctggaactcgggctcaggcgatcctcccgcctcgtgctcctgagtagctgggactgcaggtgtgtgccatcaaatccggctaatttttgttacttttgtagagatggggtctcactattgttgcccagggcttataggatttttttaaatgatcataccggacggctggg

SEQ ID NO: 538012 - DNA, 899 bp, Homo sapiens
tggatacttgcctaacatgcttgtgctgtaaaaatagttaacagggaaataacttgagatgatggctagcttggttaaatgtcttatgaaattttcatgaacaatccaagcataattgttaagaaacacgtgttattaaattcatgtaagtggaataaaagttttatgaatggccttttcaactactttctcatacagctttccatgtaaattagtctgggtcctgaaacttctctaaaggaaattgtcacatttttggaaatttattccttattccctcttggcagctaatgggcctcttaccaagttttaaacacaaaatttatcataacaaaaatactactaatataactactgttcccatgtcccatgatcccctctcttcctccccaccctgaaaaaaatgagtccctaatttttcctggggaaagggggggatggattcagaaaaaatatgtcgcggtgtcccatttaaaatttgggcatatggcattttctaaccttaggaagccacaatgtccttgggcccatcatgactttgggtagcattacctgtaagtttggtgctcccaaatcaccttttgggttttaagaattccttgatactcttaaagcctgccttcaatttggactccttatccttcataattggtccaggtgcacaagattaccttcctgtttaagccttctgtcttgtcaccaaacattcttacttgggggccatgtacttggaaaaaagggcgatgaacttcgtggctccacttcggtgttctaaggccccctgcttcctatggttgcatcccaagattattccctaattctatttattgggcaatctccccttattgatcagcactggttatctccctttaaacctacctaactgaatggccgcgctg

SEQ ID NO: 538013 - DNA, 501 bp, Homo sapiens
gacttgtacatccagtagctattctatgatgtatcctcatgctgcgctaccgcatgacactacgtaataaaaggtgcagcagaagtcagccgtaaaagcgctcaattaggtgggcttgtgagggctccaaatgcgatagctctatgaagtagtatttggaaggtatggacgaatagtggaagtactcttgatgaaagaccgtgaaaacaacatatcaagaggatatgcttttgtcacctttgaaagccctagcagacgctaaggatgcagcccgagacatgaatggcaagtcataagatggaaaagccatcaaggtggaacaagctatcaaagcatcatttgaaagtggtatacgtggaccggctccacctccaagaagtagagtgcctccaagaggtcttagaggtggactaggaggaagtggagaaccaggggacctccctcacggggagaacacatggatgacaggggatattccatgaattttaacatgagttcttc

SEQ ID NO: 538014 - DNA, 204 bp, Homo sapiens
aaccaaagtccatacctctgtcgataacggttgcctctgcgggtactcctccggagagtacaccagaggcaacaaatattaaaacaccatttcaagaactccaagaatacaccgagaggtttgtaaaggtgccatatttaagcattaaagctatatcctaaatcattttactgtaaacgtatttattatttggcttagggaaaa

SEQ ID NO: 538015 - DNA, 130 bp, Homo sapiens
gtggaagcgcaggggtgcactctcagctcagtgcaccctccattccccgggtccaaacgattctcttgcctcagcctcctaagtagctggcactgggggtgcggcccaccaggcccagttaatatggggg

SEQ ID NO: 538016 - DNA, 126 bp, Homo sapiens
gattcggcacgtggcggaacgccgaggacccggctgaggcggcagagagcatcctggccagaccagccaagggccaggccgggaggagcacacggccaaccaccaggcagaggcggtacttgtccc

SEQ ID NO: 538017 - DNA, 165 bp, Homo sapiens
ggactggatgtcctacacgaaggggctgtgtggccatcgtgtcagcagagagagtctctgtacacggccccgtagaaccctgagagagtggtgtcatacgctaccggtgtgtggccaggctgcagagctgcttgccgtttgtgtccgagcaatctacgtgtggct

SEQ ID NO: 538018 - DNA, 258 bp, Homo sapiens
aggggggggggtttcccccccccccccccgttggttttccaaaggggccttaaatttttttagcctggggcgggcccccgggttgggttttttttaacggggaattaagccccttcccagctttccccccaaggtttcgggtttagggagggggccccccccttggggccctttttttttttttggggggtttgggcggccccccccctttttttttttcctttccccccgggggccttttcccttttgggtttttta

SEQ ID NO: 538019 - DNA, 136 bp, Homo sapiens
ggattagataccccactatgcttagccctaaacatcaacagttaaatagacaaaactgctcgccagaacacagcgagccacagcttaaaactcaaaggacctggcggtatttcatatccctctagaggaggtcgac

SEQ ID NO: 538020 - DNA, 713 bp, Homo sapiens
tcatggccaaaaattggacaattagtttcaaagcaggcactagctgcttgaccacatttttctaaagatgcgtggcaaaggtgtcaagtcagtgcaggtcttaccaatgtcttctcgcatcctcccagaggctttgcataaggtgctactgcacgggaggtctttgcaaggatatcttgtaaggtctggatccgatctacagaaaatgatgcatgggtgtgaggacttctgttgaaccatctcaaagcagtgccaaagtgtaaaatgattaaatgcggactacctagccttcgtcacgggctgatccagcagaaaatacatgctcacgttctgaaaaggagagccatatcgacaacctatctgcactcgctaagctagttgctttcgggccctatgcgacaacagagcgactaaaaatatgctatgaatgatttaacagcttatgtacataagttctacatgtctgccaatacgaagctccggtctgtcgaatagggtcaacattttgtttatacgagtcagtttctaagtgtttataacggctccttgagaaggctctcatcttggcgttacaattgtagaaagtcaatgaagatcgacagcttaatgtcgtgattttctttgtcgtttgggatatggaagcgtccggttcaaagagcatgattttcaagaatctctttgcctctctgccctgagcttctaataatatactt

SEQ ID NO: 538021 - DNA, 223 bp, Homo sapiens
  misc_feature (113)..(113): n is a, c, g, or t
  misc_feature (206)..(206): n is a, c, g, or t
gggtctattcaccctcttctctccattcccgggagcaagtccacatctggctgttggatgcatggcaaaagcaaaggtgtggagaaggttcagaggagacaggacatgtatanatggtagggtcaggttgtcatgggggaaactgaggcacaggaggcaagctgagttagtacaagaacagtctgaatcataacggcatgccagtnttacctaaaaggatgac

SEQ ID NO: 538022 - DNA, 373 bp, Homo sapiens
cagggctgggggaagggggacgcaggatcatcccctcagcctgtttggctaaaaatcaggcctggagtttgggtttgccccctccccggctccttggggctttttggtttcaggccagctggcgatgggtggctaaaattattaactccagccctgtggccccagttttgggagccttcaaccctgggtcattctgccatagtttccccggtgccctttccaaaggggttggtagtggcagaatggccatgccccggtgtgtttttagaccctttacaactgtttgtgttcaggccccccccagccccaaagcattgggcccaccaggcattcgagttaaaggattaaggggaataaagtcagttccacttga

SEQ ID NO: 538023 - DNA, 843 bp, Homo sapiens
  misc_feature (17)..(17): n is a, c, g, or t
  misc_feature (63)..(63): n is a, c, g, or t
  misc_feature (85)..(86): n is a, c, g, or t
  misc_feature (115)..(115): n is a, c, g, or t
  misc_feature (164)..(164): n is a, c, g, or t
  misc_feature (168)..(168): n is a, c, g, or t
  misc_feature (253)..(253): n is a, c, g, or t
  misc_feature (280)..(280): n is a, c, g, or t
  misc_feature (301)..(302): n is a, c, g, or t
  misc_feature (420)..(420): n is a, c, g, or t
  misc_feature (441)..(441): n is a, c, g, or t
  misc_feature (521)..(521): n is a, c, g, or t
  misc_feature (752)..(752): n is a, c, g, or t
  misc_feature (823)..(823): n is a, c, g, or t
ggtttcgaagcaggagnttgggcatgggctctgggggtaggagtgaagggcatgcgacccccntgtgcggggggaggggtagganntgagcgagcactcactgcaaagctaaggnaaagaatagagctggtgggagatgcctcccctcaccccaggggcatggnttgntgaggcccaggatacagaccaggagggtgtggtgtgatgggggtctggtctcagcctggagcggcgagcaggactctgggtgtanacatgggtgtggggtgaagaggggggnatgctgaagagggagcctgannagggtatgaggggggctttagcttggcatattccccctggccccagaacagctcccagaccatggtccccaatcctacacttggcccctctcttaagtgtgctacttcatggtggggntctctgctcatgttccttctnccactcttatcgcgcctcccactgtcagttcataacattcttagggccaagcccctgagtcccctgtcacactgactggngctgcagggaagggaggacagcaaggtgctagctgggagcctcccccagcaccaggaattccttgcacatctctcggacaatcatgcggtccatctggcactggggtgaggtctcctcctcattcaggatgcgtcgcagtatggcctgcaggtcgggtagccggtggcggtgctgcaggtagggtgtggtgcggactatagcatgcatcagggagaggtatccatgcgcanttgtctcctggtgacagtctgcgatgtgcgcacagtgatgtcaatgagagcatcatgtctgtgtggtaganatggagctgtggcgggctgc

SEQ ID NO: 538024 - DNA, 177 bp, Homo sapiens
ccacatgggtcctggacagagtgtcttagcatcactaagctttgcctggttattttctaaagaagcactgcatactgcaacgtgtttcgtcggtggatgagtgatgggaaagaatccgaagggcaagttagcgattccagaattttatcacgaggctacacagatttagataataca

SEQ ID NO: 538025 - DNA, 412 bp, Homo sapiens
tcagtcggtccctgcttactgggcgtatgtgcgtgccacggtgacatagtgggactctggtctcaagaaaaaaaaaaaaaaaagatttcagtagatttagtggtgttgggtgagagcctactttctagcctgttttttaaaggggcactccctattctcgttcataagtgtttggcctcatgacctaagcttacccccaggtaggcttcctacctgggcgttttgttgggaggataatgttggtaaaagtcacaatgaagcctttattgacgaaagcttgcgctttttaaccagcacaagtttgagcaaagggttaagtctccaaacctttttagacgtggataaggtacgcatcagtaacggccacctttgcgagatttcaggaggtctcatccccatcgcaggtcgagca

SEQ ID NO: 538026 - DNA, 212 bp, Homo sapiens
tagctcggcacccttaagaaggttaacaaatgcatgcggggattttcttgcctcaaatgaattgtttattctcatagcgtaggggagttctgcgatttgagtatcaagccaatcttccaattgattacgtaaagcgatatcttcgtcattcggcttaaaggaggtactgttatgaacattcattaagttacattctttaattaatacttttt

SEQ ID NO: 538027 - DNA, 225 bp, Homo sapiens
  misc_feature (200)..(200): n is a, c, g, or t
ggtatctacggactaagtgacctctatatctacatgactgtaatggtagtggaattatttgaatctacaccaagcacttaccatgtgccacgggctttgcagaggtgcgtccttactggaccacacagaaaaaggggttgttcctgccacattatagatgtggagcctaagggtcacagaaattgtgtgctattcgccanaaaacattgaactggtagatataga

SEQ ID NO: 538028 - DNA, 216 bp, Homo sapiens
agagagagaacaagaaaaagaaaaacaagaagaaaaaatccccagtaccccgtagaaaccccttaaagatgttaaaaaagagttaacgtatcagcaacacagatttaagtggaaattaaggaagaagagcaggtaaagtgttactgtacagacagtcagcagtgggaagcccaaaacgaggtgactcagaatccaaaaacagaaaattgcagcaga

SEQ ID NO: 538029 - DNA, 257 bp, Homo sapiens
attcgcggccgcgtcgacacagggtcttgttatgatgcccaagctggtctcaaactcctggactcaaacgatcctcccacttgagctcccaaaatggtgaaattacagacatatcctttttttttcttttgagacagtctcgctctgtcgcccaggctagagtgcagtggcacgatcttggctcactgcaagctccacctcccgggttcacaccattctcctgcctcgtcgacgcggccgcgaatttagtagtagta

SEQ ID NO: 538030 - DNA, 293 bp, Homo sapiens
ccccccccccccttttttttgggggggggcccccccgaaaaccccctttgggggttaaggggggggggtcccccctttttttttaggggccgggccccttttgggggcggggggttggttttttaggggggtgcccgggggtttttacccccccccttttggggggggcccggggggctttttttttttttggggggggggggggttttttttttttttttttggggggttttttttaaaaggggggggggggggggccccccccctttttaaaccctttttgccccttttta

SEQ ID NO: 538031 - DNA, 478 bp, Homo sapiens
  misc_feature (188)..(188): n is a, c, g, or t
  misc_feature (304)..(304): n is a, c, g, or t
  misc_feature (307)..(307): n is a, c, g, or t
aaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgccnccagttccacaagatccaaccaagaattctgtatcctgggacagtcagattcctctaaatcagggcagggaaggaggggaaaagaggtgagagaatggtatcccagatattcttcntcntgcccttttcccagagctctagacagatgttggctctgacttactcctagttaggaaagtgtggttatgaatgtttgtgtttctaatgtggtgggttataaggttgggttaaaaccctgccctcttggaattggtggattttttccaagtaaagtttttcttttcccgaaa

SEQ ID NO: 538032 - DNA, 876 bp, Homo sapiens
tcatgcgggcttcttgtattccgcgcgccggtgtgctggtccgcgatatctctccgtggcatatgccttcttgaggtctgaagagccgtcgttattttcgtggtggcggtctgtggcacgcgcggccttcgtgttctctggcgtgtcgcccctcgctggggccaatgcgcattcccctggggtgaggcctaggcgttcttccctctcccgtttctggggggcccgcttctccccacaaccgggctttgtgtccttgacccccccctagggcctcttgtgctcgtggagcaaccttgagcccgatgttgccgcccgcctttgacgcgcggggggtccctttcccccagtggcgagccccagtgcctcccagtaagttgagggcatccctctcccgctatggtctaccccaccacggcgcttatttccacagccctttttcggcccctggcgcgggacgtcttcctttaacacggcatactagcaggtacaccccttgtcccggtcactatgtctgtcacgcctctgattgcccctcgcgtgcgttccccgggcagtctcggccggctcgccccttttattatttcgggaaacgcaaaaggctcgtcgcccgacactccggtgtgcacgaaagttgccacccagcctttgtccgccaagatgatgttgtcctccccaaatacgcctcgttttgtctcttcaatgaagggcagctccccccccgtctgggcacgctttatattccatcttggtaggggtcacacaggcacccgttattactatgttgtcgccctgcaacattggaagtttgcggggaccccaggaactaatcccccgctgcaccgcaacccgggttttcaaacagaaccacacgtcgcc

SEQ ID NO: 538033 - DNA, 211 bp, Homo sapiens
ccgtcatagactgcgccggctatttttggtattttaacgtagagactggggttgtcaccttgctgagccaggatggtctcgatctcctgacctcatgatccaaccgcctcggcctcccaaagtgctgggattacaggcgtgagccaccgcgcccggactggtttgtgtcatttgaagcagaggatacccatgaagtcacaggtttgatgtg

SEQ ID NO: 538034 - DNA, 402 bp, Homo sapiens
gagtagtactcgacgtgctcagtgtcctgtgagggttcatgtataacgaaggtgagtataattcgacctccaatgtaaagagttcgtcaatttaaataggacggtcattgtgaactgtctgtgatctcatgtgcctttccatgacaacacactctcagggctgactggtttaccattatatcttctttacattcatgttctttatcagtaaaacgattacaatggtctattcagacttgagtgatgaatgacaaaacaacacagttccattctaaaatgtgaatggccgtggagctcagatccaaaaacgaactgcaatggttatgccagagaatagataacatccagcaacagaatcaaattctaaaattaagcaagaaaaagaagtagaaataacaggag

SEQ ID NO: 538035 - DNA, 288 bp, Homo sapiens
aaacttaaaacccaatctaagctggtaaagatagaaggataagctgggtgtgatgctcatgcccgtaatcccagcactttgggaggccaaggtgggtggattgcctgagctcaggagttcgagaccagcctgtgcaacatggcgaaacctcgtctctactaaaatacaaaaaattagctggatgttggcacatgcctgtagtcccagctactcagggaggctgaggcataagaattgcttgagcccaggaggtggaggttgcagtgagctgagatcccaccactgcac

SEQ ID NO: 538036 - DNA, 1361 bp, Homo sapiens
tggataccattgggctcctttttgggcaaaacagtcactgtccttgtaaagttttttaagttccaataaagtccatggtctttcaaaaaaaaaaaaaaaaaaaaaaaaaaaaaaaaaaaaaaaaaaaaaaaacaaaaaaaaaaaaaaaaaaaaaaaaaaaacaaaaaaaaaaaaaaaaaaaaaaaaaaaacaaaaaaaacaggagagagagagcagagcgacgagagggggcgggcgcagcgcgagacgagcacctagtgggctgcacccacacgaaggacggacacaaaggggtctttcttttgtgtgttttttcttgcgaagcagccacttagaaaaacatgagcagagtaatgataaaaaatagagaagtaaataagagatgagaatgataactaagctgacggcgaaaaaagagataattacacagagagagaagagtgtaagtatgaggtagagattataatagtaatgattgtatggtgtgcgatcacagaggtagagagacagatacgcagagaggaaggaaggagagggaggtataagcggaaggtaaggagagaaaagaatgagaagaaagcatgtggcagagtggatgataacagggggggaagagcaagaagaagcgaagaaggagcggagagagctgtaaaacgagagaacgaagagggaggacagcagagaagagaccaataacacaagaaaaagaaaaaacaagaaaggagagacaagaagaaggaaacgaacacagagaaaagaaaaagaagggagaccaaaggacagagcaaaaagagaaacaggaagagatgaaacaaaatacgagagcagacaagcagaagaagcatgaagaagagagcagggaaaagaaaaacgaaagacaggaacagagaaagacaggaaaaaagaggaaaaagcaaacaaaaaaaaaaaaacacaaagaaagaagaaaaagaaagagagaaaacaagagaaaagaagaagaacgcaacaaaaaaacaaagaaagcagaagacgcacagagaaaacaacacacgaaaatagaaaaaaaagaaagaacaagaaagtaataagaagaaaaagaggaagacgagagcaactaggagagagctgactaggactgagagggaggagacgggtagccagggtagagagcgcaaggaacagagtgcgagagggagcgtacagaggaagacaacgaggtgagcgagccagagcaccgacacgaaacgacaagcacaaaaaacgaacatcagacactaggtaacgaaacagacgaatgagaagataacaagacagaagaagggaagaaggagacgagagggagcaagaagaggaagcagtgaagagagtgagaggcagga

SEQ ID NO: 538037 - DNA, 169 bp, Homo sapiens
  misc_feature (41)..(42): n is a, c, g, or t
gttttgccacattggccaggctggtctcgaactcccgaccnngtgagccacctgccttggcctctcaaagtgctgggattacaggcgtgagcaccacgcccgacccatagctctttacaactgccttgtaaagaaagcatcatttggcactgttagtatttctcttgaa

SEQ ID NO: 538038 - DNA, 202 bp, Homo sapiens
tagccagggtcatactctgtcacccaggctgcagtgcagtggtgcaatcatgactcactgcagccttgacctcccaggctctagctattctcactccactgcctctgtaatcttttttcttttcttttctttttttctttccttctctttctttctctttctttcttctttctttcctttctttctttcttttctttctttt

SEQ ID NO: 538039 - DNA, 119 bp, Homo sapiens
ggtctgttacctgggggtcacccgaagtatagtcaaacctttacttgatggtcagtgcttccagcttgctgccgttgccatacacataacaaagcatgttacccaccaccagcggacgc

SEQ ID NO: 538040 - DNA, 456 bp, Homo sapiens
tcacgaagccacactacagaacataataattgaattgctatttaaaactcagtagtagagtttaaaaggacatagacagagaaacaaaaataagaatgattacagacttctctccagaaacaatgcaagtcagaagacagtagagtatcagcaaatgctgaaaggaaaaaaagtgaatgtagaattccattattaagtaaaagtatctttcaaaattgaaagtgaaataaaaacttttataaacaaaagctgagtgaataccttcctggacttcatgcaatgttaaggaagttcttcagggtgaacagaaatgataccaggaggaaatttgtatctgtacagagaaatgaagtggaccagaaatgatagctttgttagtaaatattaaagcctttgttttaaaatttcttttttattattttttgagattgtcttgctctgttgctcaggctggag

SEQ ID NO: 538041 - DNA, 435 bp, Homo sapiens
cgttgtgtggattgagcgtgatgctagatggcttctattgtatgatctccgtagtatgtctctgtacggtgtcgcctatgagaagactgacatttaagtccagtacactgtgagaggcagagccatcctcaatagcaatgggaccatccaatcgactgccagtagtgatagaacaaaacaggcagagaaaggagggatcgtagctggcctgctgagtcttctggtttccgtctttctcctgtggttcctcctgcctttggacgtcaagattccaggttcttcagcctttggcactcagtgatcttgcactggtggcctgcctttgtggctcctaggcctctggccacagggtgaaggttgcgctggtcaacttccctacttctgagcctttcggactagaactgagccactaccgtattctttcttcctcctgct

SEQ ID NO: 538042 - DNA, 328 bp, Homo sapiens
aaccttttttaattttttatttttttgaaactttgctttggggttggggccccctggcccccccctttggttgtgacagcctttccaggccgggggggggcagtttgttgtttttttaagtttccttcccccccccggcccccttttttgggaagggttttaagagggttgtttggggggccccccccccgcttttggggttaaaagggcctccccttttttggggtttttttggggccgattgggggaaaaaaaaatcaatagggcccctgttttttttttgaattttgccaagggttttttttaaataaaaaacccgtccccccca

SEQ ID NO: 538043 - DNA, 290 bp, Homo sapiens
gtatccagcccaggacagactactcagagcactggacagaatgtactctgggcgtggaagggccagccctttacttccatggagatgagatggtgtttggcgtgcgtcaggtggctggctgtgccgtgaatgtgtactcagcaggctgggcactcaggtgtcagagcacagaaggtggtagacacaccaatctgcatgcacagccttgcagcccatcaggccttggaggaagtcctaacttctctcagcacctctaagggatacagccaaaggagcgggcaagcttccat

SEQ ID NO: 538044 - DNA, 612 bp, Homo sapiens
  misc_feature (54)..(54): n is a, c, g, or t
  misc_feature (125)..(125): n is a, c, g, or t
ggatcccggatgtatcgccaacacccccatcatcacgattcttcttgccacaantcactaaatatctagtactaaactatctgtattggcagcacagttactcagatctgactcctgtctcttgngaagcagtttcaaataaatcaaggggcattgcgtggactgatggttgctttgagcccacaggagctccctttttgaattgtgtggagaaggtgtgttctgatgaggcattttactatgcctgttgatctatgggaaaatctaggcgaaagtaatggggaaagattagaaagaattagccaaccaggctacagttgatatttaaaaagatccatttaaaacaagctgatagtgtttcgttaagcagtacatcttgtgcatgcgaaaatgaattcacccctccccacctctttcttcaattaatggaaaactgttaagggaagctgatacagagagacaactcgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttg

SEQ ID NO: 538045 - DNA, 92 bp, Homo sapiens
tttaaactggaaattgtaaattccccccgaaaagttttttcatccagttcccctgaactaatactccaaaaaaagatggttttgggtgtcca

SEQ ID NO: 538046 - DNA, 433 bp, Homo sapiens
tgtgtatttttagtagagacagggcttcaccgtgttaggcaggatggtctcgatctcctgacctcgtgatccacctgcctcggcctcccaaagtgctagctaggattacaggcgtgacaactgcacccggccaagaattcttaaatataagacacaaaattgtataggaaatacaacttatattgagagagatgttctcatgctagagtgagacagtgataagcatcaatgtttttgttggctggttggttgtttttctgagacagagtcccgctctgctgcccaggctggagtgcagtggtgcaaatgtggttcactgcagcctcgacctcttgggcccaggcagtctcctgcctcagcctcccacgtacattggaatacaggtgttcatgaccatgctcatcaactttttgtagagacgggactcacttgt

SEQ ID NO: 538047 - DNA, 119 bp, Homo sapiens
ccttaacggggtaatgtgtccatatcgagggcggatcctctctgggcgtgagtgaccaagatgaagatgcagaggaccatggtgatccgccgagactatctgcactacatccgcctccg

SEQ ID NO: 538048 - DNA, 489 bp, Homo sapiens
  misc_feature (207)..(207): n is a, c, g, or t
  misc_feature (234)..(235): n is a, c, g, or t
ctccgcctgtgcctggaggaacgcgactggctgcctggcaaaaccctctttgagaacctgtgggcctcggtctatggcagccgcaagacgctgtttgtgctggcccacacggaccgggtcagtggtctcttgcgaccgagctatcctgctggcccagcagcgcctgctggaggaccgcaaggacgtcgtggtgctggtgatcctaangcctgacggccaagcctcccgactacnngatgcgctgaccagcgcctctgccgccagagtgtcctcctctggccccaccagcccagtggtcgcgcagcttctgaggccagcatgcatggccctgaccagggacaaccaccacttctataaccggaacttctgccagggaacccacggccgaatagccgtgagccggaatcctgcacggtgccacctccacacacacctaacatatgcctgcctgatctgaccaacacatgctcgccaccctcaccacacacc

SEQ ID NO: 538049 - DNA, 213 bp, Homo sapiens
gtcgcacccggatcacaaaagcggggttcccaggctaggggtctaatcagagctgtagccgccagcctacaccacagccacagcaacacggggatccgagccgcgtctgcaacctatataccacagctcacagcaatgccagatccttaacccgctgagcagggtcagggatcgaacctgcaacctcatggttcctagtcggccgcttttgtg

SEQ ID NO: 538050 - DNA, 807 bp, Homo sapiens
gttggggccctgggatggtgtcctgtccgtgccagtatgttcggggggtgaacgatgttgtgccgtaaagctggtttgcccccgcgcgcgttttgttgttgtgttgaagcattgtgtctattgctgagttgttgctgggcgtgggggcccggtggcatgattctcggcgtccgctgcaaccgtccgcctcctgggttccgcgattttccttcctccgcctcctgggtgtgactgggattacaggcacccgcccccatgccccggtatatttttgtatttttagtagagatgagggttcacccaaggtgcccggctgatctggattcctgccttccaagttgatctgcctgccttggcctcccccacaatgctaggattaccaggtgtgacccccggtgtccccagccctgacctgccttgtttatgcccccgcgattttaaaattaaaagtcccggccaacttatttacctccctagggcgttctcttgggaacaccaaggggagacccgccatcagtaggccccgattcctccgagccaccattggcttgagctggagagccgctgtccattctgtacgggcgatatttgtgctctatttgggggttcttcttatacgtgttcctataggacattgcagtttggaattacttgtccctggtatgtggcagaagtggttcccgctacttgggaggctgagatgggaggatcacttgagcctaggagtttacagggtaccgctgagctatgatcgcacccctggtactcccacctgggccaccaagagagggagagaccctttttcca

SEQ ID NO: 538051 - DNA, 913 bp, Homo sapiens
  misc_feature (559)..(559): n is a, c, g, or t
  misc_feature (848)..(848): n is a, c, g, or t
  misc_feature (851)..(851): n is a, c, g, or t
  misc_feature (855)..(855): n is a, c, g, or t
  misc_feature (859)..(859): n is a, c, g, or t
  misc_feature (863)..(863): n is a, c, g, or t
  misc_feature (866)..(866): n is a, c, g, or t
gtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcngatcacctggggttgggagtttgagaccagcctgaccaacatggagaaaccccgtctctgctaaaaatacaaaattagctgggcgtggtggtgcatgcctgtaatcccagctgctcgggaggctgaggcaggagaattgcttgaacccaggaggcggaggttgtggtgagccaagatcgtgccattgcacccagctgggcaacaaagcgaaatccatctcaaaaagaaacgcgcccattcgtcacaaaggctttttctcatgatggtgggggaaaggccaggtccacgnagngctntcanttanaanttctccccttgaacctagtggagactgggccgctcgacaatatgggg

SEQ ID NO: 538052 - DNA, 106 bp, Homo sapiens
cattgagagtgcaacgttatgcgtgtgtgtgcgagtactatattcacgtgtgtgtgagtacaatgtagtggtgtgggtctggtcacatgtatctttgctttgtgca

SEQ ID NO: 538053 - DNA, 150 bp, Homo sapiens
gagagaaagccggagagatctaaaagcgacaccctagcatcacgattaaaagaactagagaagcaagaggaaaaaatcttaaaattacactagggaggaggaaaatgtgagagtggcggtggtgttgtcggacatggcgcgatgagggga

SEQ ID NO: 538054 - DNA, 1355 bp, Homo sapiens
  misc_feature (559)..(559): n is a, c, g, or t
gtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcngatcacctggggttgggagtttgagaccagcctgaccaacatggagaaaccccgtctctgctaaaaatacaaaattagctgggcgtggtggtgcatgcctgtaatcccagctgctcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctatagtcccagcactttgggaggccgaggcaggaggatcacttgagcccaggggtttgagagcagcctgggcaacatagcaagaccctgtctcccaaaaatta

SEQ ID NO: 538055 - DNA, 1278 bp, Homo sapiens
  misc_feature (559)..(559): n is a, c, g, or t
  misc_feature (1226)..(1226): n is a, c, g, or t
  misc_feature (1251)..(1251): n is a, c, g, or t
gtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcngatcacctggggttgggagtttgagaccagcctgaccaacatggagaaaccccgtctctgctaaaaatacaaaattagctgggcgtggtggtgcatgcctgtaatcccagctgctcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtttnatcccaagatgctgggattacaggngtggagccacttgtgccccggcccccc

SEQ ID NO: 538056 - DNA, 747 bp, Homo sapiens
cacattcagtagagctggggtaaggcctaggaatctgcattttcaacaaccattgcacatgtttttgtttttgctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctatagtcccagcactttgggaggccgaggcaggaggatcacttgagcccaggggtttgagagcagcctgggcaacatagcaagaccctgtctcccaaaaatta

SEQ ID NO: 538057 - DNA, 275 bp, Homo sapiens
cttttcctgcaactagatggtcccatctgggggtgatgggagacaatgacagttcatcaggcattagattctcctaaggacagagcaagatagatcccttgcatgcacagttcacaatagggttcgtgctcacatgagaatctaatgttgccactgatctgacagaaggcagagatcaggtggtaatgtgaggagcggctgtaaatacagatgaagcttcgctcacccacccttactcacctcctgttgtgtggctcagtacaggcctgtgaccc

SEQ ID NO: 538058 - DNA, 895 bp, Homo sapiens
agtttgagttctgtgttctccccgcccgtgtccgtccgacccgtgcacgcgatgctggcgctgcgctgggctcccgctggactcggctgctctccgtcccggctccgtgccgtggcctcccgggccggcctgcgagaggggctccgggaccgtctcttcgctcctcctcggggaacccgctacgatgtacctggacgtggacgccaacgggaagcccgcatcggccgcgtggtgctggagctgaaggcagatgtcgtcccaaagacagttgagaacttcaggagccctgtgcatggtgagaagggcttcggcttacaaatggctccaccttccacagggtgatcccttccttcattgtgccaggccggggcgatttcaccaaccacaatggcacaggcgggaagtccatctacggaagccggtttcctgacgagaactttacactgaagcacgtggggccaggtgtccctgtccatggctaatgctgttctaaacaccaacggtcccagtttcttcatctgcaccataaagaccggactgctttggatggcaagcatgttgtgttcggtcgacgtcaaagagggcatggacgtcgtgaacgaaaatagaactctttgcgggtctacagagtgggaggacatcccaagaaagacttgtcatcaccagaactgtggggcagttgagcttaatctgtgtggccccgggtgttggtcattggtgggacggttgcaatgttcactggcccacagtgtgccgttggggttgttcaccaaggtgctgaagcgaacctggtgaccctccacgtcacaatggcttaagacgtttaggagagttaaaccggcgcaccccacatgtttttataaatacctttccacaccactttggggtttgacac

SEQ ID NO: 538059 - DNA, 139 bp, Homo sapiens
ggtgataggatgaaggggaaataccagagacagttataagtgtctcccaagacagcagtgggtgatgcgcacatggcgcaaacaggctgacttcaatgagtgttcacgggatgtgtgataaagcccagctgtacaattc

SEQ ID NO: 538060 - DNA, 405 bp, Homo sapiens
gcccactcacctttttagtgggctcctgacctgccggccagaaattgccactgggaaacctggacccctactgaatggatctgctggcacctagacctcagagaagggggaactgaagactgatgtctgaccacggttctttgttgaaaatttctttctcaggggcttggagggatcacatctacaatcctgagctaatattctcttctgctgtccccaaaatttaaacgaagcttctcttaacccattgcaaatgagaaaaatctttgaatctacctatgactataagcccttatttcaagatatcctgcctttttaggccaaaaccaaagtgtaacctccatctattgatttacaattttgcctgtaactttggctttcctgaaatttaccccagccttaaaa

SEQ ID NO: 538061 - DNA, 346 bp, Homo sapiens
  misc_feature (9)..(9): n is a, c, g, or t
  misc_feature (85)..(85): n is a, c, g, or t
  misc_feature (196)..(197): n is a, c, g, or t
  misc_feature (301)..(301): n is a, c, g, or t
attcggcanaggcctctccctcccttcctcaggcatcagagcggagacttcagggagaccagagcccagcttgcctggcaagtgncctgtcttcctgacgaaccccttctcatactggccctgctggcatgggttgctctggctgaccaagagtcatgcaagggccgctgcactgagggcttcaacgtggacaagnngtgccagtgtgacgagctctgctcttactaccagagctgctgcacagactatacggctgagtgcaagccccaagtgactcgcggggatgtgttcactatgccgnaggatggagtacacggtatatgaacgactgggcgaggagaaaaac

SEQ ID NO: 538062 - DNA, 180 bp, Homo sapiens
gtgatctagaggtatccccttatgttctgacccactatcacaaaatcacatctttgagcaatggtctatagcttccactttgggtaaagctccaccttccacgaagaaatgaatacgtcttaaagcactctgccttctctgagaacccagttctgcagtagtcgtgacaagatgacttcc

SEQ ID NO: 538063 - DNA, 329 bp, Homo sapiens
  misc_feature (108)..(108): n is a, c, g, or t
cccaagcttcaggtggctcagtacagagagagaaactttggtttggggaacaagagtctgcccggtaatccagtgaactctttcagatcttatccaagaccacaaggntgatacctctatgagtctgcaagaaccatagcattactgggcttggggtgcctctaatgtagatatggctcagatcacaacacacaagtcccttcgaatacctgaaaagccttcccaagaacaggtacaaacaagcccaaactggaaagactatgaggaatacctaattgttcaatgcccagacaccagtgagcatccacaaacatgaagaccatccaaaa

SEQ ID NO: 538064 - DNA, 127 bp, Homo sapiens
acttatacgatccgttagtgaataatcacccactggctggccctctagcacaccttgtacacagccagtagcaagggaaacttgtctaccaggcccttgtgcttggaggatgctgtatagctcccgg

SEQ ID NO: 538065 - DNA, 141 bp, Homo sapiens
ttggctgggtgtggtggcttacactgtactccacgcctgtgggcggctgccgtgggcggatcacttgcaggccggagttcacgcacagcctgggcaacctagaccctgtctctctagaaaaatcctcctactcaggtgtgt

SEQ ID NO: 538066 - DNA, 270 bp, Homo sapiens
gtcaaattgaagccagtgcttatttaccatttcaaaaatttttagggcccttaagggttattctaaatctgctatgcctgcgttctctgtaaatggaaaagaaagactggataacagcacatcggtttatagcatggtttactgaatgttttaagcccgctgttgagacctactgctcagaaaagggtcttataaaatatattactgctcattggcaggcatctggttatccagagctctgatagagttcatcagagagatgaatgtgtt

SEQ ID NO: 538067 - DNA, 106 bp, Homo sapiens
gtagtgcaggtagaggcttactagaagtgtgaaaacgtaggctggattacggcgacagcgatattctcggatagtcagtagaattagaatagtgaagatgataagt

SEQ ID NO: 538068 - DNA, 137 bp, Homo sapiens
  misc_feature (5)..(5): n is a, c, g, or t
gaagnggaaggcgacgtctgagcccggatcctgcccaaccacatagttcacgaagaaccgcttcatgtgctcgctgggcactccttgtatgtaaacagacgttcccacgttgagcccgcccgggatgggctggtagt

SEQ ID NO: 538069 - DNA, 571 bp, Homo sapiens
aataattaattaaattttttttaaaatatataaataaatacatatctaaacttaaaatataaaataaaaaacaatacaacacaatatctcgaaaaaaatttattaaaatcaaaaataccactatccccccacccacaaacccaatcttttttgaaacaaatacattaaaaccacaataaacacctacattttacacaccaacacaataaataaaccgaatataacgtataaataataaacataaattaacaccctctaacatctcaatacactccaacttcaatactcaacattaaataaactaatacatacaacctcaacatctcacaaaaaacccactacaacaacacaaatcccctccataacaccaccccattcacctccatcccttataaaccatcttaataaccaaatcatccatacacaacaaacacactaaaacttcaataattttaaacaaactaacataaaaatccaaaatactctatacacacaacccttaaactcaatatatataactacacaccatactaaacgcaaaaaaattataccacaaacacctcaaacaacc

SEQ ID NO: 538070 - DNA, 1613 bp, Homo sapiens
  misc_feature (442)..(442): n is a, c, g, or t
  misc_feature (1149)..(1149): n is a, c, g, or t
cagtggccgagtgtctgtagtcgtacgtgtgctagcgttgtgctcgcagtgtgttgtgtgctgacgttggttgagtatctgtcgtgtagtatggtgagctggtcgttgtactcgtcgctgttgtcgctcgctcgctatacgttgtagtaggtgcgctcggcaataacataccccgtttgggttgtcaaaacacaccccgccgtttggggcgcacccctattggagccgctccggagggagtccgcaccccaacgtgtgtggccacacagaaccgcgccgggctttgttttttaactccgcgcgccgcgccggtatcctctattacctcggtgtctcttaatggggtactcgaaggtcccttgggggtggccgaaaatttcgtgcatccgtagtgtctggtgtgctgccggcccgggcgcccaaggtggcgcaacgagcgcgngattattctcccagagaaggatggggtaaatgtttttgtccgcccctgtgttgggcgattacgtttctcaaaagacgttgtgttcccttgggagaattggaagcgtttttctttgataccttccgcggggagaaccgttggtcctggagaagaaattggcgctgaccttgcgttcgggaatgttttgaaaggagtgtccggaaggtgtttcccccgcccacctccccgggtccccggactactgcgccgtgtgattccgtgttagtcgcccccccaggacccacccacgagaatggttttctctgggttgaagaaatgggggccccccgcgattttttcgcgggaatacttgagactcgcctcgtattactttccacgcaaagaaggttttttgggcctttttcccagaaaggcgccacgctgtatagaagcctctttaatgcctcgtaaaaaacgtgggggccaccctatgaggggtttctcgtggggggccacattggcgccccgcgcccgaggttcttctggctgcttaccccagctccctataggacagggcctcttcctcgtgtcccgaagggccctcgcctaattggctgttgcccttccggtttcacatccactggaagaatctgggggccccacaggcctttgcgacggtttttcggctgcttctcgcggaataacttccgcagcggaccacgagcggnctataattccctcgaacagtcttgttggaattggccctcgagtcgagtccaccacccgcgaggacccctgtcttaactatctatcctggtgacacctttctggtgccccaccctgtttgctcacgaccacgggttttctgtggcactaccacaggtgaaagagtcacatgctgtccctcgggagcacccacactcggctataagagattggcacctataagaaacgccctcgcccgagccaccctgaggcacttgtggaaaccccacaagaatgaagatatctgcccacccaccccccactcctcacgaaccacagaaagggtgggaaagccacgagagccccccgccacagccccacagacccgtcccccccagcatatacccgggtctccctggccaccgtattctggaatttggatttgtctcctttaaagaccctttattcaattttgtaccaagaccca

SEQ ID NO: 538071 - DNA, 117 bp, Homo sapiens
tgtacccggagtagtatgtacaatatgggagattatcgaagcctggtaggataagaatataaacttcaggtgaccgaaaaatcagaataggtgttggtatagaatggggtctcctcc

SEQ ID NO: 538072 - DNA, 131 bp, Homo sapiens
aatggctttttcccaccccccgcccccccccggtggttttttctgttttgtggctgtgtttagtgccccccccgcttttgggctttcctttggggcaaagaaaactgccccattaaaaacagcctctggga

SEQ ID NO: 538073 - DNA, 649 bp, Homo sapiens
  misc_feature (340)..(340): n is a, c, g, or t
atccaagaagcgtgtgaaaatcatttccagacacgcacaggatggtggttccagtagacaaaggcatcgatttccaagaatttatctttcggaggtggattatttgatgacatgtatgaatgatatggagaaaatgttttcttatatagtggtttgactctatccaatcagtatactagtagagactgaaaatagatttcatggatctagcaaggactgcaggaatgtcactcaacgaagaggaaatatggttactaatacactgagctgttgcaggactagtagttgcttattctattgcgtcagctaatagtctcaacgtggttgatctcttcctcanttatctttgaatgctaagacatatattgctgtgatactatatttgagcaagtgcatgaatttcaactttgagaggaatttgagtagtaggcctattaagaatattatttagacggcgtttcatttcacttgggaggaaaattcacctattgatacgatgtagcataaacggcaaatttattcccaatgcattcaggaccggtcctctataaacaaggcgctgtaccttctggcctagggctataactctaccgtgcctgggggctcacataattatcaccagtatcgatttaccaacgaaagtatggag

SEQ ID NO: 538074 - DNA, 296 bp, Homo sapiens
agccgcatggccggtgaagagagagaaaaagggcttttgtctgcagttaggaatttaggtgagcgaatactgtcctagacagttgggagggacaggctgatggacagaagagagaaattcctttcaatgacaaccaagctgaactattcgataccagcagaactgggttctttagggattaagccaagacaaagacttgggaatcactcactccgaggatgaagtatgggttaatggctgaggagacagtcaaaggaatagagaggcctggctttgagggcctcttcaccggccat

SEQ ID NO: 538075 - DNA, 317 bp, Homo sapiens
aggtcggtggatcacttgagctggggagttcgggaccagcctggacaacatagcaaaacctcgtctctacaaagaaataagaaattagctgagtgtgggggtgcatgcctgtagtcccagctactcggcagactgaggcaggagaactgcttgagcctaggaggtcaaggttgcagcagctgtgaccgtgcatgccactgcactccagcccgggtggggaaaaagaaaaaaagaaagagataagatgaggaaaatataacccctatctattactttttctgaattcaaggattctgaattatatctttagactaaga

SEQ ID NO: 538076 - DNA, 106 bp, Homo sapiens
gcgagtaagctcgactgaatcacagtcaatgtcgagccgtaacgtgatggcgatcacactctaccaagaccggtgcaaggtatcctggtactcttgtcagactctc

SEQ ID NO: 538077 - DNA, 129 bp, Homo sapiens
ctgatggaggagctaggggggtggaggggccggatgggaagagcaaaggagaagggagcttggttcttggccgtggcatttccgtggacatgcctgcgtcagggtggcttggggctggcacggggtgtc

SEQ ID NO: 538078 - DNA, 117 bp, Homo sapiens
ggatttgctggtgcagtacaactaggcttaatagggacatgtagaataaactcaaagacattcatacccagatgcatcataatgaaattgtcaaaagccaaagtttcaaaagcaaaa

SEQ ID NO: 538079 - DNA, 193 bp, Homo sapiens
gactgctatcaggatccccactgtctctcctatcctgtaaacctactgtgacgccttacagtggtcctccatgttagtgcgttgacgaacgtggtgactcgtaaaaaccctagcgattatcacagtttgtcccaggcttgcagatgttagaagctttttctttaaataaggcacaggatacttgcagttgtta

SEQ ID NO: 538080 - DNA, 604 bp, Homo sapiens
ggttgtactggtatcctatgagacatttccacctacctctggtgccacaggcacctcaaggtcggtatatcagattcattcttggaaccgcccttctatgccgggttaatattatacttttcccatacagccagtcagcaaaccagatgcctgagcggctccctcaatcccccaccctacccaggcatccaggggcttattttattttattttattttattttattttggagacagagtctctcttggtcacccaggcgggagtgcaagggcgtgagctcagctcacggcaacctcggcctcccaggttcaagccattctccggcctcagcctcccaagaagcggggtctacgggtgcgtgccaccaggccgggccaatttttttggtattttaagtagagacagggtttggccaggtgggccaggtgggtcttgaactcctgacctaagatgacctggctgacttagcctcccaaagggtggggattacagacatgagccactgagcctggccacgttcgtggcttttgaattgcaaccattgaaatagatcttgattccgctgtgacctctagcttctttatcttcaatggcgcccatcctt

SEQ ID NO: 538081 - DNA, 236 bp, Homo sapiens
ccccggaaagtgaatactgtgtatagggtgcatggaacgaggtctttagtctctgtcacaaacaagaatattctagtttcatgaatatcccactggccttgccctgcatctcctcttgtgctcttccaatttccaaggatgtacctacttggtggaaggagggtatgtgggaaatacaacagcccctctgtatctctttctacccgacattcacttagcaggatggatttaagaac

SEQ ID NO: 538082 - DNA, 216 bp, Homo sapiens
gtcaccaagaccgaggccaaactgggcaccttccccagggccctcaagaagctcctgcacacaataaacgcgccctcgttctttagcaagtctgctccctcgaggccacagcaagccggctacggagcccccgttctgttttgagccgaagactactttattggatgcggtgaaaggcctcagctctgacactctgatcactgtgacaaggggccc

SEQ ID NO: 538083 - DNA, 132 bp, Homo sapiens
ctcgtgccgtttttgggccacgttgggggtactcgtagtacttcttggaggccgcctcaggtctaaataggcctttttccaccccggccagggtatgccttatctaaggtcctaccccaattctcccatttt

SEQ ID NO: 538084 - DNA, 210 bp, Homo sapiens
  misc_feature (160)..(160): n is a, c, g, or t
  misc_feature (202)..(202): n is a, c, g, or t
gtcgcctctacacggactccccgacacgggtgactgcggttgacggactctgactagactgcctcgggtgtggactctccccgggtaccgggtgactgcgggacccggactctacgaccacgcgactagtggaccccggactctacgacaaccgactgtnctacgactccggttcccggactcaccccggagtacccgacgnctcgacac

SEQ ID NO: 538085 - DNA, 871 bp, Homo sapiens
agcggatcatgagttcaagaaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaaaaaaaaaaaaaaaaaaaaaaaaaaaaagtattccttgtggttttttaaaacccaaaccccctttaagggtgtttgtggggccccacagggggaattggggaatagaaacgcgccattttttggtgggagaaaccctggggtgtgtcccttttttcaaacaacctttttaacaacaagaacgtgttgggaacggggcgggcgctcttcccatttagaagggagatttgcgtagaccagaccccaaggcgtcctcaagaaccgacgcgaagaaacggcgtgggtcccaccgtattaatacccgcatttagtattcattattgggcggccccctgtgtaaatctccccgggtaatgtgggccccatctttagacaattccagttaagtgactccgtggcgtgaaacactgtgccctaatgtgtgcggcctggcaaaaaaaccccgctcgtaagggggggctttactctctttctcccacacaacagaagacgaattcttttttgacaacaccgtgctgcgctgtccacggggggtttaatgtcgacgaacacaagaaccccccgacggggcgccgccaaaaataatccttctttataaggccaaaatgtcaaactgttatgcgacgggcccagaaaattggt

SEQ ID NO: 538086 - DNA, 738 bp, Homo sapiens
tttctagctgcaggcagagcagagttgagcgtgtgggagtcgaaggagatcgagatggctactgcatatgctcctccgatggcaagccaggtgatgaagagcggcttggtgtgctccaagccgaggggactgtccggcgcttcactcaccaggaggccccgcttcgtcgtcaaggccgtcaagtccgacaaggggacgtaccaggtggtccagcccatcaacggcgacccattcatcggcagcctggagacgcccgtcacgtccagccccctcgtcgcgtggtacctctccaaccttcccgcgtaccgcaccgccgtcagcccgctcctccgtggcatcgaggtcggcctcgcccacggctacctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgccctcacgctcaccggccgcaagaaggaggccgacaagctgcagaccgccgaaggctggtcccagttcaccggaggcttcttcttcggcggcgtctccggcgccatctgggcctacttcctcctctacgtgctcgacctcccatacttcttcaagtagattatctattattggcatgcatgtacgatgggtgcacaactgcagatgatgtga

SEQ ID NO: 538087 - DNA, 253 bp, Homo sapiens
tccctagagacgtgttgcataatggttgtcctggtccatcagaagcactccatacgtgatattgtcctatactcccttacaaatttaccaagagctgtggcctatctctacaacttgttcctactattacaccttcactctcagctccagtttgctgtcccctgaacttacctcatttcagtgcctttacacctgtttcttcacctagaaagttcttccttatttctgctcaccattgcaacacggtctctca

SEQ ID NO: 538088 - DNA, 152 bp, Homo sapiens
aggatctccctctaaacatatcccgtgagatgttgcaacaaagcaaaattttgaaagttatcaggagaatttagtcaaaatatagcttagaactctttactgaactaggcggagataaagagaactacaggtattctatgagcagtctctaa

SEQ ID NO: 538089 - DNA, 236 bp, Homo sapiens
cctcccaagtcgctgggactacaggcactgccaccatgcccggctaattttgtatttttaaagatggggtttagagatggggtttcactgtgttgcccaggctggtcttgaactccgggttgcaagcaatcttcctgtcttagcctccccaaatgttgggattataggcatgagccactgcaccgggccaactctcagctttggagtttcagtatgaactttggaaactcatagca

SEQ ID NO: 538090 - DNA, 1567 bp, Homo sapiens
ggaagaaaatagggatcaacctctacagttcatactgtcttccgagacatccggatagcgtagctatctgaatgggttaggacttccaccatctgcctgcagtcgctaggtgatctctatcggtctggggaagaggtggatgataaacaatctatgtagtcagcagtgcgtaatgaccttcaacactagtaggtcttcgctggatgtcagttattatgctgatgatcctgatggacttggcaaatagggagcgaagttacaaaaaactccctatcaaagtctatggcgcataatagtgattgttcgacatataatggggactgcatatatttgtctagtggaggaagatgacagatgaccaaaagtgtgctagacagggttgttctatcatatgcaatcccgcgaatacacaacggagagttgtgaaggatctgggctccaattgaaaagttcctcgttccatgtttggacgtagtcgatgtgccataaacggggacattgtgattgcaggaggtgtcctgaagatggtctgtcagctgtcagtttgaagctttcgacttacataaataaatggggatgtaagtgggcgcattgcccccatgaaagaagtccagccagggatggtcaggctggctggatccctgtttgccctttgtgggttcggccttcatacactggggtctttagccatttgggcccctggagtcccgcactatgggcgggtgcgcaatttcaacaagaaaagggcgcgggtgggcggcgaacaaataggtgcccgagaattcggcggcacggataaactctgcagaagcgtggacggcaccaacaggaggcgggggagagagggaactatacttgtgcagcgacacaacattacggtgagtcctgtctttcgtttattcatttgtcgattagtttatgctccgcaccacgaccacgaaaccaacaccgacatcacagacgcgatctacgactccaaaacacccacccaccgacgcaacaacgaaccaatgagggagaaaggaggaccaggaagcagcgagacagcagcaccgagagaagacggagagcagcgcgagagacgaagagcaggacacagacgacaagacgacggaggaccaacgagcagaggacgcagggcacggacgaggaccgcagacagagcagaagcgagagccgaggcagcaggccgagagacgcgcaaagacggagcgcagcgcaagcgaccagagcccacgaacgaccaggagcaacaccgccgaaggagcaaacgacggaacacggagcacccggcgagaccaggggacgtagaaagacacgcaaacaacaacgcaagaggcagagggcagcacgacaaccagaagaacgcaagcaccagacgagcacagaagaagacaccataacaacgcgccagcaggcaagcacaagcacacgacaaaacaccaaggacaaaacaggacagaacaccaaggaagaaaagaggagaggaagaagacaaaggaagcgagacaaaaaaaccaagagaacaaagaacgagcagaaagacaagaaacaacccgagaccgct

SEQ ID NO: 538091 - DNA, 892 bp, Homo sapiens
tggggggcgacgtggcggcggatatacgttgcaaccctgtcgttttgcatatttcggggaatcttatatagtggggttaccccatgggtggaccacacagttgtgtgttcgtacacggtgtttcgccgctgcaatcttgtttcccgcggctccggtgttgttcccccccccgtggcattttcagttggtccctcgggtcggccggagcttcggcctttcgtcccaaccggcacgtcggcggttttggttcccactctcgccgatgtttgtgttagcccgaaaggtgttggcgtttggccccctcttcgcgttttctttcagcatagggggcttctgtgccctcccacagtgggtggttgccccaggcgtgcccccttatttgtctcggacaattaccctgttgtcggacttctacccctcggagcgcgtctgtgctagtactattgtcatccggggctgaatgttgacttgtttctagtcgccaccacagtgtttcgtcgcgtttcccgaagttacgccggaatctctatgggggcagcccgcctgctaggcaagagccaccctcataactgcttccatgcacgtttggccacttcattttttcttagcacacggcacctacgaattgtgaaataatcgaatggagagattggtagacgccactctgctaatatagctgcgtaatatctcttcgtactattgaaataacgccccctcactatcgctcggggtgcacaacaatgggaggtgtcgccccccctcttcgcaccacttctgtgcggcagccccgtataaactattgtaatcccttcaaccccatgcaagggagggaggagacccccccacgctgggggtacaccaacccacgcgctccaaacctttccacataaca

SEQ ID NO: 538092 - DNA, 164 bp, Homo sapiens
caatatatttcgcaagctcatgtccacatcatttcacatagcaacaggaaataaagttgtatgtgctttgaaaccagccaaatcctttgtacaacacctctcttctccttctatgtttatgaatagagttcgtggcatattgccatagtgcacaatcatgactt

SEQ ID NO: 538093 - DNA, 609 bp, Homo sapiens
agtaagctattaggcgcgcaaagtaaatttggtcgcatcaatatcggataagtagtagcacgcccagcccagggaaagaggggaagcaatttcgtatgaatcgaaaacgtctaaatattctcccatagaaagaagaaagacctgtggtcacaaaatagttgaaactttattaagagtgttagatagtatcgtgatcggaccagtctccatatataaaggcacagctttatgacagcagtatcaggctgatctctaaaccatatatgcatcgttccgggttcagttaaagtgtatgcactacagcagagcactctcttctccgggcagggcgtggtacatttagcacccacctcttagagcaaaatttcacacagaattgcatcaatccagactgaagaccgcagtttctgtcactgctgtagccattcagcacaacgcaggttaaaggaatcgtcactgacagggtttgtaaacaagtcataccacaggtgtacacttccatgacaaacaagcattgcaccagtgggtaacatcagtgactgcatatgattccatggccgataaacaactctgtcagtcagtcgagaataatacatcagcacacctcat

SEQ ID NO: 538094 - DNA, 134 bp, Homo sapiens
tcatgctgtacagtgacctacagtttggtaagatgtcatcaatggaccagctccatgtgattcaagtatatacaactaccaccatgacccctccaaccacatataacaccgccacccctagttcgcttcactgt

SEQ ID NO: 538095 - DNA, 1060 bp, Homo sapiens
atgacactttggtgctcatcctttcgtgggccagacacagagttctcatgctcacaatggcgagcgaggtagcacgaaaccgaactgactgggtatcgtggatgatcagcagactttcttctgtggcaacgtggctcatcagcagcttatccagatcacttcagcatcggctgcaggttggtctctcaagaacccaaagctctggtcagtgaatggaatgtgagcctcaggccaagaacatcacgtgtgtgcctcctgcaatagcagcacaggtgtgtggtgtgctgtaggcatggtgccctctactatctgcagatccatacctcaggagctccgtgcagcatcagccacacagacgatggaacatgcaagatggactctgctctggacaatcacacccatatagtgagacaagcaaatgcgacatggtccccatcattctgatgccacttgcgcactcatggacaggacaatcatcggaatcgaaaatccttgaccagtatgccctctttcttgcacacctagcgtgccaccaaggcagcatgcatgaggctgggcacgacgcactcattataccatcgacatccaactccctgaactgcacaccaccacaatatctggaagcaagattacgcacctactcataacccattcccatattgctagccacgtatggagtgcaagaacttgtgcccgctggcctctataactcgcttaaccttcctggagtgaattacaaacaaaattcgcagcaccacaggacatacctggctactgaaagcccaagaacaaccggccacaaacgccaaccacggcctgcaacaaactaggagcgaacaaacccacacaaagaaccacacaccaccccggatacagatacggacgagaaaacagaccaaacacaggcaagcaacgacacaaaagacacataaacacaaagacccacaccaccggcaccgccatctacgaacactagaggagacaacccgggacccacaggagaccacacaaacgtagggatacaagcccgaaaccttaaagaataacagaaaaaaaacag

SEQ ID NO: 538096 - DNA, 413 bp, Homo sapiens
  misc_feature (335)..(335): n is a, c, g, or t
  misc_feature (339)..(339): n is a, c, g, or t
gcgtggtcgcggccgaggtacattcttgtagaaccgggttcgtttttccagttttgtagaaaaatagatgttccagccaccatttacttaactgtctaatatttaagaccaatcaatatgttccctggaaagatgaaaaagtctcatgactaactcgtttttttaaaaattctttaaaacaaaaagtgtgtgtgtgtgtgtgtgtgtgtttactctcaaagcacagcatttccacagcagcagccaacatggggtttagtagcttcactcacccctaactaaagctttgaataaaccagtgatttactacaaaaaacactgtccttgaaagaaangacngcagtcatacatgaacgtgaaacttggaatgatcaggtcctaaacatggcacttaaaaagttacttatcaaaac

SEQ ID NO: 538097 - DNA, 239 bp, Homo sapiens
aacagaccttggtgcacaggtacggtggacgaagttgtagtgcacacgccgagaacccagacttcttcaagtcacaggtggacgaagttgttgcccactgcgactcgcaacaacttcgtccaccccgacatctgacacaggtttggagcctcggcgtgtgcatgcacacgccgaacaaccagactgcacacgccgagtcccatatacttcttgaaaggtcacaatggacgaagtggttg

SEQ ID NO: 538098 - DNA, 428 bp, Homo sapiens
  misc_feature (428)..(428): n is a, c, g, or t
cactgaccgagagctactatattgctgcgccaacaactgaatatgactagctcacacaatagcttttatagtaaagatacctgtttacggactccgcttatgactccctaaagcccatgacgaaacccccatcgctgggccaataggacttgccgcagtactcttaaaactaggcggctatgctataatacgcctcacactcattctcaacccactgacacatcacataggctacccattgcttgtactattcctatgtggcatagttatagcaagctccatctgcctacgacagacagacctaagatcgttcattgcatactcttcaatcagccacatatccctcgcagcagccattctcatccccgctgaagcttcaccgacgcagtcattctcattcgcccacggacttacatcctcattacttn

SEQ ID NO: 538099 - DNA, 1119 bp, Homo sapiens
  misc_feature (147)..(147): n is a, c, g, or t
catgtttttttcccggtgtcaaccgacttctggtaaaaatctataaaaacgggggccaaacacaatgtggagatcaaggtggtccatgcttaagggaaaagaaaggccctggaccacaaggtggattgctctgtaattggggagagnatctttgtgcttgctctgccaatgcagtcttggttctaagttcactgtgaccacgaagcagctgactgtgcatcacgcagtcacaatattgtttttagggtgagggtggaggactgtgtgtccgtggattactcctcctgctggtggattgcagatgcattattaggtcatactggctagaatgcagcttttctcccaccataacatgaaaacagtgtaagaacatagggtgctttgtgcatagcccttctctatgtaagcagccatggcagtcattaaagagaaaggagtagctttgacattaagctccccagatccctgctgctcatacttctggcaagggttcccctctctcatgcatgaacaggggcatccaaaataagaagctctccattctgtggtggggaaagcggagaggggagtgggtgaagctgggaaagtaaaggcagcacgttacagaaggaagaaaggaagccagtaactgagggcccactgcctgcccggccctgggccaggccctcaacagaagccatctcatttaagccctgcaaccaatgagatgcacgtcatcattggctcttacagacaagaaaactagactcagaggggctgagtccacatcccagacagctcactgcagacacaggtggagtggttcctacaagacatccagttttaacaacaaaagagttattgaaatgcatgggtagaaattgaaccaggaaaatcagtaaagtgattgtaaaaaagaaggactagcttgcctggagatgatgtttcttgcttttggaaaaaaaaaaaaagtctctgaaatttgattcttactacagatttaaaactttctacatattatatgtaggagctcctagtgtttttgagaaattagactgtacctgtgtacacttctaaggtctacatggacctatgtatatatatctaagacctctgatcattaaaacctataaaaggttg

SEQ ID NO: 538100 - DNA, 192 bp, Homo sapiens
tggaagatagattctttcaacaagtaattggtagtaatgactgtgttcgacttcaatttgggagcgcagtagctattgttaaaagatagaactatttgggtctcattggaacgccaacacagaacttgctggctggtgtattttctcttcagtggatcaaataaaatacttacaaaaaaaaataaaaacggg

SEQ ID NO: 538101 - DNA, 374 bp, Homo sapiens
atttacgttattttgcaacaatcaccaccatccatctccagaattgttttcatgtttccaaacggaagctgtgtctccatcaaacattagctcccattctccccaccccctagtccctgcaaccaccatgctactttctgtctctataaatctgactactctaagtacctcattgttagcatcatgtcctcaaggttcatccatgttgtaacatatgtcccaatggccttcctttttaaggctgaataatattccattgtatacatgtatatactacactttgtgtatccatttgttcgtccatggacactcaggctggatgtaccgattagctatggtgccccctgctgctataaacaagggtgccaaaaaaa

SEQ ID NO: 538102 - DNA, 341 bp, Homo sapiens
gcggaccccagagagccctgagcagggcggggctgagtaaatgccggcttaccatctctaccatcatccggtttagtcatccaccaggaggaatatgaaattccagcataggaatgacaaaggttggaagctgagactaagtgcttcttttgccgttgacagttaatagactatctgcattatctatgcagcatggggtttttattattttcactaaagacgtctcttttgggtatacaaccgtgtttttaaaaaagctggttttctcatacgctttaaggttttaattgttcaattctgcaggtgagatttgagactcattttattgtataagttcactg

SEQ ID NO: 538103 - DNA, 492 bp, Homo sapiens
ggctttcctatgttggccaggctggcctcgaactgctgaccttacatgatctggccgcctgtgcctcccaaagtgctcagaattcaggcttgagcctctgggcctggacgaagatcgatcttttagacatcaggactagaccggcatgattgataatattgatctcctatccgttttaacataagcagcaaggagttctaagttaaacaaccaccatagactgtcaataactttaagacataactttccgataccagaaaatgaaatgcctcatggcagttcatagattctgaaataagtgccatgacaattgagtgtgacaaacaggtgtaaaacttgtactaagcacctaacagcataattggtttaggattcacgcctgcaactcgtaaaaggggcagcatctatgaaactactcttgttagacattacacagaatgcaaggatggactgagatccctcaactatagctgttggctagatatcctatag

SEQ ID NO: 538104 - DNA, 116 bp, Homo sapiens
ttgtgagcttggaggggaggcagccaactcccacacctgcggactgccgctgagagaccagccctcgtccagcccgctgctccagaccgccccagaggtcaaaggtcaccagcggg

SEQ ID NO: 538105 - DNA, 832 bp, Homo sapiens
cttctctcgcgcctcgcctcttcctccgcctcctccttcgcctcttcctgcctcctcccggcttccgccgccgcactccagcctaatcccaaccccaggcgaaggcgttcttatttatttccgttttctcgccactacagccccctgacaaggtgatccgggcgggccccgagaaatttttatcccctcaccggcctcacactagtatcgcatgtccattatccagaacctccaatctttcgaccccttgtgctgatgcaactaagggtgacgacttactcccggcagggcctgaggattcacatccatataagaatccagcaacgggaacggcagaaaagacactgactatgtccaggccatgtgcagattgattatgaccaaaaagaactctgtgtgaaagctttccaaaacagaaattgtgcctgtaagtgtactgtgacttgacctcctgaatacggagaggtaatacagcttcaggggtgcccaaaggaaaaccttctgcagttcctcctgaggtggctttgtaaggggaacagctaaggtccatggattctaaaatgaacctcaatacggtggagaattcccttgcattcgttgtgtctctaaacccggtgtggtgccttgtgaagtgattccttgcagtaaccggacttccctttatttatcatcaacctccatcactctgcttggtacgaaactgcgttgtgactgtacccttaaattgggtcgtgtcaaactctttgtgtctgttccacgaagtgggtatgcgaacccccaggaattggtgtacgggggtaaaaattttgtgttccccgaaaaaaatgccgat

SEQ ID NO: 538106 - DNA, 491 bp, Homo sapiens
agttattaattaagtgaaggctacgagtcatttgaatttaattttatttttagagactgagtttcgctctgtcggccaggtgggagtacattggtgcgatctcggctcactgcatcccctgcctcttgcgttcaagcgatcctcctacctcagcctcccgagtaggtgggactaaaggcacccgctaccatgcctggtctcatttgactttgaaagaaaaaactgtgtgtaatgccagcattttgaaaggccgaggtgggtggatcacttgaggtcaggagttcaagaccagcctgggcaacatggtgaaaccccatctctactaaaaatataaaaattagccagcacggtggtgcacgcctgtaatcccagccactcggggggctgaggcaggagaatcactttaacctgggaggcagaggttgcagtgagcagagaaggcaccactgcactgcaggctggttgacagagccagactcagcctcaaaaac

SEQ ID NO: 538107 - DNA, 100 bp, Homo sapiens
  misc_feature (86)..(86): n is a, c, g, or t
  misc_feature (89)..(89): n is a, c, g, or t
gtttccttcatcatcatgcacatgctgcatcatttcaacaggtcagcatctcatagtggtcacggcattcacacgcggggcatccntcntcagcagtcgc

SEQ ID NO: 538108 - DNA, 374 bp, Homo sapiens
gctcgacctttgacaaaattcattcactggtgcaatgcaaatctctatcaaaatatacaaccatcaaaatatagaacaatctagtagggtgtggtgactcatgcctgtaatctcagccctttgggaggtcgaggcaggcgtatcacggggtcaggagatcgagaccatcctggccaacacggtgaaaccccatctctactagaaatacaaagagttagccgggtgtggtggtgggcgcctgtggtcccagctactcggggggctgagaaaggagaattgcatgaaccctgggggcagagcttgcagtgagccgagattgcgccactgcactccagcctgggtgacagaccgagactctgtctcaaaaaaaaaaa

SEQ ID NO: 538109 - DNA, 231 bp, Homo sapiens
tggggacatgaaaaggggatgaatgacaccagctaaaatcctaaatattgaatacactcaagccttattagccaggagtgatcacatgcccaaaactcccctccatcccagcactatgcacagtacacggctcatatgcaacgtggaaagcacgtgggacaagagcaaagcacaagtgacacatggtccctctcataacacctcagaacaccacccctggctagacccagg

SEQ ID NO: 538110 - DNA, 108 bp, Homo sapiens
tgactcgtaccctcacaagacctgcagaagcaggaagcagcagaagcagaagggcagaagcaggaagcaagggtctggtggcagacaggaagcggcagaagcaggaag

SEQ ID NO: 538111 - DNA, 538 bp, Homo sapiens
  misc_feature (314)..(314): n is a, c, g, or t
  misc_feature (344)..(344): n is a, c, g, or t
cgaaatggcaccctcgcaaaggggaaggaaaagaaggagagaaccacggtcactcacgcctcggagcctccacggtggctgtaaaggagagaaatgtatttggtgtctgcccacaaatcttgtgcatcccttccaatgacactttgtgtcccaagtcacgtgatctttttggccaaggaaccctctgcccgtgtgactggtgggattaaggttaaggccagaccgagatgaatcctccacccatatgctgctatgttggctgccccggatgtgcccagaggtgaaggagctgggtatcaccgccctacacatcnaactccgggccacaggaggaaataggaccnagacccctggacctggggccccatcggccctcagagcccttgcccgctcgggtattaaggatcgggcggattgaggatagtcacccccctcccctctgacagacactccccgagaaggggggtccccgctggtccccctctgtgaaccagattcctccaaatattttttgttaaattaattgcccttcatgtta

SEQ ID NO: 538112 - DNA, 574 bp, Homo sapiens
  misc_feature (574)..(574): n is a, c, g, or t
accttgcttggcactacggcaggtggctgggagagagtgatggagagaaaggctaagctaaggtcacagaaagtggaggaaggctggcttgtcccgctggacttgacggcggagctgctgcaatctcgcgggctgtggcccttgccccgtggtgtgaccctgagtgcctgctggggagtgcgtggtgtggctccacccgtggaggtgacagcatggctgtggggccccgtaagggagctggtcttgctccgggctcccctctcgtagccggcgccctgggaccagcgcgtgagcacgtctcggaggagtccgatgcgctgggcagggccggggtggtcacccccgcccagcttccagtgggtgactgtgcctctgacgtcagacggctttgtgggtcattcccttggcacaggggcacttaattttcataacaggcaatgaaaggatgcctgtggggaaaactggggacactagggcagtggtcagctcttcccccttcggaacacaatcacacacatcacatatgtttgcccaatcgtgacatcaaccccactcgggatcggtacacccatcn

SEQ ID NO: 538113 - DNA, 213 bp, Homo sapiens
ggcacatcctgaaacttctgctcccgggctaaagtgatcctcccacctcagcctcccaagtatctgggactacaggtgcgcaccaggacacccagctgattttttcaattttatagtagagatggggtttcaccagtgctggccaggctagttcttgaacttcctgacctcaatgtgatccaccgtgccttaagcctccacaaaatgcctggg

SEQ ID NO: 538114 - DNA, 535 bp, Homo sapiens
  misc_feature (79)..(79): n is a, c, g, or t
  misc_feature (86)..(86): n is a, c, g, or t
  misc_feature (97)..(97): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (110)..(111): n is a, c, g, or t
  misc_feature (121)..(121): n is a, c, g, or t
  misc_feature (142)..(143): n is a, c, g, or t
  misc_feature (160)..(160): n is a, c, g, or t
  misc_feature (166)..(166): n is a, c, g, or t
  misc_feature (223)..(225): n is a, c, g, or t
  misc_feature (320)..(320): n is a, c, g, or t
  misc_feature (323)..(323): n is a, c, g, or t
  misc_feature (333)..(333): n is a, c, g, or t
  misc_feature (348)..(348): n is a, c, g, or t
  misc_feature (367)..(367): n is a, c, g, or t
  misc_feature (377)..(377): n is a, c, g, or t
  misc_feature (387)..(387): n is a, c, g, or t
  misc_feature (429)..(429): n is a, c, g, or t
  misc_feature (451)..(451): n is a, c, g, or t
  misc_feature (506)..(506): n is a, c, g, or t
ttaagtaaaggaggtaaaaaccttggcttaaaaatctttcttttccaaccaattagtggttggtaagttcccaacatcnaatgtgnacacttaagtnggnccttnanacnnaggctttcantatttcctttaaaatgaggannattattttcaaggcccncagcanatttgtatagttgcttgcctgatataaatgcaatattaatgcctttaaagtatgaannnatgccaaagatcacttgttgttttactaaagaaagattacttagaggaaataagaaaaatcatgtttgctctcccggttcttccagtggtttganacnctggtttacnctttatgccggatgngcttttttccaaaatcagngctcgagacncagtgaagcnaattaaaaaaaaaaaaaaaaaaaatccctgaatgatgattanagacatccccgctaaaaaactncatttataagctaggatttgttatatgcaaaaattttctgcctcttcttttgttntgtttaaaacaataaaatgcatttgtata

SEQ ID NO: 538115 - DNA, 258 bp, Homo sapiens
tagtggggactacagatgggcaccactatgcctggttcattttttttttttccaggtttttagagacagagccttgctatattgcctaggctggttttgaactccaggcctcaagagatcctcctgccttggcctttggaggagctgggagagccactgcatctggctaatttttggggtttttttaagagacagggctgtgttgcctagcctggccttgaacactggacctcaagtgatcatcctgcctcagcaggc

SEQ ID NO: 538116 - DNA, 771 bp, Homo sapiens
  misc_feature (315)..(315): n is a, c, g, or t
  misc_feature (322)..(322): n is a, c, g, or t
  misc_feature (333)..(333): n is a, c, g, or t
  misc_feature (336)..(336): n is a, c, g, or t
  misc_feature (341)..(341): n is a, c, g, or t
  misc_feature (343)..(343): n is a, c, g, or t
  misc_feature (346)..(347): n is a, c, g, or t
  misc_feature (357)..(357): n is a, c, g, or t
  misc_feature (378)..(379): n is a, c, g, or t
  misc_feature (396)..(396): n is a, c, g, or t
  misc_feature (402)..(402): n is a, c, g, or t
  misc_feature (459)..(461): n is a, c, g, or t
  misc_feature (556)..(556): n is a, c, g, or t
  misc_feature (559)..(559): n is a, c, g, or t
  misc_feature (569)..(569): n is a, c, g, or t
  misc_feature (584)..(584): n is a, c, g, or t
  misc_feature (603)..(603): n is a, c, g, or t
  misc_feature (613)..(613): n is a, c, g, or t
  misc_feature (623)..(623): n is a, c, g, or t
  misc_feature (665)..(665): n is a, c, g, or t
  misc_feature (687)..(687): n is a, c, g, or t
  misc_feature (742)..(742): n is a, c, g, or t
atgaaccaatgggaactactactccgataattcctacctccaagcaacaaactacacacacgcactcagcatctactcccacgtatggggttcaagagagtaatgggtttcatatctcttatcaccacagtaagttcctactaggcaaaatgagagggcagtgtttcctttttggtacttattactgctaagtatttcccagcacatgaaaccctattccatcccaaaaaaaaaaccacacgcctcacaaaatcccacccttgcctgaacatccttccttcatccccatcacaaaaacgccagttcccaacatcnaatgtgnacacttaagtnggnccttnanacnnaggctttcantatttcctttaaaatgaggannattattttcaaggcccncagcanatttgtatagttgcttgcctgatataaatgcaatattaatgcctttaaagtatgaannnatgccaaagatcacttgttgttttactaaagaaagattacttagaggaaataagaaaaatcatgtttgctctcccggttcttccagtggtttganacnctggtttacnctttatgccggatgngcttttttccaaaatcagngctcgagacncagtgaagcnaattaaaaaaaaaaaaaaaaaaaatccctgaatgatgattanagacatccccgctaaaaaactncatttataagctaggatttgttatatgcaaaaattttctgcctcttcttttgttntgtttaaaacaataaaatgcatttgtata

SEQ ID NO: 538117 - DNA, 464 bp, Homo sapiens
tgtgatgtgtagtaatgtggaagtcagtgcttgggatcagtagtgtttctaattctttcaaatggtatagagcaaaaataacttgcagcacacttttgtgcaccataatgattttatatgtatatttgaaacaatatgttttgttttagaaacaaatttttcattataatttgcctccagtttttgcttttagaaaagtatcctgggttcatgcctgtaatcccagtactttgagaggctgaggagggaggattgcttgagcccaggagttctagatcatcgtgggcaacatagtgaaccctcatctctacaaaaaataaaaaaattatccaggcatagtgttgtgcgcccatacctcccaggttgaggtgggaggattgcttgagcccaggaggtcaaggctgcagttagctataattgcaccactgtacaccagcctgggcagcagagcaagatgctgtatc

SEQ ID NO: 538118 - DNA, 350 bp, Homo sapiens
tcataggcatgctcctggggctgagctctttccttttcattattctgagtttggctctggacagcacctgccattgagagttgtgggctctcaccctctggtagctgagctaagcactgtcattcttggtgccatcttcccttccgtcaccggcattctcagcccagcccccacctttgtgttgtaggttgtgctctcaagcaacacagatcactcttccctttgccccttccccagagggacttgactttctttctggactgtttttattgaaacaaagtggtgtcaaaataaatcgcttgcagggccttgtttcctgttggtctgagtgaagcattgaataaaaaaaa

SEQ ID NO: 538119 - DNA, 1129 bp, Homo sapiens
gaaacactgtatactgcctatatatattagttatgcaacggatgtacttagtacatgtgtattccatgcacatcagcaatatcccaatagcagcatcaagcttgcacttgaatccattttgcagccaattttgccctgtgttatatgtgtttcacgccaccatcatttgcagcttggcatttatctccaacagaaagtggattcactactcggcacattaacaagcaccaataggtttttattccaactccgagcactgtggttgagtaacatcacctcaattttttattatccttaaagcatattgcattttcatattcgtttattgtataaaggcatcaatgctgctgtcaaatacaggatatgttttaatctttaaaatttcattccaccaccgatcagatgccagttcccctcattctcgctttcacatgcaaggggcatcatatacagctattctaatggctgtcttcagcaacatttcatcaaaatgtcacacatactgcattcgactggtctttaaagcatgtgttatcaactagtgaggctatcttaaacgcaatcagtgtggcatgctgcatcggtcatcccaggtcatccaagtacttcatccattgcatccttcgctgtccaaacacacccaatcaggcacaagaaggagacacactgcacgctattcatttaccagaattcctttgatcgcgacagccatctaccaacactggatgacgtactaaataaaacctcctgcaatatctggcctccaggaattacatcagaatctcgacgccgtcaactctcaggggccctctacatcagggctaaaaagcgctggaggccccaataaatgggtcacgcagcccacaacaacacacaacggaaccctcactacagggaggcccacagcaacacggcgccacaacaatcatcggcgcagtggtaccgccacccagacgcaagaaaaacgaccgcttaaaagcgtcaaaacaacagacatacaatgggaggcacaaacagagtgagaaactccacaccagaagaaacagacacacacaacaccgaaacccacacggcaaccgaacccggagaaccagcgggacctataacccaccgcattcaaaacacaaga

SEQ ID NO: 538120 - DNA, 898 bp, Homo sapiens
ggtggctcatgcctgtgatcccggtactttggggggccggggtgggcggatctgcgggctcaggagatcgagaccgtcccgagcggcatggtgaagccccgtctctactaaaacacaaaaaattagccgggcgtggtgtgtgcacacctgtagtcccagctacttgggaggctgaggctggggagtcgcttgaaccctggaggtggaggttgcacgagagccaagatcacgccactgcacttcagcctggtgacagagcgagactctgtctcaaaaaaaacagaccgaaccttgaacagaggctattgtcaagctgggctcaagtgaatatagcactgatagtaaacagcactgatagacacctctgtgaatgttcagctatgaaagcagagttgtacgagcataggaaccaacacattcatttagcacttagcaaatatatatcgagcacatactatgtgccaggccctgtgctgaacaaatgcatgatcacaagcactgaacaaggcacgtcttttaccctcaaaaggtcacacaccggcaccctcaaggcaaaattaagcaacaacaacaacacaactggactggtcactgtcgggcactctacctgtactgtctactgcacatgtccgggctcatcttctaaggcatgtcgatgcttattcattacagttacattgcacgagacttcatctactaaacgagccatcggcgactaatcacaaattcattcccccttgacactgctttactttcaccacacctccaacactacctctcgtcctccacaacctgtcgacctctgccacaacaacccaagaccatactctccactattacacacacgcccctcctacttacacccccttattgtaattccagcaatctgcctccattg

SEQ ID NO: 538121 - DNA, 430 bp, Homo sapiens
cacgaggaaacggaacgaatatgtactggcactcgcgcgtgtagcggctgcccgcggtgcggctctcggcgcggtcgtggcgcaggcctgcattgacgctgacgccctgccccagcctgaacacaccttcggcccagcccgcgtggccgttcagttcgccgctgcgccgcgtcgagttgccgaccacgaaatcaccgttctcgcggcgcaggtagtcggacgactggctgacgtagccgaatgccaggtcgtgccgctgcccgaaggcgtcgacgcccaactcatgcgtcacgcgcaggtcgcgccgggtggagtcgatcacgttgcgctggtcggccagcgtcgtagcggcctgcacgccgatgaagtacgggttttcgcggtcgcggtgatcgaactgcacggtgagcagtcccgcgccgccgaaatc

SEQ ID NO: 538122 - DNA, 700 bp, Homo sapiens
  misc_feature (269)..(269): n is a, c, g, or t
  misc_feature (526)..(526): n is a, c, g, or t
  misc_feature (537)..(537): n is a, c, g, or t
  misc_feature (546)..(546): n is a, c, g, or t
  misc_feature (548)..(548): n is a, c, g, or t
  misc_feature (553)..(553): n is a, c, g, or t
  misc_feature (618)..(619): n is a, c, g, or t
tatcgggggttttcacttttgcttccttctcattttctcttgctgctgccatgtaagaagtgccttttgcctcccaccgtgattctgaggcctccccagccatgtggaactgtaagtccaattaaacctctttttcttcccaagtctcgggtatagtctttatcacgcaggcgtgaataccggagcgtagcgtatactaagattgggtaccatgtaggagtgtggggcactagcttgattaacgatcgaccccgagaatattgttggcnatagccgaagctgtgtgtgaaaagctcgtgggctgagagccatgcgcccacgtatgtgggtgtgggacacgagattataggtatggcggcatcaggacaggagaggtacagcgcagagacactttggtggggggaaaaggtcgttgggagaaactttcccctaagaaaacccctttcattttcggacaatttgggccttttttggcgcccaaaaaaatggccgtggaattaaacccaaagtaattggaaacccagcntcaagcgtgcnccaagcgcntngacgngtagaggtcctcccacgcacttgggcacgcacttgaacggcaaaccttggcgctcggcgcacacnntggggagcccacaaagggcttggaacctcctttgttttaaatagcgtttttaaggccaaacacgcaagaacctggggattg

SEQ ID NO: 538123 - DNA, 1038 bp, Homo sapiens
  misc_feature (283)..(283): n is a, c, g, or t
cgcagtgtcgctaggccggagggaagatggcggcgccctggtggcgagccgcgctgtgcgagtgtcggagatggcggggcttcagcacctcggccgtcctgggccgccggacacccccgctggggccgatgcccaacagtgacatcgacttgagcaacctggagctggctggagaagtaccggagcttctgaccgctaccggcgccggagcagagcaggaggcgcagtgcccctgcactggtgtgctgtgacctaccgagagtatttcgggggagaaggacangatcccaaagagaagattgatattgggctgcctccacccaaagtctcccggacccaacagctactggaacggaaacaggccatccaggagcttcgggccaatgtggaagaggagcgggcttgcccgcctccgcacagccagtgtcccgctggatgcctgtgcgggccgagtgggagaggacctgtggcccctaccacaagcagcgtctggctgagtattacggcctctaccgagacctgttccacggtgccacctttgtgccccgagtccccctgcacgtggcctacgctgtgggtgaggatgacctgatgcctgtgtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtcctaccttccaccttcctgccgaggtcggcatcaccgttgcttctgcttcagagacagcgattgattttgagacgaagcctacctgtaagtggcaaggacctcggttgattacagaaacagaactgacaggcgttgtttcatcgggagccgccactcactgaaggacgtgggggcgccaaccaaccaagcggagggagaaccaagaagagaaggaacagcgcgcttctttgtaaaatgtcgaa

SEQ ID NO: 538124 - DNA, 438 bp, Homo sapiens
  misc_feature (275)..(275): n is a, c, g, or t
  misc_feature (416)..(416): n is a, c, g, or t
  misc_feature (434)..(434): n is a, c, g, or t
gagatgatggagtttcactcttgttgcccaggctggaggacaatggcgtgatctcggctcaccacaacctccccctcctgggttcaagcaattctcctgcctcagcctcctgagtatctgggattacaggcatgtaccaccaggccgggctaattttgtatttttagtagagacagggtttctccatgttggtcagtctggttgcgaactcccaacctcagttgatctgcccgcctcggcctcccaaaatgctgggattacaggcgtgacaaccngctcctggctgaagttttcccttctggatgtccctcacccctcaccccaagctcgtgagccgtgccactcatctcatatttgggccacagggtggggccaaggcttgcaataagcacaaaagtcccgatttttcctcaatnagcttgggccggccaagnccaa

SEQ ID NO: 538125 - DNA, 340 bp, Homo sapiens
gtcgacccccaacccgtattactgtctgaggtagacggatcgctcgtccggccattcagctaacggttgaaatgtatgcctccatgggcatacagccacatcacttgtatacctctgccgatgagaacctaattatggattcccccttgctgtcatttcgtgtcgacgaggtgttggtcgaacaactcgatcagttgtcagcagcaacggaccatgatcgccaggaccatcttaaccgcgccttaatccgttatcttgagcccgagtcacggcacctcaatgcaattgccgagggtatcgccgacgctgaggccggtaacctgacagatctgcagtcgac

SEQ ID NO: 538126 - DNA, 1238 bp, Homo sapiens
  misc_feature (1)..(1): n is a, c, g, or t
nacgattttggatgaataacccctctcggtcctttgaattgttccaagagtggtgttaatgatttcgctcctcccacggggataattaatcttcggccccccccgaaaaggcgagccctgtttgtcttgagaaactgattttttgctctgtgcctttgtccccacctctttgggggcgccccaaccttgcctccagcagttttggcgttggcgccccccggtgtgtccaaagcagttctcctgttggggagaacccgccgttttccgaatcttgattaccccctcaggtaggttccccccaggcgcaatgaccaccttttcctcccggggggaatacctcccccacgggccttttctttgtggttggggtgttatctttgaaccccccccacagagggggcatgttgtacaccacacccaatgccgctttgttgtcctctccgggaggcgcgcatctgtataaaatggtgtagacaccgttatcctttaacaccctctgtgtggcgccctctgtgggtgaacacacccacagatttgttctcgctctctctgtgccgcctgatattgtggggacacacttcggcacactttctcgcacttgccacactcacacacacacaggggagagtctctcacactccacagtgtgggtgtctagataatgtgtggtgtgagatatccttggtctccgcggaaatatttttctggcgcacaatggcgcgtgagacacaccacatgtgttccccgcgtgagacacacaccctcacatgtgagagaggtacacatgcctcgtgatattctgtatactgttctacacacagaagagatctctcgaaagaagagattgaaaataagaaagagccacggctcgctcgcctgaaagaaggccacgtggaccccaaggagggaaatttccacgggtgaaatggaactgcttcccgcctccctgaggttcacctggctatactcacccctcgagggttccacgaactggttctgaaaggtgtacacacaggtggcccttctgtgcctatattcacgcacaattccctatctgaaagaactggaggcgctcacagcctgctcccggaaagaactggttctgcacagctcccacctgctacacaggccacctgaatgggtaggacgccacccctgactggtcttaagctgttcttgcataggctcttaagccgccctggagaaaatggttgatggaaaataaacatccgtttcta

SEQ ID NO: 538127 - DNA, 662 bp, Homo sapiens
gggttggggaccttctgctggaaccaagaaaacaacgttcccaattggaaaggcccccaaaaaaggtccccttttccccccacagaaaaaggaacgggggcctgcctccctgttggccaggtgggtcccccaaaagaagaatataaaggccctccctttccaacccagggggggttttgttttgggccccaaaaaaaaagagaaatttttttccctttccccagttaccagtggaagaaattttattgaaattctaagggtggtcatttttctccaattgcaaacaaaaaaaagggttcccccccccttttattgaaaaaaggggaaaattttagtggcccctccccccccccccgaaaaaaaaaccaaaaaatttttcccaaaaaaagttttccccaaaaagtccccctttggcaaaaaaacaccccggttaacccccccccctttatttttttgaaaaaactggtgttgttaaccaaaaaatatcaccccccaattgtgttttcccgcaccaattccataaacccaaccgggggtcctcccacccaaggtttttggggtgcaaacccaagggcctattaaatgaaaagggccccaaaaaacaataacaaacatgaaaaaaagataaaacaaaccaaaaaaaagaataaatgaataaattc

SEQ ID NO: 538128 - DNA, 409 bp, Homo sapiens
  misc_feature (4)..(4): n is a, c, g, or t
  misc_feature (131)..(131): n is a, c, g, or t
  misc_feature (138)..(138): n is a, c, g, or t
  misc_feature (152)..(154): n is a, c, g, or t
  misc_feature (163)..(163): n is a, c, g, or t
ttanatttttgtacatattgttaggggtcagccatttttaatgataacgggtgacccaaaccagccttcagagcgttttctgtcctacttcagactttacttgtggtgtgaccatgttcattataatcccnaaggggnaaaaaaaaaccctnnnaaaaaaagncaaaacaacaacaaaaaaacaatcttattccgagcattccagtaacttttgtgtatgtacctagctgtactataagtagttggtttgtatgagatggttaaaaaggccaaagataaaaagattttttttttccttttctttctgtctatgaagttgctgtttatttttttttggcctgtttgatgtatgtgtgaaacaatgtccaacaataaaccggaattttattttgctgagttgttctaaaaa

SEQ ID NO: 538129 - DNA, 899 bp, Homo sapiens
  misc_feature (2)..(2): n is a, c, g, or t
  misc_feature (27)..(27): n is a, c, g, or t
  misc_feature (33)..(34): n is a, c, g, or t
  misc_feature (75)..(75): n is a, c, g, or t
  misc_feature (78)..(78): n is a, c, g, or t
  misc_feature (87)..(87): n is a, c, g, or t
  misc_feature (95)..(95): n is a, c, g, or t
  misc_feature (161)..(161): n is a, c, g, or t
  misc_feature (223)..(223): n is a, c, g, or t
  misc_feature (298)..(298): n is a, c, g, or t
  misc_feature (303)..(304): n is a, c, g, or t
  misc_feature (316)..(316): n is a, c, g, or t
  misc_feature (320)..(320): n is a, c, g, or t
  misc_feature (323)..(323): n is a, c, g, or t
  misc_feature (332)..(332): n is a, c, g, or t
  misc_feature (342)..(342): n is a, c, g, or t
  misc_feature (348)..(348): n is a, c, g, or t
  misc_feature (356)..(356): n is a, c, g, or t
  misc_feature (359)..(359): n is a, c, g, or t
  misc_feature (363)..(363): n is a, c, g, or t
  misc_feature (378)..(378): n is a, c, g, or t
  misc_feature (386)..(386): n is a, c, g, or t
  misc_feature (408)..(410): n is a, c, g, or t
  misc_feature (413)..(413): n is a, c, g, or t
  misc_feature (416)..(416): n is a, c, g, or t
  misc_feature (432)..(433): n is a, c, g, or t
  misc_feature (440)..(440): n is a, c, g, or t
  misc_feature (442)..(442): n is a, c, g, or t
  misc_feature (446)..(446): n is a, c, g, or t
  misc_feature (453)..(453): n is a, c, g, or t
  misc_feature (464)..(464): n is a, c, g, or t
  misc_feature (496)..(497): n is a, c, g, or t
  misc_feature (507)..(507): n is a, c, g, or t
  misc_feature (516)..(516): n is a, c, g, or t
  misc_feature (528)..(528): n is a, c, g, or t
  misc_feature (532)..(532): n is a, c, g, or t
  misc_feature (544)..(544): n is a, c, g, or t
  misc_feature (598)..(599): n is a, c, g, or t
  misc_feature (625)..(625): n is a, c, g, or t
  misc_feature (658)..(659): n is a, c, g, or t
  misc_feature (662)..(662): n is a, c, g, or t
  misc_feature (664)..(664): n is a, c, g, or t
  misc_feature (677)..(677): n is a, c, g, or t
  misc_feature (679)..(679): n is a, c, g, or t
  misc_feature (681)..(681): n is a, c, g, or t
  misc_feature (704)..(704): n is a, c, g, or t
  misc_feature (708)..(710): n is a, c, g, or t
  misc_feature (718)..(719): n is a, c, g, or t
  misc_feature (734)..(735): n is a, c, g, or t
  misc_feature (738)..(738): n is a, c, g, or t
  misc_feature (745)..(745): n is a, c, g, or t
  misc_feature (747)..(747): n is a, c, g, or t
  misc_feature (751)..(751): n is a, c, g, or t
  misc_feature (753)..(755): n is a, c, g, or t
  misc_feature (763)..(764): n is a, c, g, or t
  misc_feature (766)..(766): n is a, c, g, or t
  misc_feature (770)..(770): n is a, c, g, or t
  misc_feature (780)..(780): n is a, c, g, or t
  misc_feature (784)..(784): n is a, c, g, or t
  misc_feature (786)..(786): n is a, c, g, or t
  misc_feature (798)..(798): n is a, c, g, or t
  misc_feature (801)..(801): n is a, c, g, or t
  misc_feature (807)..(807): n is a, c, g, or t
  misc_feature (812)..(812): n is a, c, g, or t
  misc_feature (816)..(816): n is a, c, g, or t
  misc_feature (819)..(819): n is a, c, g, or t
  misc_feature (826)..(826): n is a, c, g, or t
  misc_feature (829)..(829): n is a, c, g, or t
  misc_feature (837)..(837): n is a, c, g, or t
  misc_feature (895)..(895): n is a, c, g, or t
gncgggagaggccaactctttaaagtnaaatgnnataaataaataagttaagcatagagaactgtctgagactgngtncccggtgtncccttacnacccccacccccaccccattttcttttccctaaaacctcttcctaaagaaaatgatcaggtaatangccccttgacccctccccacacccctcctcccaatacccaattaccccccaaagcaaagggngaaattaagagagagaaaaaaatccaagggcaacattgtctaaactcccagaaagagagatggcagcgtccgggncaggnnggggggggtggntaangcncgggtggtngtggtatttncacagnggggaccngcngggnctgtgaacatttttnggggttcnggggggggtcttttcctcgtgnnnggnggngggtctctgtggctgnntggcagngnggcngccctcngggctcccccncaccctccttagggggggcccttggggggggnngtgggttttngggctgggngcccagggatcngggntatcctcctctngctgggggtgggggggggtgggggccagcttccaagaaacccctaatgtggggnngaggctggggtgagggtgagctgggngtgtgtggcaggcccctgcggctctcctggggnntgnangggtagaaaaggncnantgttgggggaggcaagtacaaancatnnnacaagaanncctgtcaaaggagcnnagnagaaggnanatancnnngagcattnnanaatnttaatagatnaatnanaaaggccaaaanggnatctangaggnaatnggncattggngcnagggaagnatagacatggccattcagagaggaaggggggtgggaggggaaggtgtattgtgaaaangggg

SEQ ID NO: 538130 - DNA, 416 bp, Homo sapiens
  misc_feature (14)..(14): n is a, c, g, or t
  misc_feature (52)..(52): n is a, c, g, or t
  misc_feature (61)..(61): n is a, c, g, or t
  misc_feature (100)..(100): n is a, c, g, or t
ggtaaacagatccntcacacctgggcagtttatgtgcaaatattccagagcnaagtccccnggttacagaagtatcctgagtatcctgcattaggagggnccttgttttaaaatttccttaaagaagccaaataggcccagtccgtgggtgtcacgcctgtgatcactttgggagtccccaggcaggctgattgcttgagctcaggagtttgagaccagcctgggcaacatggcaaaaccctgtccctacaagaaattttaaacaaaattagctgggcatgtgtgtcacgcctgtcatctcaactactcaggaggctgagaggtgaaaggatagtttgagccagtgatgttgacactgcagttagccaagatcgtgccactgcattccagcctaggaaacagctagaccctgtctc

SEQ ID NO: 538131 - DNA, 164 bp, Homo sapiens
gcagcatatcatcaccagcctcagcagtaccatcacctccatcaccacttccatcagaatcaccataaccaccatcacctctaccaccactatcaccatcatcactacaaccatcctcttcactatcaccaccaactaagaacggccatgcaccaccacccacg

SEQ ID NO: 538132 - DNA, 194 bp, Homo sapiens
ggattcagttccggagacccagaggtcatctgcgacaggcggccggcagacccttaggacaccggggggtacgcaaccctggcgagaggcgcggcaaccaccggccaccgagggcgcaggaccagcgcagccactcagctcagacagggcacacagcgaagctaagagaccaggggggctaacacgccgacaca

SEQ ID NO: 538133 - DNA, 727 bp, Homo sapiens
acaaaacaaaaaaacaaatactgctagtagagcggttatcgtacgaggatgcctgaggtagagtgagcatggtgcagccccgaccaatgaccactgataagtgctgacgaggtggagaaatacagcagtggcatgcctgattcgcatcgaaaacccaaaccaatattagtgcctctctatacttgacccccagtgaagtactggagatgaggaacaagattcgacgaacaaaacctgacaagatgtgaagtacatgacgtgtggcctcagtacccagctacctgtgcgagcgtcaattgccgagaagagcctgaagcccagtctacagatgagccatgctgatgtccaatggtgagaccgatgtgataccaaaagacgatatacatgatgagatgacagtgtgcccaatcaccctatcagccaaactcactgaccaatgagtttggaggagtacaaataaagagtgttggacgtatgtgaatgaacactagaacttgactggcgacggacacatgaaactgccccaagaagagcctggctacacactgcaaagatctagcaaacctgacatatactacacagctgtcacgacgaccccaaagatattgaagcgcacgcagacacaaagaggccccattttagagactcatcctatccaaaagtcttatagaacaggacaggatactagagaagatctgaaaactacgcaaagtccgtcacacatgaa

SEQ ID NO: 538134 - DNA, 578 bp, Homo sapiens
  misc_feature (52)..(52): n is a, c, g, or t
cgcagccaaggcggatggcgcacaggaaccggaggagaagagatgagccacnccgtgggcgcggacctgacacaggccgtgctggcccgactggacagctgcagcgacccgcgcttcaaggcagtgatgagcgcgctggtggcgcacctgcacgccttcatgcgcgagatcgacctgacgcccgatgaatggatggccggcatcgatttcctgaccgagaccggacggacgtgcgacgcgcagcggcaggagttcattctgctgtcggacaccctcggcgcgtccatgctcgtggtggcactgcagcaggcacgcgccctcggcagtggccagggcgcgacggaggcgaccgaagcgacggtgcagggcccctactatctggacggcgcacccgatcgccccctgggcgccgacatcggcgagggtgttccgggcgagccgaccttctacgccggccgcgtcacagataccgagggcaatccggtcgccggtgcactgctcgacgcctggtccggtgacggcgaaggggtgtgcgacatggcggctggaggacggcgcggcatgccggcgcgcggccg

SEQ ID NO: 538135 - DNA, 368 bp, Homo sapiens
gtcacgcccacaggactccaatgactgaggcaggcagccttgtgatccccacagcgtcacaggtagagagtgcatgctcatacctctcctagcactgtaagagccttgtccttgggaccggacactatggctttggccctgtgtagggagaatcggtgccacaggagttgtcttaataggacaaggcatgcacggtctgagatcagaggttgttgacgtggccacccatgagccagtccgtttgggacacatcacactgcacagctttttaaaaaaataattagctgccaatcttttaaaatggtaagatttcatatacaaatctggatttttggcttctctaggagtaaacattgaaactttttttt

SEQ ID NO: 538136 - DNA, 196 bp, Homo sapiens
ggggaggaatgttacaagtacattcacaaggacaggagtatcactaagtacattatcacacgggtgggggaatgtcaccgtggcttgaccatagtgcagccatgctcacgagtgaccttacaaacagtttcctacttgcacgtgttgtcttgtggcgaaaatataaaacatttaatttctgggattcttttttttt

SEQ ID NO: 538137 - DNA, 789 bp, Homo sapiens
ggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcaaaggccaagaaggaggcgccgcccatggagaagccggaagtggtgaagacgcacctgcgggacatgatcatcctacccgagatggtgggcagcatggttgggcgtctacaacggcaagaccttcaaccaggttggagatcaagcccgagatgatcggccactacctggggcgagttctccatcacctacaagcccgtaaagcattggccggcccggcatcggggccacccactcctcccgcgttcatccctctcaagtaatggctcagctaataaaggcgcacattgaacgtccgaagacgaaaggcaacagattaaggggaacgaagacagatgtatccttccactcatgagtacctttcattgttaatcccagaccccagaaagactgcgggtgtggcgccgtcccaaaaagtgatactagaagagaggtcattgcatccctaagggcaccacaacagcttgttccaggccagtggagcgtgtctaaaagagcgcgagaggtcaattcccattaattcctagtgccgcattgcatgaatgacagtcgttttgagaaacactgcgagttggctcgtttgcatattgggaggccctctttg

SEQ ID NO: 538138 - DNA, 399 bp, Homo sapiens
aggcagtgtgtcactcatcattctgctcaccgatggcgatccaactgtggtggagactaaccgcaggagcattcagaataacgagcgcgaagctggtggccgatacagactatgctgcctgggattcggcttcgacgtcagatatgccttcctgcagaagctgtcactgaacaatggcggtctggcccggcgcatacatgaggactcagactctgacctgcagctgcaggacttctaccaggaagtggccaacccactgctgacagcactgaccttggagtacccaagcaatgccagggaggaagtcactcagaacaacttacgaatcctcttcaaggcctcagagatgatgaaggctgcggctccaggaccgttggtctgatgtgctgacagccacgt

SEQ ID NO: 538139 - DNA, 785 bp, Homo sapiens
ggcaagatggcggcgagcggcgtccgccatagctacttctaccgcaacagtcaccttcgatgaagcccattttcagtcgcgtgcatcatgaacgaggccaagcggcgggtgcgcgagctctaccgcgcctggctatctgggaggtgccggacatcactgtgcaccaatttccagctggcacatcactgtgtaaaatgggacgggataaagtccgagaaatgtttatgaagacatgcccatgtctacagaccctaagggtggtttgatcttctggtcattcaagggcaatagcatcgaactggcaagtagaacaattaaagtatggaagcagctggacacatgttatgcggttcttcgcattgaaacagaacgcgccaatggccaaacggatttcctatccaagttctatgttggccacgatccatgaagtcattcaggggaaagatgcacgttgatactatctttagagcgacaaataaccttcacttatgcaagtgggtcaaatccgatgaagaagataaggaaagaacacaaaagagcaagaacataaactcagaaaggcagaatagccaaaaataacacaagcacaaaaagaatagagcaacaaaaacaacagaacaatagatcaacgaagatcaagcgacatcccaaccatgagaccaaagccaaaacccccacagggaacacggaccaaaataccaccaacgggaatcccatccaaacgggggaagaaaacaaatgagagcaagcaagacagaggaacacgacagaagaaaaagcaacaa

SEQ ID NO: 538140 - DNA, 714 bp, Homo sapiens
  misc_feature (588)..(588): n is a, c, g, or t
  misc_feature (658)..(658): n is a, c, g, or t
  misc_feature (689)..(689): n is a, c, g, or t
  misc_feature (691)..(691): n is a, c, g, or t
ttaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattaacatattttgtatgctttgtgttgaaattcataggaaaacttgtcttctgtaattgacttttgcataggaatttgttcagccatctctaagcattacacatgcgtgtacttgtccactgaattgaaggcagagaaggaagagaagagggaatgattcaaggccaaaatggtcacatttagaagatccttagatgataaccattgntatgtgtgtgcagtttatttaacagtgcccgtgtacatggtggacaagctatgaaatatctagtctttanatgtttggaagtgcttgatgtattttaaagnantagtagtagaataacactttttg

SEQ ID NO: 538141 - DNA, 538 bp, Homo sapiens
  misc_feature (16)..(16): n is a, c, g, or t
  misc_feature (22)..(22): n is a, c, g, or t
tttagggaagaatttnggtaantttcagggttacagtgtataacatgtgttggaagtttgagcattgaaatttcaacagacgccacaacctcgattgagggaaaatgagctaaccgactactgctgcaagaaggacctgtgtaactttaacgaacagtttgacaatggggggatactcttatcagacaaaacagtgtttctgctggcgaatgcatttatagcagtatactgtagcctacatgcctaatcccatagcacgagatcttggtcgaaactcatcgtttctgctaaatatgataccactaacataactatccgcccggcccgaattccgatatccgcttccaccctggcaaagacgcaaccagagtcgccctccccccatctattatgtcccctctccgcctccatcaccacctcccccaccttcgttctctcctcccgtctcccctttatctgtccttccctcacactcgccactctacgttaatgtttagttttttttcagaatattcaattatatatagatgatacaatt

SEQ ID NO: 538142 - DNA, 217 bp, Homo sapiens
gtcgttgattcgctgtgtacggtttcttcgagcaatagcagcagactcattggcgctacatttagtagaggaaccacgtgtgtaatgttatacaacacagtctactactacaatcatccctcttagagtaaaacctacctctctattgtggtaagcttttactgtcccataaagacaggagccacagtaggcgttatgaatgcgtccgtcgaacgtg

SEQ ID NO: 538143 - DNA, 152 bp, Homo sapiens
gcatcctttgggctgatatccatatgagatcatggctttgctgtttgtgcatattagagatgagactgcctctcccaccacaccagttgactactacacactgctcatttgagacctgtcagctgaggggggcaggcctagggtttccattc

SEQ ID NO: 538144 - DNA, 178 bp, Homo sapiens
cggctgtacggacgcggatacaggcatatggctcgcgggaatgggggtggacatgttcgactctcccgttgagaagtgatgctcggcaagcacaatgagggcgtgttgccacagtgatcaaagataacggcgcgggggtgggcgcggttagtcaattcctgcagggcgtccgtagcgg

SEQ ID NO: 538145 - DNA, 860 bp, Homo sapiens
gtgtgcgctcaaaaaatgcaatccccgcccgggtgtaatattatagccgtgcgcagtggctggcccctaacaattagggtccggtgtggaagtgtccgacacgaaagagcacaggggagcgattaatcgcccggttgcccactaaattgtgtggccgttggtcagccgtcgtccgccctatattcgcccgatggcttgttaccattcgcagccttgttgcaagcgtctgaagaaatttattgcaagcatggtcttcagtacatggtcgaatgttatgtgcctgcgcgcccccttcgggggctgctttaatcgaactcgtgtgggcccccagttcaattcctcggatacaaccacgtttggcagcccctcaactgtttagtggcgttacatcgcccttgtgtgcagtgtagtgttaaaacaacgggcgttgggtatgaaatggatctgcccccccgagcccgattttctgccgcactgtggccaggaaacccacctcgcagctctttgttcgggggccacccccggagtgcgttccgcggcgccacgcacgacatctccttcattgctgtctccttgtgagggcgtaccacgctgtgccgaacaaccaaacagatctatagtacgtacactggggcgtgagaccccgtgccttcccacggtgcaagtgcgctcaagtacaacatgggccactaaaaccgcggggagaaaaaatatggggtgcgcgcccacagcctacccacgctgcggggactcacccgtatcaccccggtgttagcaggcagcctacagggaagtgccacgcacaccccccctacaaccccggtttcccacccccgtcccaacccctttccacaaaaaca

SEQ ID NO: 538146 - DNA, 667 bp, Homo sapiens
tcctgaggctgggtcatgggtgcacaccctcaaccttgtgcaaaataaactttctaaattaactgagacttgtctcagatgtgctgggttcacatttgggtaaccacagggggatgctgagtggagatacccctgatctttgacaaatatcctgatggtgctgtggtaccagcatgagctaactttatggttcaaaccagtaggacaatttgccgggcatcccctccagagaatccctgagctccaaaaatttggttgagatcagaagtttattttgctgtacaactcctcttttgagggagtattactgtgcttccaagaggaaggcaggtttacggcgtccatgatgatggacagggagacaactcctttatggagtatgagcttgcttccgaacagggaagcatgaggtttgagatatccttcttgcataggatggtagaagagcggtctacagactggggaccatatcgaccagctatggaacaggaggcgaccctggggtttcaggaaagagtgtggttgcgcggggaggctcatgccgggatccaaaacagttggggacacggagggggggaggacacaggaggcgggagtacagaaccagatgggacacctgggtggaaacctatgtctactaagatacaaaattagtggactggggacc

SEQ ID NO: 538147 - DNA, 139 bp, Homo sapiens
ataataatttctgcaaaccccccccccaacaccaattcctagtctaatgttaccctaccacttgtggctgtaatacttgaccatgtacttaacttggaaaccctatattccaaaagactgaaacctgaatcttcacccc

SEQ ID NO: 538148 - DNA, 128 bp, Homo sapiens
cgagatgcgacgacgctcgaaatcgacgaatcacgtcaacttgttgtaagtcctgggacagccgcagcgaactctgcagctccactgtgttccatgtacctgcacggtccagcatgcttgatcagtgt

SEQ ID NO: 538149 - DNA, 560 bp, Homo sapiens
  misc_feature (28)..(28): n is a, c, g, or t
  misc_feature (86)..(86): n is a, c, g, or t
  misc_feature (88)..(88): n is a, c, g, or t
  misc_feature (120)..(120): n is a, c, g, or t
  misc_feature (124)..(124): n is a, c, g, or t
  misc_feature (219)..(219): n is a, c, g, or t
  misc_feature (232)..(232): n is a, c, g, or t
  misc_feature (275)..(275): n is a, c, g, or t
  misc_feature (321)..(321): n is a, c, g, or t
  misc_feature (331)..(331): n is a, c, g, or t
  misc_feature (363)..(363): n is a, c, g, or t
  misc_feature (365)..(365): n is a, c, g, or t
  misc_feature (409)..(409): n is a, c, g, or t
  misc_feature (416)..(416): n is a, c, g, or t
  misc_feature (436)..(436): n is a, c, g, or t
  misc_feature (447)..(448): n is a, c, g, or t
  misc_feature (454)..(454): n is a, c, g, or t
  misc_feature (541)..(541): n is a, c, g, or t
ggaggagcgaatctcgggctcagccagngctgggcatggggctctctctccgtggagtatgggcctcagggaggctggggtgggangncccagggtccggtaggagggcagggggtggtnagcnagcaccagggcgcagtgtagagctggggcagcagcatttgcgggttcagcagctcaccaggtacatccctgtggcaaacctcctcttcacagcgnaatgcggtaccgngtgcccaccagttcaagtccacgcccgacagagtggtcccctngctggtgaacgtgtgtgtagccgacggggcgtggggtgtgctgggntctgagagcngctcccaagctggatagagggctggccaaaancngccttgcctgttggacacaatatgtgaagccttccaagtgagcngcttctnctccaggttccatggtggangctgggtgaanncggtcngtgtggtacaggcttcccccacaggcagcaggagtctggacgttcgtgagtggtgtgggcacagccgtggcaccgggccggtagccntactccactgagacctggg

SEQ ID NO: 538150 - DNA, 1252 bp, Homo sapiens
gcttaacaggacgcagttcgctcgcgcggtaggttggcgcgggtttggtgaggtgttccagtcacctttaagagatgttagcggctgtgtgtgagctggcacatcaatgggtattcggtagatcgccctgactaatggttggtggacaaacatcgatggaacccaacgctgactgttgcctgccggtggccggtgtggagcgacatttccggtacgcagatggcactgctagcaatatctgctctgtcctccaggcagaacctatacgtgaccgaaggatgccacatgtcatgcatcgcccctgagatatcgttggaggggttcatagactccctcattgtcacgcttcagaacgtgataccgatcaggcggtctactatcctggctgtacgcacaaccgtatctgatccagggaatcgagatggcttacctccatggtgcgccttcgctgatacgaaggcttctgagatggtcatgatgtaggccgattctccagcaaatggtggagtggtcggtgtgtgccctaatggaagaacgagtgggtgagtgaaggtatccaacgccaaggaggaaagctcacggcctgtccaggaataaagtagagagagacaagggaacacgctccacatcaatcaccaacgtcactggggaactcacaggcaaacaactggggtacagtgatagagcgtaagcgaaggaaaacacatgtggaccggcccgttaagtaccaacgcgtgttggctgaactgtaccccactctggtggcgaggaatcacccctgcgggaaagggtcccttccagccgagcctttaggttcatttttacacgtgatgtgttcttgcatttcctcactaccgtatgtagacttgtggctaaatttcctcgctgcccagaaaagcccaccttcccattgtgcaggaccagatgacaagggcgccatgggttggaataccatattttcctcggggggggatagaagcccttggaacaattacacgggcgccacacacggcaccccccgagtttggaaccccagaccttgcgtggaagttgggcgagtttctcacagcccttggcgcgaatagtggtcttttttgggagaacaggaacgaggacggccgcaatgtgaggcacgcaaaagggtcggcgacttcgcgcacctaggcgcgtttggggcgtacaagagttaaaccttttgtggaggtagaacaagagttcttaggcccttctccactggagtacggggcccatc

SEQ ID NO: 538151 - DNA, 265 bp, Homo sapiens
tgtttcctcagcctttcaacctcgagctcgacatacaacaagggccaatctctggcgattgtggctacataactcagggctcgcactttcaacacccagcgtacagagaaagtcttcttgaatgcaacaccagctaccagctgagaatcctcgagggctccaccctgctaccttcttgattccaatcatttcaagctgcagcaaatcatcgagcatcatcacagcatccaccaccatcttagcaaagaaagctttctgctgggag

SEQ ID NO: 538152 - DNA, 250 bp, Homo sapiens
  misc_feature (200)..(200): n is a, c, g, or t
atcccctcagtatcgcggaacatactatctaccctaacatcacacaccgcacaatcccctatctagcgccttcttactagccataacctgcccctactcctcctagacctaacctgactataaaagctattacctaaacacaatttcacagcaccaaatctccatctccatcatcacctccacccaaaaaggccttattngagcgtttacttcctctctgtcttcttcccactcatcccgcgatactcca

SEQ ID NO: 538153 - DNA, 122 bp, Homo sapiens
  misc_feature (47)..(47): n is a, c, g, or t
  misc_feature (116)..(116): n is a, c, g, or t
  misc_feature (118)..(118): n is a, c, g, or t
tgccggtcctggcgacggtggtgacactgcgcaccatctggatgttntacatgttcgcggatgtttatttgctgacgaccaaggtcgatattttcggtgtatatctctacaaaacngncttt

SEQ ID NO: 538154 - DNA, 147 bp, Homo sapiens
caggaggatcacttgaggccagggagaccaccctgggtactatagtgagacctcatctctacaaaaactaaaaaagattaactgggcgtgttgacatgtgcttgtattcctgactacatgagaggccaagcagtcgtcgcaaccggg

SEQ ID NO: 538155 - DNA, 404 bp, Homo sapiens
  misc_feature (7)..(7): n is a, c, g, or t
  misc_feature (14)..(14): n is a, c, g, or t
  misc_feature (44)..(44): n is a, c, g, or t
  misc_feature (107)..(107): n is a, c, g, or t
  misc_feature (149)..(149): n is a, c, g, or t
  misc_feature (265)..(265): n is a, c, g, or t
  misc_feature (372)..(372): n is a, c, g, or t
aaagaanatatatncccttactgcccgttaaaagccaatgaggnaagacacctttcctaaaacctgccccttgagttgaaatattttttatgaacctatttttgaantggactcccatttaaaagcaaacattggtggagcatggtagnctcacaccctataattcccagcactttgagaggcctaagatgggaggatcacttgaggcccaggagttcaagaatagcctgggcaacatagcaagaccctgtttctacaaaaaatnaaaaattacttagacatagtggtgtgtgcctgtaatcttaactactcgggaggttgaggtggaaggactgcttgagtccagaagttggagactgcagtcagctatgntcacaccagtgtactccagcttgggcagcaga

SEQ ID NO: 538156 - DNA, 628 bp, Homo sapiens
tcgtctgtaccacttctcaattaataccgggggagaaaacaggcactgtgtgctatgtaaccttgatttcatgaaggactatctgttgtactaactataaactttgatcacctatgttacaaccttatgtcacattgccagcatcgattaacgaattgagtgcgcaagtgggaatagtctcgatgtatcattcgacatgggtatggggactgccgccatctttctgttagagaaagtgtgacgagtattcaatctgtgagtagaagaacgctgattatgtacgacagtagtgtggagagaaacaggagaagactcgttagtatggagtctcttaaatgaaggtgtatgtaaagagctgtacaaatacgtattgtctaaaatgcgattttaaaactctcgtatttaatatcccgaggacacaacgcgtacaaggctacaagaaatcactgggatattgacccatgcaaggacgtgtcaaggtggccaaccaaaagagcaacactaatactagcacatcgtacacggggattgcgaggtgcttcccagtattattgaacaactgttcagacaacttgcctgatgttgacactgagcgctaaagggcctctaacctatgcaggttccccca

SEQ ID NO: 538157 - DNA, 346 bp, Homo sapiens
cgggcaatagagtgagattccatctcaaaaagaataaaactaaatacaactctaccggctacggatatatatataaagcctttatgtgtttctcataaggaaagccagggggggactggcctttaaagcctaatatccaacttaattaccagcacctcccccaagcagagggtcttaggggaaagactgctgtccttacaccttgaatagagacacgttacactactctctatagactgctaattagaaggcatgagagagctggcagtggggatggacagacagtgggactcgccaatcaaatcatgcacttgggagacttactgcggctggagggggccgcgcg

SEQ ID NO: 538158 - DNA, 756 bp, Homo sapiens
  misc_feature (2)..(2): n is a, c, g, or t
  misc_feature (70)..(70): n is a, c, g, or t
  misc_feature (95)..(95): n is a, c, g, or t
  misc_feature (104)..(104): n is a, c, g, or t
  misc_feature (197)..(197): n is a, c, g, or t
  misc_feature (202)..(202): n is a, c, g, or t
  misc_feature (253)..(253): n is a, c, g, or t
  misc_feature (266)..(266): n is a, c, g, or t
  misc_feature (337)..(337): n is a, c, g, or t
  misc_feature (348)..(348): n is a, c, g, or t
  misc_feature (386)..(386): n is a, c, g, or t
  misc_feature (398)..(398): n is a, c, g, or t
  misc_feature (401)..(401): n is a, c, g, or t
  misc_feature (413)..(413): n is a, c, g, or t
  misc_feature (436)..(436): n is a, c, g, or t
  misc_feature (439)..(439): n is a, c, g, or t
  misc_feature (487)..(487): n is a, c, g, or t
  misc_feature (533)..(533): n is a, c, g, or t
  misc_feature (610)..(610): n is a, c, g, or t
  misc_feature (626)..(626): n is a, c, g, or t
  misc_feature (632)..(632): n is a, c, g, or t
  misc_feature (634)..(634): n is a, c, g, or t
  misc_feature (706)..(706): n is a, c, g, or t
  misc_feature (735)..(735): n is a, c, g, or t
  misc_feature (737)..(737): n is a, c, g, or t
  misc_feature (749)..(749): n is a, c, g, or t
gnttttcactttgaatttcaaagtaaattagagatatgtaaataacagcaattatcaacattaaaatctnattcacacactcgcgcctcaacaanaacaggatnacagtcaacgctcagtcgctttttaataaaatgagcagaatcccatcgtaacaatactttgttacatgaatccaaatacacagcagaccaatnatgtnccctgaaatttaacaatcaatcatacttaataaaggcctgtcagtgctgtncctcaagactctnattctaaagggcttcctttgaattccctttataaagctttgtgcaaagaagagcttaagcaccagtcaganagactgtggcnagcatttttatttcatcatcaacaacaaacatgcagtntctttctctgangtncatgggactgtnaaatgggtgccacactctctctngtngtacaaagtttataaatacagtatactgatacaaagttgaagccattnaaaagagcttaataacaactatgaggagataattaaatctggagtnttgatggaatctatgaagagattcagaaacaagacataaacactacggtaaaagtcttacttgggaaggggccagangggaactttttatgtnccactnanagattttttaagttgctccagatttactttctttctgctattatctttaaatactgcaaagcattgtgagcngcatcactttgtgcattgccacaggaganancggagccatganagaatgt

SEQ ID NO: 538159 - DNA, 1238 bp, Homo sapiens
gaatgatcccatgggatgtaggaattgcgggcatcacgaggaggttggacaaacgaatctgtatccacctttgccgagaggaagctgcccggtgctcagatgttacctggtttgcatcttgcggtgagccattcccacacaaactcacggatgcagatagcatctcacggagactgggccccggagacgatcggagaagggctagctcgaggctggcaggagcatccaagcacgtcagtcgatgacgcggacctcgtctccaatgcatgcccagatgacgagaacggtgacaaggtctgagtcaacacagtgttgaagagaacgagtctagtgagccccctccctcggcaccatacccccctaagcactgaatgagtgtgcattgaatcactacacttgagagcttaccaggggtctccaactccaggagcggatcgcaccagtggagatccgactaggacagtattgcatcgtgtggagtcattgggagattcgcgtacccttgagaggagatagcaaagaggctgcgttgacgtagggccctaggatggcgataaataagtaggcaatatgggtacccgggaaactcgagtgtcgaccttcgacgcggtgattccgtacatgtgggggcaccgaaacgcaagccccaactcgtgagcccaccgaacacggggaagtcgccatacactaggtccacaagcaagcgcgcgcaacccgctttgcgccatggggaaacacgaccgtttacgcaccattgcaagacgaattttcactacctaaaggaagggcgcaaccctgtggttgggcgaggccgcagaatggggaaaggccaccgcttttttaataggaccatggtggcatatggcccctgtttatccaagcattatactggacagcggcgccacaaattcggtggttcggccaaaagacgacgggattgggggcgcggcaacggacgcgaccaacgggcaaattccacccgatagcgtgagccccaaacgacaagcatccagcggagtcaccataacacccgtgtccatgccgcacccacccaaaggctgtgcgcaagaacgcgggggccgccccgtaagacaacgccacccgcgtgtagaacaaggttcacaccccaaagacgcagtattggcaccgaccccgccgcgcctctcacacggactaaaggcacccaccaacacagacgtgagagatgatacccgacccactggcacgtatcagactgg

SEQ ID NO: 538160 - DNA, 583 bp, Homo sapiens
taacattagctttcgtagcagtttataccataagatgttctgactggtttgtacactaggtgggtcagctagtagaatttaggcatttatacttttcctgagttatactcccagaacctcctcagagttgcatgtagatagcatttatttctgcatatttaaaaaaaaaaaaacccatttaggaaatatctacaaagaagaaatgaaaaatagtaattattttttcatgaagattttggtccacacctcattgagttgtaatggattctccagtttcttgagttggcaataatcaacatttggtttggagagcgagcatgagagagcgtttgttagtgaaactcacagacttctaaaagttcattgctacagttatcaaagtgggggaaactaaaattaccttatcaaggaaaaaatattaagtcacaagccatatacatttagctcccaagccataatgccgaacagctttggagtatcgtacagaaagctcattacaaaatgcttgcgttttcttttctctggaacatcaacaccagtgtattgctggcagctattgtattaaaaaaataaatatattttc

SEQ ID NO: 538161 - DNA, 1179 bp, Homo sapiens
gcagaaagccaggatcatagagacgctcggcctccgccgaatgcgctggcggactaagagtggcgggcgaagcgagcggccggacgcgggcccctggacgggcgtggcggtacagcgcccaagcctgaggacccggacctgagcatcgcagggcccaggacgaggtggccaggcggcacccactatggcagtctcctggtcgtaggcggagaaccggctgggcgatgagtgagaacctcgacaacgagggcccgaagcccatggatgagctgtggccaggagatgcagcagtgccctgagctgccctatccgtctacaggtgccccctgcagaccccgggcagccctggacggaggtggagaaagcagggcgctgtggtgcgcgctacacgcggccggcggcctcagccccgcggctctaccagctaccatcagcggatgacttgtttacctctgagatctttaaactgtagctgccgaacgtagcgtcgaccacgcccacggttcagcggatcgtccgagcgcttacctgggccggttgggtctggcagacccacaaaaccaaacatctctcggggccatcaaccttggcgccgtattgtagacatttcccgaggcgcatagcagcagagggacaacgggccctgcgacgtattgcatggtgcacctcttggaaagggccgaccactccagtgtgagcctggcctggtccaaaaggcgaaacccatggcaccaggaaggacggcgcaccacacggaaggcgtgcagaagtgaagccaacaaggtaatcccgaatgggccgaacgtgtgtgcaccccttctacttgacagtggccctatgcctgacccactttaccgacaatcacatcgacgtgccaaccaggtgctggcacaactcgcgccacgcacaccggcaggacaaccggccgctgcaggcccggcaggccgaaccaggaggcagacagacaacaccggccggatcgccctgaaaaggcctaagcgaacacccgagagccactgacccagagccaccgaactatagatgtacaccgccagctgggagcaccacaagacgacaatacgcaaaccgcgcacaaagagcccaccgacacagcactgaaagacagcacagcgcatgcaaccaaacgaacaaccacccacacaaacaccagaaataaca

SEQ ID NO: 538162 - DNA, 1151 bp, Homo sapiens
ggttgtgccaaggcgctgcactagtggttgcggttggtgtagtggtggggtggctgtggtgggtgctcccgctttttgggtcgtgctgggcggtttgttgtcctctgttgagaggtgtgtgtgctctggtaagtcgccccctttgtttgccacagttgtgggggccccccggcagccggctccgggtgttaccggggtcccagcttgctttcgggttttgttgagtgcctcccgtctcctggttgattcccctggttgtttgttgcctgtgtgttgtggccgcccccctgtgaaggagtattggcggacattcttgcacgccctggggaggagtaggcgctaattttcttgctctggagggggtggaccgtagccctgggtcccagtgacctgggacgaagttgcctcctggaaaagaagaaggtggtccaaggagtgggttttgtcatataaaattttgggtaaaggattgaaaagaggttcgtgtatcggcacttgacacaactaaccctttaagggggaaagataaagagttgtcctcgtgctacctaaagtgaatgccgtgagacaccttaggccacctcaatcccacgaagctaagtaatgcttttgtgaggtgttcacaagttgggtttatattcttcacccgagttcgggggtaaaccgggcacctgtgaagaccggtaatggaaaacactgaggggttaaactcttgtggtggtttaaaaaggtgttttatacccggtccaagccgcgagtgcccttgaagtatgagcccaagttcttggttatttgaagtgtttctgaggctgtatcttgatgtttaagaaaagtattcggtaaactcttgtaagagtttactttttggaaactttgtgcacttccccgtagttgaccacaattctgcactgtgaactagtgccttctagaaataggttaaactgaagccacttgatggaaggatctctcccccgggcttgttttcccaagaataagtattgtttggaggagcccaagtttaaagcctacctaagcatattcgtaaagctgttccaaaatattactctcagaccccgttttgtggctgccaatgtagtgctcgagtccaccttttgcttaaagttgtaaccaaaaccagatgagtttaaaga

SEQ ID NO: 538163 - DNA, 241 bp, Homo sapiens
  misc_feature (11)..(11): n is a, c, g, or t
  misc_feature (53)..(53): n is a, c, g, or t
  misc_feature (78)..(78): n is a, c, g, or t
  misc_feature (124)..(124): n is a, c, g, or t
aattggtctcngtcatttggaacagatgttctctgaaataattgaatgatccntgggtctggatcagtattgttattncaacccacgtatgtgtgaccatggttttctactcgcgtaatgtctnaagcacatcggagacataaatctccctgtatgcttagtttgtgtcattgccactgtatcaatgagaaatgtcttcaggcagggtactgagcataatacggtcggcgatctagaattc

SEQ ID NO: 538164 - DNA, 187 bp, Homo sapiens
  misc_feature (58)..(58): n is a, c, g, or t
ggcgctggagcacgacttgcactgcgttgtcgacgctcccggtctgtctccttcatgngtgaaaaagctggtggaatcctcacactgttcatgctaggggtgttctctgtgcacctctacggctacgccgccgccgccgcgccgcggtgcagatcttggtggtggtagcaaatattcaaacgagaag

SEQ ID NO: 538165 - DNA, 331 bp, Homo sapiens
gagctcgaattccgaaaaccttccgcctgcgtcattctatgactcaaactgagctacatgtaacagttacctccctgagctaggtgttgcatctgactcagacaccggagtagcccgtattacagacacttgccaccacgcctggatagctttgtattctcagcagagactagcaatcaccattgatgaccatggtgggctcaaacttatgacctcaggggatccgcccacctcgcactcctaaagggctgtaattacaggcgttagccaccatgcctgccctgtcacggcgatgatcttaaggtctctgatgctatgccttctctgaaag

SEQ ID NO: 538166 - DNA, 575 bp, Homo sapiens
  misc_feature (6)..(6): n is a, c, g, or t
  misc_feature (423)..(423): n is a, c, g, or t
  misc_feature (432)..(432): n is a, c, g, or t
  misc_feature (527)..(527): n is a, c, g, or t
ggcatntttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaataacagaatgggagttcactcatgatttggctctctgtttgtctgttattggtgtataagaatgcttgtgatttttgtacattgattttgtatcctgagagtttgctgaagttgcttatcagcttgagggagatatgggggctgagacgaaggggttttctacatatacaatcatgtcatctgcaaagaggggacaatttgaggaaaattcttggggcccaccccagaccccactgaatcagaagctgagggggtngggccccgncaaactatgtttttgtttttgtttttgtttttgtgttttgaggacaaggattcccctgttcacacaggcgggagtgcagtgacagggaacccggncccactgtaacctccacctcccgggggtccaagtgattctcctgcctc

SEQ ID NO: 538167 - DNA, 748 bp, Homo sapiens
  misc_feature (40)..(40): n is a, c, g, or t
taatttgtatttttagtagagacggggggtttctccatgntggtcaggctggtctggaactccagacctcaggtgatacccctgcctcagcctcccaatgtgctgggattacagctgtgaagccaccgcgcccgggctgctgtgatagttgagatgtaaaccaaaaataaaattctaagccacccaatccgactgaatggacccttcctgttgagcaaggacattccaaagtaaactgaaaagaccagcttaggccatgatgggaaggggaggtgtcaacatgcctcattctaccttcctccctctggaatccagacacaactgaccagcattaacattaaaacagagatcttaagctgggcacagtggctcatgcctgtggtcccagcactttgggaggccaaggtgggatcacctgaggtcggaagttcgggaccaggcctggccggtatggtgaggccatgtctctactaaaaatacaaaattgggccggacgttgtggtgcacgtctgtcatcccgggttcaagcgattctcctgcctcagcctcccgagtagctgggattacaggcatgtaccaccacgccgggtaatttgtattttagtagagacgggggggtttctccatgttggtcaggctggtctggaactcagaacttctgggataacctggcttagctccaatgggctgggattcaggtgtgaacaacgggccggtggtgggtttttggatgttcccaaaaaaatga

SEQ ID NO: 538168 - DNA, 305 bp, Homo sapiens
ctggttttccctcaacaacatatattatacttgctactggacaagtgtttaagacttagctaggtttccattcagatcttcatatctgtcgcatggcagaaagctgggttcttggcatagacttgcatgatatgtaagattttggggcattcaaactggttaaaatttggtgctccaaaagttgacattagcatgtacaggcaggtttccggccggggcaccaaaagtttaaaaaagttgtctaatatttgctgttgtatacccaaatacgcaccgaataaactctttatattcattcaaaaaaa

SEQ ID NO: 538169 - DNA, 634 bp, Homo sapiens
  misc_feature (254)..(254): n is a, c, g, or t
acgtatctgaaaactggagggccttcaaggctctcatcgctgctcagtacagcggggctcaggtccgcgtgctctccgacaccagcccacttccatttgggaccaaaccaaccgtcacccctgaatttctccgcaaatttcctgtcggcaaggtcccagcatttgagggtgatgatggcttctgtgtgtcttgagagacaagcgccgattgcctactatgttgagcaatgtaggagctgccggggaagctactnccagatggcagccagcccagcgtggctgcagctgcggtgaagcttctgctggattcccgatgatagctgccccccagccagataccgtgggtgttccctcaccttggtccatcactgcaccacaacgaaactaggccactgcagaatgcacaaggaggaagtgaggcgaattctggcggctgctggatgcttacttgaagacgaggacttttctggtgggcgaacgagtgacattggtgacatcacagttgtctgcaccctgttgtggctctataagcaggttctagagccttctttccgccaggcctttcccaataccaacgctggttcctcacctgcattaatcagcccccagttccgggctgtcttgggcgaagtga

SEQ ID NO: 538170 - DNA, 197 bp, Homo sapiens
gcaaagctgagaacatggacggttaatatcgccccactccgcgccttgggacgatttctttcccggggttccgatcgcttttcccggccggactttcagggacatttccaaatgggaacaaccgcgtagtggggcaacctgtctctttttaccagacaactacctggggggggggctgccatgaaggatttccattg

SEQ ID NO: 538171 - DNA, 191 bp, Homo sapiens
gtttgcacgcagattgtaatgggtatggcagacatgtcatactaagtaatgctaaggttgagtggtatcgaagttttttcataggaggctgtatgagattggtcgtaacggaatcgggggtatgctgttcgaattcataagaacagggcaggttagaagcagggtcttggttaggaaaggccttggtgagg
